United States Patent 9,073,990 (PROTEASE-ACTIVATABLE PORE-FORMING POLYPEPTIDES) - sequence listing, part 6

SEQ ID NO: 15736 - protein, 282 aa, Vibrio alginolyticus 12G01
MKKTLSIAVAALLSSTAFAGTFAEVSQATDNETAVKVGHSLENGISFDIEGVYSNNGFSDVLGNKKSNGYKETTLGAAWKVELTDNVWVQPQIGYTMPSGNFSATATSGAEPSPFESTEYRASGDKGNTLKIGLKGGYDFDNGMYVAGRYRYDMREDNLKISAESGAKTDNVDIEGSANVHRTDLTFGYKMEVVDLSMNWIHKDGEDKIDLKNATKHKSRAKSTRLDKVEASADEFEFKATLLTADNLKPYVQYTVKNDINVKGGKNFAKDNVFKLGVNYSF

SEQ ID NO: 15737 - protein, 408 aa, Vibrio alginolyticus 12G01
MTQNMRLFKKSLLAVTVALASGQTMAAGFQLNAQSATGIGRAFAGDAVIADNAAVMARNPAAMALFDEKALSLGFESITSMIEVKDARYQGLTAPAGKESNYDDAGDTSIAPNIHFIMPVNDKFAWGVNAYSNFGTKTEFDDSFVAREYGGLTDVKSANFGLAGSYRLNEQWSFGAGLDIIYGQGTMKREHALIGTLVDVDKADGWAVGFNVGTVFELDENNRFGFSYRYSPEMEAEDDKGQKITLPLPDMAEFSGYHKITDTKFAVHYSIQYIGWGTFDKIEFRNLKDNSPAIGASYDKAYEWQDGWHYAIGGTYYLNNDWTLRAGYMYDTSAQDSLTSVSVPDSDRQWLSTGFTYHIDTKSNVDFGFTYLMGDDVKVNESTAGVSSLTATTHADAILFGLQYSRTF

SEQ ID NO: 15738 - protein, 442 aa, Vibrio alginolyticus 12G01
MKTNKTLLSTAVALSLLGTTGMANAAGFQLAEYSATGLGRAYAGEAAMADNASAQWRNPAMLTYLEGTQVSVGAIYVNPNIDIEGDVNFHGSTSSASSDDFAHDAIIPNFYLSHQYNEKFAIGLAFGTNYGMETDLGKGFGASHFGNEASVTTMEANLNAAYKVNESISVGGGIRYIIGEGSFGAAAPKNNVVGKHPLTGDPISVPQGTALKYMEGDDTAWGWQVGTAWQINENNRIGFAYKSEVELKLEGHAEGLGFGFGTSELPQLRDNGYMYLNLPATAELASFHQVTDQLALHASFNWTDWSSFDKLEARLDTAGTHMVKVENWEDNYRFAVGATYQLDPKLALRTGIAYDTSAVSDKNRTITIPETDRTWLSIGATYDWTKDFSLDAGFTYIFAKDAPIVESRGYKSDDAAEQVGGQFVGETTGNVWLIGVQANYRF

SEQ ID NO: 15739 - protein, 270 aa, Vibrio alginolyticus 12G01
MRKSLLALSLLAATSAPVMAADYSDGDIHKNDYKWMQFNLMGAFDELPGESSHDYLEMEFGGRSGIFDLYGYVDVFNLATDKGSDKGSDKAGAPKIFMKFAPRMSLDGLTGKDLSFGPVQELYVATLFEWDGTDYKTNPFSVNNQKVGLGSDVMVPWLGKIGLNLYGTYQGNNKDWNGFQISTNWFKPFYFFENGSFISYQGYIDYQFGMKDEYSTASSGGAMFNGIYWHSDRFAVGYGLKGYKDVYGIKDTDGFKSTGFGHYIAVTYKF

SEQ ID NO: 15740 - protein, 196 aa, Vibrio alginolyticus 12G01
MKKVLMSLFVAGMCAAPAYAAGPYVSASAGLGLLGNSDFKGVVEVKDVIEYNSGLVLNGAIGYDADMFRGEFAVGYQSNGVDTLGGVSIDNLDVSILSFMANAYVDFEMKDSALTPYLMAGLGLASVDFSDDGGDDFEAESVFAWQIGAGIGVKAADNLTVDLGYRYFVPSDVEIDDVDKITLASSNIMLGLRYGF

SEQ ID NO: 15741 - protein, 740 aa, Vibrio alginolyticus 12G01
MTGVSALAFALAASSALAQTAEPQAEPQATTLDEVVVTARRTEENIQDVPVAVTAFSQEGLRQRGIETGTDLQNFTPSLSVVGNTNRNQENYTIRGIGGIGSLGTGGGPGVVAYFAEVPSTASGPGLLFDLQSIQVLKGPQGTLFGRNTTGGAVLLDPVKPGFEPDGYIEGTVGNLDRRSARAAVTLPLSDSLSLRLAGQFDQREGFVTDVNTGKDYNDRNNFSLRGGLLFQPNDRISSYTAVNYVDIDENGPGTVLLAVNPAGPVAALLNPLLAAQQARGNDRIALSADTKNVSQTLLALNNTTFQLTDNITLKNVLSYTRTRADFGSDGDASILVINDLNGAIPGRWNVDNETWTEELQARIELGRLTFQTGVFYSDTSTVTPLTFVQRANLGAISLVQDSAHVNDSSKAVYGQFTYAITDTLTANAGYRYTWDEFGGDISIYIPQLGNACGTNPGFAFPNCSRAFEGESDGGTWQLGLDWQATPDTLIYGVSRHGYKSGGINPSVLLVSATSPLFNIRPETVTDGELGLKHDWSASGINARTNLAVFYMKYEDIQRSDYALIGGFNTQLITNAAEATVKGFEFEGVIQPIAPLTITATYSYNDATYDKYIDGLGVDRSGFPFQYVPETKYSLDAKLFLPVPSTIGDVSVRASYAWQDDQQVASDLQPFGVIPAYGLLNVRLDWEHIAGSDVALSLYGTNVTDEEYRVTSNATYNTTGLVGAAFGDPRQYGVTLRYSW

SEQ ID NO: 15742 - protein, 781 aa, Vibrio alginolyticus 12G01
MQKNLWVIGLSIIMFSGFAQAQSNKVLSIPAQNLPDALHSLSSQTGIQILFTAEQLKGFQSPAINGSMNTEQALIRLLQGTSYTWLASGQNTYVIKSAAEVATVMPEVRVTGAMNPDTPGNPSYTRTNASTATKSNLPIMKTPMSVQVIPRAVIEDQQAVQVNDAVRNVSGVFPGFTFGGMSQAFMIRGFDTGFASFRDGFRFPLALRFSLANIERVEVLKGAASNLYGRIEPGGMVNLITKRPQAERYYSLNQQFGSYGQFQTLADATGALNETGTLLYRLNFEYLNQDSFRDFGFNKRIFVAPSVTWRITPDTQLDVDFTYNNEDTREDHGIVAIGNRPAKLPRSRFLGEPADKTTQNMYNTAVTLTHAFNSDWQARARFNYLRRDTVDPQTTGFDLNEATGDMQRSFYGGTATGDVFMSTMDITGRFYTAGVEHNVLAGWEYYGQFGSVKSISVDASPINIFRPIYSNVNLASQPYNFFIDQKNEWNGVYLQDQITLFDKLHIMAGGRYDWASNDVGTAFGIDKFLSDAKAAGREINNNRFSPRAGIVYQPWEWLSFYGNYVQSLGAANSAFDANGNILKPQIGEQFEGGFKTSFFDGRLNSNVAFYYLTKQNLAFRVPGQPYSIPIGQARSQGVEVDISGQIIQGLNLILTYAYTDAEVLEGANKGNRLWNVPKHAGSLWARYDVQYEPLRGLSIGAGIYAQDKRPGDPANTYFLPAQARVDAMVRYRPPAMHSRLSLQLNIYNLADSTLYGGTLGDRFSVNVDVPRTFVGSIRYEM

SEQ ID NO: 15743 - protein, 713 aa, Vibrio alginolyticus 12G01
MKLTPVSAAVLSVLAASQVHAESKVFSMEEVVVTANKIDQPLSKVAGSVAVITNEQIEERGETELYDVLRNEPGVSVTGGAGRPQNITIRGMTGNRIMIVRDGIRSADGFGANDINDAVGRDTFDLSNFESLQIIKGASSSVHGSGAIGGVVILESSQPGDFLKDKDFYTDVSGTYTDISNKYKGTSNLAFRSGDTESLFNVSYWQGQETRNFDEDLYNRDLDGYSGAYTINHFFNEEVMLKAKAELYTQNQERLEGSPSIQPDGIWHIEDFAEDETSEEYSAYIGAEVTPINTTWFEELDTKVYWRHTEVVEDTNRLMRQVDHNGLITKRRELEHKTFIDETIGFRGDFTNTIFAANTEHQLAYGIELSTDYYERTDSDSKIDWNGVTPSTKQPFAPARAYNIGLYVRDMVELDKWTITGGLRFDAHRLTPDGEGEVGGFPLKDMDSSEVSPSLSVSREMFANNIVYVSYNHGYRAPEYDKAYGFVNHDFVPLTPFVIAPNLDLEAETSDSFEIGNKFDNGRAYVYASVFYNKFENFIDVVTTGFDSSTGNYIKQYQNLDGVETYGAELSAGYALTKQWDISTKFGYVDGKDAEGEYVRSITPFEGNAQLKYANQDFNAYVAWNWAAAMDRVPKCQTTLGLATECAQTSAWNTFDIGATYYVSKDLRVSANIVNLFDKEYIRYQDVAGIAEESKRYSTEPGRYFTLNAKYEF

SEQ ID NO: 15744 - protein, 315 aa, Vibrio alginolyticus 12G01
MKLKTLAVAVALLASGSQVVASELYNQDGTSLEMGGRAEARLSMMDGKAEDRSRIRLNFLGKQEISDSLYGVGFWEGEFETFENGGVDGNSDLETRYAYAGLGGKYGEITYGKNDGALGVITDFTDIMAYHGNTAADKLAVADRTDNMVAYSGQFDQLAVRASYRFADRTTDANGFDDNEQDGFSLSGIYAFADTGFELGAGFASQDKDDQYMLAASYTVGNFYVAGNYTDIDYDSVDYKGYELAAAYTMGQTVFTSTYNKGEEESEETVENLAVDVTYYFKPNFRGYASYNFDLMDNEGSNEQDELALGLRYDF

SEQ ID NO: 15745 - protein, 815 aa, Vibrio alginolyticus 12G01
MKKSTLGLAVIAAIPMFSSVQVLAADEAAKSIEKIQVTGSRINRTDMETASPITVIGDDFIAKSGYTSVADVLSNQPSAAGMSLGGSSNNGSGGTATVNLRGMGSQRTLVLLNGRRMVSSGTGADSSVDLNTIPVAMIKSIEILKDGASAVYGSDAIAGVVNIITKKDFEGSEVNVEGSRTTKGDGNNYGVSLLHGMQIAEGNLVVGAQYSSRGEIIQSDRSFVEPGQSSFIPEGTLGGKMPDGNGGFIDRNKGYDYTTSSYAQTPNDLYSIFTSFDKELDSDTTFNVDLMYTRRDSTQQLAPQPANIDLKTANLDAAYTSAFVDGKGALADTLEYRRRMVDAGPRIYEQKTDTYRASVALAGTLDNDASWDVSATYGRNDSKDKVQNSIHASNVEQSIYANQALWFAGDALNRDMLVSDGAIYTESNEGGNEQFILAAGYSALTDNDIGYAIGVENRFESGYYTPDMITQRGESTAAQQDPTEGDYSVQSVYFEASMPVLESVTIEGAARYDNYSTFGGATTWKLGATWNVTDEFMVRSVLATGFRAPNVAELFGGNSGSFDYLEDPWGNEQDPQIEVNYTSDKNLKAEESKSFTFGMVWEITDGLSSTMDYWKFDITDAITRLDVQNEMRNCFAGTLESCSSINITSTGDLSNMSSALTNVGSQKTSGVDWNISYKADNYAINLDTTYLIEFEQDDIDYTGTIDGNIGGYAKIKSNLSVNYDVSEALSFLYNARFVKGMDGEYYGDFFSTDNTVYHDISMSYSVSDDLRITGGMNNIFDKEPESVLGGNDMGTVPEIYDVIGSRIFASVNFKF

SEQ ID NO: 15746 - protein, 712 aa, Vibrio alginolyticus 12G01
MSYQNLDGKVRVRAGLSTTYSVLAIAIASATSMSAVAAPAAKNETTVMETVVVTGSVIGNSDIEDVKEYPGARTVITRDQIEKTAAGSIDNALQRVPGIKVQDESGTGVLPNISVRGLKASRSGHAQFLMDGVPLTLAPYGHTGQSIFPATLSMLDRIDIVRGGAAVQYGPNNVGGVINLVTKPIPHTWQTEISNRLTVFDGGDAPLNDFYLRTGGWLSDTFALQLEGNFLKGESFREHSDTDVKNFQAKAQWLLSDTQEIQAFLQRYDAETQMPGALSPQDYEQDRHQSKRPYDDYEGKSTRWSVKYIHDLPFADSAELEVLTFGHKSERLFKWGFNSAGGHWADPALPATDVRTSPREFTVYGIEPKMAMYFGEGKSVTQNWIVGTRYVNEDIDYKLTQTPIVGGATKVPRDWHLDTDAFAGYVSNEIGLFNDTLKVTPGLRVESVRMTFTDRGKKQTADNKVTEWLPGLTVAYNVTDQWVTYANAQKSLRAPQIAYIRGLGEEGSELAWNYEVGARYTQDATSFNAALYRIDFEDQLQWQSSTQTFDNIGKTLHQGLELSARYVPEVLPALSLGASYNYLDATLEEEGANKGNQLPYTSKHQLGWDATYAFYGMDTTLSGFYFSDSYTDNANTSAEDATGATGKVPSYMVWNFNLGTDLYKDDKGKLRMNVAVNNLFDEEYYFRGIDTSPVGRYPAPGRSYTLDLNYQF

SEQ ID NO: 15747 - protein, 678 aa, Vibrio alginolyticus 12G01
MNKLLTLTPLAVAIGSSLVAPSAVASEETNSTSSATETIQVFGHKYEGYAEHMPQSGTKTDVEWLDVPQAVSVVTKTEMQDRGAVRLVDALDGVAGVNNTLGEGSRDQFMIRGFDSLNDMYRDGLRDDGTLQSYRSLANVERVEIVKGPAGALYGRGSAGGIINLVTKRANGENFTHVNGSVGSNNQYVGQVDSSMAFSDKVNGRINLEYRQADSYVDHVDSNDFFIAPTIRVLPADGHTIDIDVEYAHQELVPYRGVPSKNGKPVDLPVSTYFGGTNDYQESDSLRIAVDYEWRLNDQWVWNNRAAFNHIELEQKGTRQGKVTGNEVSQTVNNFGYDPRTTTTLQSELVWETRDNQLMVGADFNQIDIDLTLASDKTLPPQNIYDPVVGPTTDPGFKPFRDNTTTTTGLYVQDVYTWGDLSLIGNVRYDSMELEQQKAGSDKEKLDDDKVSYRAGLVYRINSDTSVYASLARSWQLPYAGIYINPKLAEFFHTDLKEVGAKAYLLDNALMLNAALFQIDQEQPQTNVDGDVIDKIEVRHQGIELEARGQITKQWDISVGYSYLDAEDKATGKKPNDVSDHLFSLWSTYQLDDKWRLGGGVKYVGDRYAGNDEAVALGDYTTVDLMAAYTTGRHKIQANAYNILDEKYILGATNGTSGLNQIGYGAPAEFMLSYGYQF

SEQ ID NO: 15748 - protein, 1026 aa, Vibrio alginolyticus 12G01
MKKYILSLFFLISCVLNTYAHTEKQQQEKIEISGIVLDQNKEPLVGVNVSVKDIPGLGAITDINGKFKIKVEPYQWLVFTFIGFDKQEILVKEQKSINVIMQEAKATAIDEVVITGTGAQKKITMTGAATTVDVNTLRTSTSSITNALAGNVAGIMARQTSGQPGNNISEFWIRGISTFGAGSGALVLIDGFERDMNEINIEDIESFTVLKDASATAIYGSRGANGVVLITTKRGKSGKVQIDAKVETTYNTRTYTPELVDGYTYANLMNEARTTRNKEAFFSDEKLYILRNGLDKDLYPNVDWMDVLLKKGAPTYRATLNLNGGGSLARYYVSVSYVDEGGMYKVDEGLKDYNTNANYRRWNYRLNVDMDITKSTLLKVGVAGSLDKKNEPGMAGNIWASAMRNNPISVPVMYSNGYVPAYGSENDQLNPWVAATQTGYQETWNNKLQANATLEQSLNFITKGLKFIGRYGFDTNNYQWINRKKFPEMWRAEQNRASDGSLVMKKIKDEQLMTQESSSNGNRKEYLEAELHYDRTFGDHIVGAVFKYSQDKTIDTSQNGNDIMQGIDKRHQGLAGRFTYGWKYRYFFDFNFGYNGSENFAPGHQYGFFPAYSAAWNIAEEPIIKKHLKWMNMFKLRYSYGKVGNDVVGDNDQRFPYLSTFGASGGFNYADIGQKYEFTGLSYTHYATTAVTWEIATKHDIGIDFSLWDDKFTGTIDYFHEQRDGIYQQRNFIPISVGLNGAMRISTNIGSVLSKGFDGNFGFKQRIGDVNLTLRGNFTYSKSEILEYDEEYSNYPYKSQRGFRVDQTRGLIALGLFKDYDDIRNSPKQSWGDVMPGDIKYADVNGDGYVNDNDIVPIGATTRPNLVYGFGLSGQWKGIDINVLFQGSGKSTFCIDGPTVYPFENGDWGNILTDVVKSNRWILGENEDPNAKYPRLSYGGNSNNYRASTYWLRNGSYLRLKNLEIGYTIPKSLVNKMHLNNIRIYFMGTNLVTFSSFKLWDPELGSSNGQKYPLSKSYTLGLTINI

SEQ ID NO: 15749 - protein, 897 aa, Psychroflexus torquis ATCC 700755
MKKNYSQLMQSFIALLFISLTGAYAQQSTIQGTVSDKFEPLIGATVVVNGTTNGTTCDINGKYTLAVKPGTYKLTASFVGTQSQTKEVTVAAGQTATLDFTLAPSLSMNEIVVVGSRAEPRTLMETAVPVDIISSKEISNSSQENVGQILQYLAPSFNSSQQTISDGTDHIDPASLRGLGPDQVLVLVNGKRRHTSALLNVNGTVGKGTVGTDLNAIPAAAIERIEVLRDGAAAQYGSDAIAGVINIVLKKQVGVAQINSQLGVTSEGDGAMGRLGVNYGFRVGKKGFVNVTGEFVDREATNRSGDYTGTVYGDARDNDLTDFFAQTGLGGKRVMAIGNSAGRNGQVFFNAEVPIVGGGELYANGGFSFRKGRANGFYRFPKDQNRVVLSIYPNGFSPEIHTDIVDRSLTMGLRGEKNGWNLDFSNTRGANGFDFNVENSNNASLGAASPLSAYAGGFRYGQNTTNLDISRKLDIGFDLNVAFGAEFRLERYEIVSGEEASYINGGQESQPGVPGSAGIQVFPGFQPQNELNQTRTNTAGYIDLEADITEALLVGVAGRFESYSDFGDNFSWKTVARYKINQTLSLRAAFSTGFRAPSLHQYYFSNLSTQFITIGANQVPVQVGTFNNESNVARAFGIDRLKPEVSQNFSVGFTTQPVAGLSLTVDAYNIDIKDRIVLSGRFDAADYPFLTTLGAGAAQFFTNAVDTRTQGLDVVANYRNDLGKGAITLTAALNLNQTEVQGQVKTPPLLAGREEQLFNREEISRLEVVQPRSKLILSALYELGKFAFTLRSTRFGEVQFLHPNDGNPANWVVNEFTGEVETRDQSFSAKFVTDLDIAFKPTTSLQLAIGANNLLNVYPDKLTHSANTSLGRFVYSRTAANFGVRGMFLYGRVSLKF

SEQ ID NO: 15750 - protein, 280 aa, Psychroflexus torquis ATCC 700755
MNYKKILVRSALISLMSILPYQSFADPVGSRTNDNKEGFYISAKYNPSISHFRKFSAEETPINGTNSLTKKVFGLKKDGDITKKDDFTRVAPGIDFQNNLISGFSGSIGYSMDGPRIELEAAYQQFNPKNTDNNDTDNGEYYKHFALSRKDAMEEQQYVVLKNDGITFMSLMVNTCYDITAEGVSFVPYACAGIGADLITIFKDLNLKFAYQGKIGISYPITPEVSAFIGGYYHGVIGNKFEKIPVITPVVLKDAPQTTSASVTLDVGYFGGEIGMRFTF

SEQ ID NO: 15751 - protein, 3766 aa, Psychroflexus torquis ATCC 700755
MVFEWWVGIMSARIAETMFRSQGESFRQPLLRKRLLRSSALIPFLALVLLAPPAFAGGGGNGGGNSGSPGGLDNYDAGGTGGTGTAATSIGSGGGAGGGGAGLTGGAGGAANGTNGAGGAGGTHAYVGSGSGVTNSLTGGNGAAGSSGSNNGGGGGAGGTAVVITGNSSGVLNWSSATFTLTGGVGGAGGSGSSAQNGGEGGTGGDGLYFGQDITFTSSNSLLITGGQGGAGSNGRAGGNGIEFATGTNSRATINGQVQGGAGGTSTKTNSNTGNGGNGILADTLDLTLNAMVSGGAGSSGAGDVGGGAGGDGISALAFTGMINAAVTGGTGGSTGASSSASAGSGGYGLRLNGASTVTVNANVTGGNSGAASVSGGYGGIGIYATPSLSLTIQNNAIVRGGDAGAVTGSAYTTGGSGIYLDYATSDITLLSGQVIGGNASGSDSAATGGYGIESHGAPSVTITLGAGSTISGGLGGNGMSDRSARANAIFIENFDGTPATNTLVLLGSGGTSGSTYATIIGDVVATPADSTTNKMTFGGAGGVFDVGQIDLGAGSSAATIFRGFTEFTVDTTGTWIMTGASTTGGTALPATWTVAAGTLQLGNASTAGTLLGSVGVNSGGTLANGGRTATVTNGVTVTSGATLSLTAVSGGPALSITSGNLNLNTGSTLTITLGAPTTQSLISVAAGSAVLGSTLNITDAGTMAAGSYTLLSYSGTLSGPGLTLGTTPSAFQFSVDTSSTAGQVLLLVTGGAPTVIYWNGSTTGGSSGPVAGGTGTWTAASSGVTNWTNSAGTSRVVSDPSLTAIFAGTAGTVTVSAASGAVSAKGLEFDTSGYTITGSELTLVNGSTMPQVNVVGSSASATISAPLAGSNGLEKIGDGALSLYGANTYTGNTTITAGTLTVGGAGSLGSGTYAGNISIASGTSFNYASSAAQTLSGNISGDGDLTVGGTGSLTLSGNNTYTGGTTNLNGALVASGGSAIGDTSAVLMGNSASLTISAAETIGSLAGAGTVAISGQLTLGGINTSTTYSGVISGAGGLTKTGTGTLTLGGANTFTGALNLESGTLLVNTTGSIASASSVNLSAGTQLTLSGGGSKSIKMLNDGVGGTGTAYLQLGTTALTIGLGDGSGTFSGAITGSGSLTKVGTGTLTLAGANTFTGGLQISGGTVTVTGGSAIANTANVTVGTGATLTLQASETIGALSGAGSVTATGGSRVLTAGGNNTSTTFSGTLSASGGNSIGLVKTGTGTFTLTGASSYAGGTTISAGTLQIGDGGTTGSITGNITNNAALIFNRSDDLTYSGGISGTGTLQKAGSGKLTLTGNNSMTGLTTVSAGTLALTGGMAGSVTVNSGATFASTSTGLIGGTLTIENGATLTATSGNLFTVAGLSLASGSIINLTANTPTTTAAVSVTGGLVLGGTLNVSAGTGFGSGTYRVITYGGALTNNGLALGSTSSDSLYYLNTATIGQVNLLVAVGQWWNGAVTTAGGSSVAGGNGTWDVAAATTNWTNTTGSSADAWGQGGLALFGGAAGTVTVSGPTAPQVAGLRFLTDGYTVTGGQIGLSAFATGATPAILVDTGLSATIASQLTGSDGLEKTGAGTLILTGTSSITGGTTITAGTLQIGNGGSTGSVAGNIVNNAALVFNLSSDTTYAGSISGAGTLEKTGTGTLTLSGSNATTGLTTVSAGTLALTGSLAGSVNVASGATLRGSTTGIVGGTVTIANGGTLAVASGNLFTAGALSLGSASTLAFTAGTPTTTAAVGLGGSLTLDGTLNITAGNGFSTGTYRLINYGSSFTDNGLAIGTAPTHSLYRIDTATLGQVNLVVAAGQWWNGTTTTAGGSAVVGGSGTWNVAAGTTNWTNTDGSSADAWGQGGLAVFGGTAGTVTLSGGTSPQVAGLEFMVSGYTVTGGSIGLSAFSAGTKPAIYVESGASATIASNLTGTDGLSKTGAGTLIFSGVGTYTGGTSIAAGTLQIGNGGSTGSVAGNIADDGALVFNRSNDLTFAAVVSGSGSVTQAGSGGLILTGANTYTGGTTVSSGTLQIGAGGTTGSIVGAIANSGTVAFNRSDDIVASGAITGSGSLVQMGSGKLTLTGSNSAAGGTSVAGGTLEILSGATLASNVVVGSGATLQGETGGTAGAVLNGAVTVQNGGTIRAAATGTPGLYGLSMSGLTLSNSANINVNLGANTGVAVLQATNLTLDGVLNISNTGSMALGVYRLIDYTTLVADNGLAIGTVPSQFAYSVDVVPNHVNLSVLNGSLRYWNGTTTTPDGTVHGGSGTWSSSVSPANWLTAGLNQSVPWNSEFAVFSGTPGNVSVSGTVSTTGMQFMVDGYSLGAGTIVLAATSGQTQVRVGDGTGLGASYVATLGSVIDGTTGLEKTDLGTLILTGTNTYTGNTTVSAGTLQIGNGGSAGSILGDVAVASGATLAFNRSDAVSFGGVISGNGGFTQTGSGTLTLTGNNTYTGTTTISGGTLQVGDGGTSGTLAGTVVNNAALVFNRSDATSFAGAISGTGTLTKQGAGALTLSGSNSFTGATTVAGGTLAISGGASLADGARLTVASAATLSLLDANETVGSLAGAGTVALGSQTLTAGGDNTSSTFTGTLSGTGGLTKVGTGTLTLGGTNSYSGQTTVSAGTLVAQGNAALADGTAVSVASGATLDLQMTGTKILGGLSGAGNVQLNATTLSVGGDNSSTTYSGVLSGTGGLTKTGTGTLTLSGTNTFTGTAQISSGALALMGSVGGDVSVAAAATLSGTGSVSGTVNVLSGGTLSGTQPTGLTMGGLTLASGANMNVTLGAPSGSGLFTVNGNVTLDGTLNVTQAPGFGIGIYRLASYTGTLTDNGLDVGALSGGLLGGVQTAVAGQVNLLVESPNNALLFWNGANTTPTGSIVGGAGTWTASNQTNWINGSGTIAQNWNGSFAVFQGTAGAVDVDASNGPVSASGMQFATSGYIVSGAPIVLTGSGPATLRVGDGTGAGAAMTATIASALTGTTGIVKTDLGTLILSGANTYTGGTTISAGTLQIGAGATTGSILGDVVNNAALVFNRSDATSFAGAISGTGTLTKLGSGELSLTGTNTYSGGTTIGAGTLRASSAQALGSGGLTINRGGTLRGSSSFTFGNNVVLSNAGTATTNAAISVDAGQTVNVSGVISGSGALDKTGGGTLVLTGTNTYTGTTTISAGTLQIGNGGTTGSLLSNIVNNASLVFNRADTYTFTGSITGTGSVTFLGGGTVQFSAPYTGAVGVDDSTVRLVAGTTTSSPFTVNNGGVLGGTATIGGLTVNSGGTASPGYSPGTLTVNGAVTFNAGSVYAVDLTPEGAHDLIIASGNVTLSSGATVAVNATAGVYPRSGQVTIITTSGTVIGTFGAVTSNYAFLTPSLTYDQQNVYLNYVYNGIRFSDYARTPNQANVAVAAQALGDASPVYQALFALPQGAVAPAFDQLSGEIYPSVSTVIQQESIYVRDAVGARLRQSVTGGDADALSAAAKATGQATAALSQDLTPTLWAQGYGAWGNAFGNGNAATIASSVGGFLAGLDVAVAPNVRAGIVGGFSQTKVDVNARSSTGTIDNYTVGLYLGGQFGALGLRGGASYSWHDIQADRSVLFSGFSSAQSSGYSLGTTQLFGEAGYRMAFGAYELEPFAGLAYVNLSSGSATETGYGSAGLGVNVQGMSTLYSTLGVRAATSFLLGGRALTPSATLGWQHAFGDTTPTAATRFLGGATPFQVQGVPIAEDTMLVGAGLAYALSDLATIQVNYSGQLATTASQNAVSAQFSLKF

SEQ ID NO: 15752 - protein, 560 aa, Psychroflexus torquis ATCC 700755
MKKSHQRSMKLAVLPCMIAVALSISGCTFSEINKMQKKAQEDSAHAREKVSALSARKSQALTWLDNQWINPVPVAQVSREKKQTAPACYITQARKGEITLQELGQRITAVCGIPVIITPDAANSTLEGGATRQMTGTLPAPDENGRLPLSSLGSTTMTTSTQPLTLNNLMWQGDINGLLDLMASRSGLYWRMDNGRIVFYLTETRTYPLHMLNTKTSSSSSVSSGSTSTMGATGGQDNSASGDATSSQSTTVGQEYDLYEDIRKTIEAMLTPEKGRYWLSASSSTLTVTDTPAVQEAVARYVDEQNSIMNRQVALNVQVLSVSNTRNEQFGLDWNLVYKSLHSAGATLNNASGDFTGATSAGVSILDTATGNAAKFSGSSLLIKALSEQGDVSVVTSQESTVTNLTPVPIQMADQTVYVAQSATTTTTDVGATTTLTPGMITTGFNMTLLPLIQKTGNLQLQMNFNLSDPPTIRSFTSKDGNSYIEMPYTKLRSLSQKVNLKEGQSLVVTGFDQNNTTTSKAGTFTPANPLFGGSQTGKNERSTLVIIITPTFPSGGNNG

SEQ ID NO: 15753 - protein, 784 aa, Psychroflexus torquis ATCC 700755
MKHIITLLSIFAISTVIAQNKQATISGTVTTNGIPVPFASVYVKGGTQGADTDIDGKYTLHIPFGDHTIVAQLQGFRLSSKKITIAETENQELNFVLTEDGLGLEQVVVSATRNRISKKEAPVIVNVLSPKLFQATQSISLADGLNYQPGVRVETNCQNCGFTQVRLNGLEGQYTQVLVNSRPVFSALNGVYGLEQIPVSIIDRVEVVRSGGSALFGSNAIAGTVNVITKEPVNNSWEVSTNLGVIDGSALDRNVNLNASIVSEDLNSGVTIYGIFRDRDSYDANDDGFSEITKLNNKSLGAKVFLRPNDNSRFGIDFTGINEYRRGGDRLDLAPQFTDVTEELEHNTVYSGIDYELFDDAQKNTGSAYISVQHTDRDSYYGGLGGGRTVADSIAANNAFGKTTDLALVAGTKYTHRFDKDVITTGVEYQLNDTDDAIQGYNRLVDQKVNSIGLYAQYEWKPSEKLTTLIGARLDHVNVDGYYTIQDIARASDVSETVLNPRVTILYNINEALQFRGGYARGFRAPQAFNEDLHISSVGGEQRFVILSDELESEFSNAFTASLNYTKDFNKVQTNFLAEGFYTTLENPFTIVSTGTSLPNGSILEETRNGSGAYVAGTNLEVSVSPNAAFLFQAGLTLQRSMYKEDQVLFEADGSVPGEQDVILSDFTRSPNAYGFINANWTATEALKFDVTGSYTGSMIAPHVISDSGFIDLVTTESFLDMTTKATYHFDPIEDFHVELSGGVQNIFDSYQDNFDRGASRDSVFIYGPNQPRTFFVGLKFGDF

SEQ ID NO: 15754 - protein, 1011 aa, Psychroflexus torquis ATCC 700755
MNYFSFYKDGKALYCLIFTGMLLTFSSSFAYNSKRHLNTFYQQNQVEGTVTDHTSPLPGVTITIKGKSNLSAITDYNGHYFINAAASDSLVISFIGFKTKILPVDGNSKIDITLDYDTTTLKEVKINAGYYYVKDKERTGSITRITSRDIKRQPVTNVLATMQGRMPGVNIVQNTGMPGSGFTVEIRGINSLRSDGNSPLYIIDGVPYSSQGIGSSYTSANMPQQNSPLNSINPLDIASIEVLKDADATAIYGSRGANGVVLITTKKSKAGKTSFTADYSNGIGRVTRYKDVLDTPRYLAMRKEAFANDGVTQYPSNAYDINGTWDQNRNTNWQRELIGGTADYTNLTSTLSGGSAQTQFRLSGNYSKETTVFPGSFDYIRAGGRANINHESEDKRFKVNFSAVYTAQVSSMPLVDFTQTALQLSPNAPALYDQSGNLNWENNTFQNPLAILNGKTKGNTYDLFANVSLSYELGAGFTASGNFGYTDLDQKQINLQPSTIYNPSYGLGTESSLAISNVLNRNSWIVEPKLSWVKNIGNMTIDALAGTTFQQQKGDQLITQSRGFSSNSLVSNPASSSTTTILNSDETIYKYQAFFARINLNLAGRYILNFTGRRDGSSRFGPGRQFADFGAVGAAWIFSESKWLNENISFLSFGKIRMSYGTTGNDQIGDYQFMDTYNTSGTKYQGISGMQPSRLFNADFGWETNKKAEFAIETGFIKDRILAGFAWFQNRSSNQLVGIPLPGTTGFSSIQANLDATVQNTGIEITLKTQNIINNNFSWSTNFNLTSIKNELLSFPGLDVSTYKNRYVIGQPLNLVKAYHYTGIDPATGTYQFEDVNGDGVFTANEDKKTVKNLNPKYYGGLQNHLRFHKLELDFLFQFVKQENYDENYGQPMPGTMNNQSTSIASHWQSEDKDQGTYQGYSVSNSSKLQAYLRYTQSDASISDASYIRLKNISLTYELPKTWTKKITCRLSLQGQNVLTFTKYKGIDPEFRSTGYLPPLKIYTSSIQLTF

SEQ ID NO: 15755 - protein, 267 aa, Psychroflexus torquis ATCC 700755
MTTLCEDPISQASIKELPLRKFIRFVLAAFLLSSAAVEATAADLPPVPATPAPTLPDAFQPWQIRLRAVGLITSSGGGNTVRAQANGAYVSDGIKASNAVIPEIDISYYLTKNFALELVCCVSYHKLFLKGGPLANTQVGDTWVFPPTVMLQYHWTDFGKFQPYIGVGVNYTHYFNQQAAYGVLSHLSVNDSWGIAGQVGFDYMINDHWGVNVDVKKIMMEPSVTANLGNGTLLRGGARIDPWLIGAGITYRFGGPDAAPAPVLAKY

SEQ ID NO: 15756 - protein, 1043 aa, Psychroflexus torquis ATCC 700755
MKQNLKQTARKRLAAMALFLLICLPFSLAQAQTIKVNGRVTDDLNEPMIGVSIFEKGTTNGVITDMDGNYSLSVKEGATIVYSYIGYLTQEKKAVAGVMNVILKEDTKTLDEVVVVGYGVQKKSSLTGAVSSVKSEDMEARTITRAEQALQGKTAGVQVLSASAKPGASPQVRIRGISSNGSCDPLYVVDGRIASDIGGIDPNDIESMEVLKDGASAAIYGAAAGNGVVLITTKKGKGNGKITYDFQYTSQSLGKVPEVMNAAQYKEFFLENKKLTQSAFDTYWDGKTDTDWVDEAFENSSMVRHNVTFQGGSDRGSFYLSLSHLDNDGMIVGNADTYERLTGMVNASWKIKPWLEVGTNNQIEHYKTQSVAEGNEYGSMMLSVLQLDPLTKPLYPIDDLPLNMATIYKDHKNMLGDGNGNLYGVSAFTGNAEAINPFAMRDNSYTKNRGFNINGSTYLNFMPIKGLTVTSRLSYRLASTSSYGVGQSYYYTDKAKRDWVEVSASDYSPTYYQWENFLNYTRSFGKHNATLMLGTSYSQSRSYGVSGSKKGYNEDTTDMWGNVINRVSHLGFLQNDPNFFYFAYATSDAVKDVSGGEPTYTRKLSYFGRLNYDYAGKYMAQFSLRADAADLSVLPKNKRWGYFPAVSLGWVLSEENFMKGTEDWLSQLKLRASWGQNGSTASLGGYKWNVSIGATGHLAVGDNNNFSYINGYAPSATGNDGLKWETSEQTNIGIDARFLNSRLTVTADYFHKKTKDLIVSGIKASTVVGNSFSPVNAGNITNKGFELELGWQDRIGDFAYGVRANVATLKNKVTKMHESLSSIDGATYVTYGAITRFEVGKPAWYFYGYDFMGVDSKTGEPIFRDIDGVEGITDNDKTEIGKGIADYTYGITLNAAWKGFDFILFGTGSQGNDVFCGLNRVDYNLNQLTYFTKNRWTESNRNGKTPASGATDYTKYLTSSGCVFDGSYFKIKQIQLGYSFPKQLIKKVAIENLRIYGSLEDFFTFTDYPGFDPEVTGVGNSLGVDKGSYPNSKKVVLGLSVTF

SEQ ID NO: 15757 - protein, 1016 aa, Psychroflexus torquis ATCC 700755
MRLLLSFLLTAGFLSAIQHSGSIRAADQFLPGATITARQGGAKLITSTDEAGRYTLDLTPGAWELQVELFGFQTATTKIEVGAEPTTYDWTLEMPRTTTPAAAVNKPSQGFQSMSVQVTAEGTPSLAAEPSPPEIPADTDAFVVTGSTSDGLAAAAGDQTRHEKQNKPARAGAAAQLNSFGNRRQNRPTYTGSLAFTARNSAFDAKPFSLNGQNAPKSSYGQNTIAFNLGGPIRIPKIYSNDRLMFYFTYQATRARNPYNALSTMPSAAERAGDFSQAAGAPAIYDPLTQSPFPGNIIPANRINPVAAGLLPYFPLPTYAQLAVQNYQIVTSSKTSSNNYGFRQNLPFSRKDRVNVSFNYQNRTGSTPTLLGFRDASNGSGFNGSLGHSHSFAPRFNSNLTWNFSRSTGHVLPYFAYSQNIAAALGIAGTTQDPIAYGPPNLGFTNFGGLSDGAASISRNQTSNINEGITLVRKKHNLTFGLGYTRLQQNPMNYANARGSFSFSGLLTSGFDANGSPLKGTGYDFADFLLGFPQSSSLQFGAKSNYFRTWNINAFAQDDWRIRPGLSLNLGLRYEYFSPYTELYGRMANLDLNSTITAAAVVTPGQPGPYSGALPTSLIRPDTNNLSPRFGFAWKPLGKKALTIRGGYSIFYNGSAYGSFAARLASQPPFIHSASLSTSLANPLTLQNGFAAAPSQTITNNYAIDPNYRLGYAQTWTFAVQQNLPHNSIVELEYIGTKGTGLDILRQPNRATPGSPLTAEQRLQIGNATGFSFETSQGSSIMHMGQVRLTRRLTRGISAVATYGFQKSIDNASTFGGGGGAVAQNDQNLRLERGLSSFDQRHHLNIQYVVTSPVGGAKGMLRGKGLARKLLEDWTLNGGFNATSGTPITARVSGNLANTTGIAAFGTGRAQATGLPVSGGSFFNLLAFTTPPPGQYGNAGRNTIPGLFQTSLNTSFGRAFRLAESKRQLTIRLNSNNVLNHTVITNIGATVNSATYGLPIAASATRSLNLTVRLNF

SEQ ID NO: 15758 - protein, 238 aa, Psychroflexus torquis ATCC 700755
MKKVKILSGVLLLCFSSPLISQAATLDVRGGYRSGSHAYETRLKVSEGWQNGWWASMESNTWNTIHDNKKENAALNDVQVEVNYAIKLDDQWTVRPGMLTHFSSNGTRYGLYVKLSWDATKDLNFGIRYRYDWKAYRQQDLSGDMSRDNVHRWDGYVTYHINSDFTFAWQTTLYSKQNDYRYANHKKWATENAFVLQYHMTPDITPYIEYDYLDRQGVYNGRDNLSENSYRIGVSFKL

SEQ ID NO: 15759 - protein, 374 aa, Psychroflexus torquis ATCC 700755
MKTKLAALAALAGCSALAQAQSSVTLYGVVDTGLLYQSTSAASFRPNAPNTGKVFRMKDGGIYSSFWGIKGSEDLGGGYKVNFKLQGSFDSGTGRLQLSDTPGAVAIFNQIASLGVSGPFGTVTAGRQIVPMIYAMADTDVRNAQFFGSVLTAWLGLNTAAGWPATSTNGAIGALYDSNALVYQSPTFAGVSLALEYAPGGVAGQFQGGTRESVVLRYSNYGLNASAVYYNGHDTNPAPGVAPTGVDNNRFVYVGAKYTIRDFSVSASYGNGRNPAHADRVNLDMLSAGVGYRFTPALQVASAVYYLKDRNRSANRSTAVVLTADYSLSKRTMVYAQAGHVNNRGTMDQMLVYGQPVAPGVGTTAAMVGLRHNF

SEQ ID NO: 15760 - protein, 539 aa, Psychroflexus torquis ATCC 700755
MQLRFNFGLLLILCCFQVAAKDSLDNLIKQQKNADESTLRAHKLEKKDVYSNAQRNAFTLGDLPQEKNCFIINRIELEDNFLGGQLISEVQKAIAGRCVGSAGVQKIAAALQDYYINAGYITTRISIPSQDISKGKLRFQVNAGKIEKTIVEGNDISEWMLPFQRNDILNIRDIEQGLENLQRVPDVDVKINIEPGTRDGYSIVHIDTHRGKNWSVRASYNNWGDEETGRYQTTSVGYLFNPAKMGDLFYLAGTRSTTGQYENVSSYYSIPVGYWEYGFFYSKSKSQQVIPLSYISLDYVGISEYLSAKATHTVYRDKTKKFAGSAELIRRKSNYTLNGEELTLQARDMGNIKLGLNYKQQLPGAFWDSTLSWQRFLTWFGGEKTPDMQYGDVSPVSNIFNFEGNYTRQIENGYYNTAFFAQYAPRELTLQDKITVGDRWSIRGFENSVGLSGNDGFYIKNTLAFPLPGMKANYYAGLDFGQVYQDASYGDESLVGSAVGIDGNIKSLEYNFSVSTPLKYPATLDIDRVNVNFNFSYQM

SEQ ID NO: 15761 - protein, 613 aa, Psychroflexus torquis ATCC 700755
MYQKSDAPRTITVTGTPIETEDTGQPVTIITREEIEQVQGPDLARILRRAPGVTISRNGGVGGFTGVRVRGAEAEQLLVLIDGVRVNDPSSPAGGFDFGNLLPGNIDQIDLLRGSNSTVWGSDAIGGVLAVKTRSESGIEGSAEYGARDSFNANLAGSIEGEDAFLSLAGGYYTSDGFSAAASGTEPDGFEQFALTARGRVFLSATTEVFARGRYAEGELEIDGFPFPTFTLSDTPEFQETTQYSGAFGLLHDNGPLYLQAAYSFAETERANFDPTFGTAPGFTSDGHSDRIDVKGEYRLIGPLLVNFGADAEWTSLETNFTPRQDVRILGGYVQAGIEFGGLSGHIGLRQDDHQRFGGATSFGADVSYEVAPDVRVKASVGEGFKAPSLFQLFSDFGNELLRPETSTSFDLGLAFRDRSAPAYAGITLFRRDSEDLIQFVSCFGVVGGICTGRPFGTYDNVARARAQGVEMEAGFTISDALRGRATYSFIDTEDRSAGALTQGNRLARRPRNAASASLDWDSARGLESLLRPKIGADLRYVSGAFDDAFNTVPLESYVVVDLRAELSVAQLNGDHPLVLFARVENVFAEDYQTAAGYAQAGRGVFAGARFSF

SEQ ID NO: 15762 - protein, 364 aa, Psychroflexus torquis ATCC 700755
MKFIKYILILSILFITEKNSYSITINNDNDKLINFHGKIFSKYTHPDISSIKKNVYLTYGIDAKWKLYGDTFLFWKIDYDFIKNKYQKKFKKDNNISLNILGINLDQYQTIKYGKDDIIINSISDLRNGIDTFNKSFNFDNIIIGSKPKKVITYYNKDLYNLIPGIKLAFQKILKWNSTILGDEIIDNFNNIKNYSNGAMISYYIKDNYLYFIASFLRNNSIYNLNMHEKKYNTNFLGMGLKYERFPFYFSLIHGKKWNNFNLNENDKYLEKNIFDNSTIELLTCYNFDKNIRPFLGYSVYKSKKIYDLKLIKDKEEKNIFAGTLIKINNNIETNFSYLIKLKNNKINNIDKYNNFSLIMTYKF

SEQ ID NO: 15763 - protein, 677 aa, Psychroflexus torquis ATCC 700755
MRTSSSNRLSPLCLAVASALVAQVASAQTDTPRMTAQTITVTANSSARDRAQNDSLYTEEYTPAQQASHLSDFLEVVPGVSVGGTSSVNQRIRVRGLDDTNLKVSIDGARQEGALFYHMGDVTIDPDLLKQTEVAVGNNSVTLGNDALGGAVAFKTVDAADLLKPGQKIGAKLHAGYASNNDEVLTSATVFAAPAENVDLLAYYGKRDVESGEDGDGRELFEDSKGENILLKAGATIADDHRIGASFSRTEKKGIFPFRPDFPSRPEDPIPQQVKRDTYNVDYGFNPANPLIDVSANAYQTKTQILRDSDGKAGYEFDAEVKTTGAKVENISMIESRIGNHKLIAGVEHYKKESAMSRDFAKASNDEAKNTSVYLEDQWHLDKLTLTPGVRYDRYESPKFVSDGKTYNNVVGALAASYEIAPNTQVFASYTQLFNGPDLSQTIFNSDGANTFVNRGLKPEEGDNSEVGISTVLRGLTLDNDALQLSAKYFKTNVENYLQFVRTGGGREGLDCNTGRPGGNCQGSVNSDEDYEIKGVELAANYTTNNFGMELSYSRARSEGDKTGNSIPSVSGGTADSGDRYMVNLNYDPTNELGLGWRSTYVASITDNNGITKPSYDVHDVYMSYAPRQFKDIKATLGVYNIFDETYANHSSRLSDSDAATDFEPGRNIKASLTYQF

SEQ ID NO: 15764 - protein, 562 aa, Psychroflexus torquis ATCC 700755
MAKINGYLSERDILTLSYNMTRDNANRPLRANFTGTFLPYSCGDFNAFPNEKNPSDCLFENDASLFKTYSVNLVHNVSLNYEREGGSRFGDPKLKINGYTSIRNVQIDPLFKPNDIAASIPFTPNPKLGEENECVAQGGIYDALKQTCSITFKSLGGGSVVANKNLFIINSGFNANVIHTIDHKNDNLLEYGLNYQNLTTFDKAIPNSELVKPGDAPDACLRVTSPNDPNMNGRCQRNGATANVIGVYAQANYTLHPMVTLGAGTRYDVYTLVDKDWQLHITQGFSPSAALNVSPLENLNFRLSYAYVTRGPMPGGLVWMRQDNLRYNRNLKPEIGQNVEFNTEYSSQYFDFRAAGFVQLISNYINQFSSTLFVTNLPAQDIIYVPGYEVSGTAKYKGFSLGLSVARSWPSLKGRLIADVYELAATTGNVFILTASYKIPRTGLSITWLSRFVTDLSYCSYSPYRNGPTDIDRRPSNCPKTPGIFHVHKPGYGVSSFFVTYKPTYKKLKGLSLNAVFNNVFNQQYIDQASPVMSPDEPNQDKYARGMAEPGFNARFEISYKF

SEQ ID NO: 15765 - protein, 754 aa, Psychroflexus torquis ATCC 700755
MMKVRPSRPLCNLEQRKMEWATSTRVRAIAAGVAFYAAAAGHAQAQAAQPGADARQPGGEAKADTAAGGTLPAISVSGAAERDASVGLVARRSMTGTKTDTPIIEIPQTINVVTAQQIEATGATDINQAFRYIPGFSSYGSDNRSDWYAALRGFTPTVFVDGLQVPNTINLSSWRVDPYMIDSIAVLRGPTSVLYGQGDPGAIVDVQSKLANGERIRELGVQVGNYARKQLMFDIGDTIGKDGTLSYRIVGVGRDGNAQTGPLADQRVSFAPSLKWQPNADTSLTLAATYLQDWGDTSSNFLPSRGTVLPNPNGTISDDLYTADANFDHYRKKQWSLGYQFEHKLNPVWTLRQNVRWMHLSLDDASVYGGGLDDADPTMATMTRYAGLFQFNYSRFDVDNQAQAKFTTGPLSHTLLFGFDYNRQTTTDSEWLAKGPSLNLYRPVYTPIPSDIFSGPNAYPRTDTKTTLNAFGLYVQDQIKWRRWVLTLGGRQDWTRTSQDDIANAASFRQNDHAFSGRVGLTYLGDYGLAPYLSYSTSFNPQIGLKLAGGGLATPTKGRQIEAGLRWQPPGKNLMLNAAVYQINQTNVAMSNPNDPTSSTFVQVGEVRSRGVELSAVGNLSRELSVIAAYVYQDVKNVRANDNTLNKWPVDVPRPRQIASLWADWTWRTGPLTGFGVGAGVRYMSAAAGAADNSLTVPSYTLFDAALHYELRNWRFALNATNLFNRRYVAGCQSDAVCMYGNQRTVIATAKYNW

SEQ ID NO: 15766 - protein, 759 aa, Psychroflexus torquis ATCC 700755
MKQNTIKMSCIALAISSVLSAQYAVAAEEQNNSGDKQPVLERIEVTARKTVESLQNVPVAVTSVSATELAENGISVMTEIQQFSPNTTLQSSRGTNSTLTAFIRGVGQEDPLWGYEPGVGIYIDDVYIARPQGAVLDILDVQRIEVLRGPQGTLYGKNTIGGAIKYVTKKMSGDGELSLKGTVGSYGQKDAKIAGQLPIVDDKLYVGFAFASLNRDGFGEFKTSALDGQDTENYNKDVMAGRLSVEYTPTDDLFMRFTYDKTQDDSNSKGGYRLLPSLLTDAPVPDSKYDSYTSMPTWNKVETEGWSATVEYNLNENWSVKSVTAKREGESLTNIDFDNTSLRIFDVPAIYEDEQFSQEFQVNYVGDNLNLVSGIYYFDGDSCGVFDAILEEAFKAYGGLTREVSGCNNSESYAAYVQGSYDFTEKLSMTLGGRYTRESKEATVYNGVIFDSIYPETDWYPGFVRDDALIESQIPKVLDDEETWSKFNPRIGLEYQVNEDMMVFTSYSQGFKSGTFNPRATGAEPAVDPETVNSYEIGMKSEWNDNLRVNATLFYLDHKDRQFVTVLPGEDSSDLNQRLGNIGKSTATGLELEVEYAATDSLNLFANVGLIDATFDEVISYDDLGTKIDISDTYTITNTPDTTANLGFSYSIEADVGSFIINGNYYYRSDYDLAVVDNLLSQDGYGLLNFGVNWYSNDGHWNAGLHWKNVTDEEYLVGNYAFVTPTGNGDFTPGLGGDNTLIGYYGDPETISLTVGYVF

SEQ ID NO: 15767 - protein, 1058 aa, Psychroflexus torquis ATCC 700755
MKQNVNLIFLFLFALISHIGFAQSQEVTGTVVDNSGLPLPGVNVIEDGTSNGTQTDFDGNFSIEVEQGAILVFSYLGMKEQRVAVSSQSSIEVTLMNDTGQLDEVVITALGIKSNPRSLTYAAETVTSEDIENTGETNLVNSLSSKAAGVSVVSSSGSVGASSNIRIRGNTSIGRSNSPLFIIDGVPIDNSSSGNGTGGVDSSNRAIDINQSDIESLEILKGTAAQTLYGLRAANGVVLITTKKGKVGAPRVTVSSSYQFSNVNQLPDLQSEFAQGRPVGGVNTYRGPETQDGFSWGPKISSLEFDGDSSYPFDRNGRLVPRGDGNGQSANAYDQYDFFTTGVLKDNSVSVRGGTEKIKYYISGAQLDQTGVSPKEQFSRTSFRTNISANLRDNFKISANANYINSGGRRVQRGSNVSGIMLGLARTTPTFDNGNGLTSRDAADTPSTYLFPDGTQRSYRNGVYDNPYWTVSQNPSFDDVKRFIGKLSFEYKPFEWATIQGTLGYDQYADKRKQGVNINSAGNPQGQVFNQTIFNEDINTQLLFITEKKINEKWDFNGVLGYDGFKTETQFDAVTGLGMTIPGFFIISNTATQAVSESVGRRQLDAVLADARFSYDNTFFINGTLRNDWSSTLPENDNSFQSYSFGSSFVFTELFDSGNMNYGKLRGSYGKTGNDAPIFSTLTYYNAAASGGDGFIDDNQFPIFSTVAFERGSLLGNNNITPETTEEFEVGAEFNFYDSRIKIDLTYYNKTTEDQIIQVDQPAVTGFTNRTVNAGIIENIGWEITSSLKPIVGDNFNWNIDLNWTTFENTVKELAPGVESILLAGFTSTSSRVIAGESYGAIFGSKFLRNDNGEVLIDDSGFPVVDPENGIVGDPIPDFTMGIRNTFSYKDFTLSALLDIRQGGDVWCGTCGIIDYFGSSQTTAEQRGITDFVFNGVNQTTGQTNSTEVALADPANGLGANRWVRYGFGGVSEDYIYDSSWVRLREASLTYSLPNKFLDKTFLTGGSLTVTGRNLFLITDYPGIDPETNLTGASNGIGLDYFNQPNTKGYAVTVRLNF

SEQ ID NO: 15768 - protein, 997 aa, Psychroflexus torquis ATCC 700755
MKNFPAWLSVWSVVAVACGSAHAADLQNVAVPSAVPAATNWTGFYIGTHVGAAASESAWNSIAGSGAGLAAGPFPGHGVSGNAIAGIQGGYNAQFGNYVLGIEGDASFGSINGLARCLHGTFACTSRIDELWTLAARFGYAAGDLLVYGKAGAAWADVHRRMASGNFVNVLEASETRSGWLLGAGVEYAFLPGLSAKIEYNYADFGNRSLTMADQFGDVSDVSIGQTAHLVKVGLNYRIGAASVSAAPLPGVPLPQWSWTGIYLGVHAGGGFGSNDWDSATGALLAASTSGGFPGRGDSSGLFGGGQIGANYQFGRWVAGVEASAAAADIGGYAKCATDVGTRRNFTCHNELSSLGTITGRLGQTWGNLLIYGKAGAAWATGSSDAQRAGSASRFTESGTRWGWVTGTGLEYALSPNLSAFVEYNHVDFGTQDTAYVDQFGNASEVGFKQKFDLVKAGLNYRLGSGAPMFGAGGDAPLFVKAAALPLGWQIEAGTRYWGSSGRMQKDLNDNVSPSRLNSRLIYGDQTGHSLEAFVRVDHASGLFAKANLGLGHLVNGQLNDEDFPSEVNYSNTISEMRDGRLAFGSADIGYNFINDGGRKLGGFVGYRSFYQTGNGFGCRQIATDFDTCGVPFPTNFVGLSETESWRGVALGLNVRAPLTERLRLEVDAAYLPYVNRAGFDNHWFRADINPQSEVGHGWGTQFEAILSYAVTDRFSVGVGGRYWYFATDSASTIFPREATTSPMQFYSERYGGFLQTSYKFGDVDAAETSAHGIAKAPQRIAPTNWTGLYVGASVGAGWGRTTYADPFPTPTTGDRADLGGALLGGQIGANYQFGHLVAGVEASANWANIRGTDTCFGAYPNPVVAGFNCGSRIDAIGAFTARGGYAIDRTLLYVKGGAAWDRQQDQFNTVGVGGTTLASTSTNWGWTVGGGLEYALAPSWSMALEYKYFDFGASPAFSTSVTPALDGVNLAPQTNKLQTVSLGVNYKFGPSLFARD

SEQ ID NO: 15769 - protein, 256 aa, Psychroflexus torquis ATCC 700755
MRDHSSISLSLITNKLTYALVAIAALGAMSSVQAKVLFTDTSISALYGTDYELVPQETLTTVTLEHASTHTWGGVFFFVDRHQGKENAAGKEFKETYGELAPKLKLAKFDNSFIKQVNLAGQYEFGSNSNGFSQDNYLVGVGADLNVPIPGMKYASASLYHAFNDKDNADDQQITLTYGWEKNNFVIDGYVDYAFNSEDDSVKDNIHINPQLKYNLQEVLGIDNRLEVGMEYSYWKNKFGSDKTQNAASALVKFHF

SEQ ID NO: 15770 - protein, 420 aa, Psychroflexus torquis ATCC 700755
MSIALKKSLACSAALLVAPYASAAFVEDFKGSLELRNFYYNRDFRNDGATQSKRDEWAQGFILNLQSGFTEGPVGFGIDAMGLLGVKLDSSPDRTGSGLLAYDSDRQVEDEYGKFVATAKARMGKTELRIGGVNPLMPLLWSNNSRLLPQVFRGGSLTVNDIDKLTVTAIRVNAVKQRNSTDFESLTATGYAPVEADHYNYLAFDFKPTKDMTFSLHAAELEDLYTSYFAGIKVIKPLGEGNVIADVRVFDASETGSKKLGEVDNRTLSSYFAYSIKGHTLGGGYQKAWGDTSFAFVNGTDTYLFGESLVSTFTAPEERVWFARYDFDFAALGVPGLLFTTRYMKGDDVDPDLLKSRQAASLRLNGEEGKEWERVTDISYVIQSGPAKGVSFQWRNSTNRSTYADSANENRLIMRYTFNF

SEQ ID NO: 15771 - protein, 308 aa, Psychroflexus torquis ATCC 700755
MKIILLFLAALASFTVHAQPPSQTVEQTVRHIYQNYKSDATAPYFGETGERAITSARIQQALTLNDNLTLPGNIGWLDYDPVCDCQDFGDLVLESVAITQTDADHADAVVRFRIFKDDKEKTTQTLKMVAENGRWVIDDIVSNHGSVLQAVNSENEKTLAALASLQKEQPEAFVAELFEHIADYSWPWTWVVSDSYRQAVNAFYKTTFKTANNPDEDMQIERQFIYDNPICFGEESLFSRVDEIRVLEKTADSARIHVRFTLTNGNNEEQELVLQRREGKWEIADFIRPNSGSLLKQIEAKTAARLKQ

SEQ ID NO: 15772 - protein, 752 aa, Psychroflexus torquis ATCC 700755
MKYTSHFPLGIVIPLLACSVPLQAAENMTEQSTRDKSTPTAENQEETMVVTAARQNLQAPGVSTITAEEIRKHPPARDVSELIRTQPGVNLTGNSTSGQRGNNRQIDIRGMGPENTLVLVDGKPVTSRNSVRYGWRGDRDSRGDTSWVPAEMIDHIDVIRGPAAARYGNGAMGGVVNIVTKPTTPEWHGSWNTYMNAPQHRKEGATKRTNFSLNGPLSDSVSFNLWGNLSKTQADAQDINAGHEAERTGSYAGSYPAGREGVVNKDIHSKLRWEFAPMQALEFEAGYSRQGNLYAGDTQNTNTSTLVKSMYGKETNRLYRQTYGVTWTGGWDNGVTSNSYAQYEHTRNSRMNEGLAGGTEGIFSSSEFSDIDLADVLLHSEVNIPFTLGVDQNLTLGTEWNQQRMKDGVSTTQALSYGTIDGVSATGRSPYSSAEIFSLFTEDNMALTDSTMLTPALRFDHHSIVGNNWSPSLNLSQALTDDWTLKLGIARAYKAPNLYQLNPNYILYSNGQGCYASSSACYLMGNSDLKAETSVNKEIGLEYKHDGYQAGITWFRNDYHNKIESGYAAVGTASNGTTNIYQWENVPKALVEGLEGTLNLPVGETVNWSNNLTWMLQSKNKTTGDRLSVIPQFTLNSTLSWQVREDLSLQSTFTWYGRQKPKRFNYKGEAVSGSELNEVSPYSIVGLSATWDVNKNLSFTSGIDNLFDIRHYRAGNAQTTGNATTGAYLYGAGAETYNESGRTFFMSVNTHF

SEQ ID NO: 15773 - protein, 826 aa, Psychroflexus torquis ATCC 700755
MRTKHLLRSSALVGVMAAAFATSVQAQEETGGREIEEIVVTAQKREQSLQDVPIVVTSVSGELLRDAGVRDIRELTVLTPGLTVTSTSNETIVTARVRGVGTVGDNPGLESSVGVVIDGVYRPRNGVSFGDLGEVTRIEVLKGPQGTLFGKNTSAGVINIITAGPTEDVQAQSEVTVGDYEQFGFSGSLSGPITEGVTGRIFAAARQRNGYQDIITGPGPRGQHDDNNQNFYTVRGQLQFEPTDDITFRLIGDYTKRNEDCCVGTQLFVGQGLAGQPGRGQMIDAVRPGSLDLTSTPFDRLGYANRPTDQRVEDRGVSGELTWRLAPGMSLTSITAWRKWNAETGQDSDFTAADLVYRPNDGSNNVQFKQFSQELRLAGDAMDGRLNWLVGGFYAEEDLDTRSVLSYGTDYYAYYAGRVLGGAPALIGLVPGTVFQPGAGSDDRYAQDGKSWALFTNNSFAITDALELTVGLRYTKDKKTLVTDYSTTGSSCDQGEAAFPILVGAVGAATATRIAGGLCLNSQNNDFDELGLLTQKRTEEEVTGTAKLAYRWNDDIMTYASYSRGYKAGGFNLDREQLITLTPAGTPNFTADPDTSFGGEFVDSYELGAKTSWLDNSLLLNAAVFYQKFEDFQLNTFVGTAFVVETLPKVTSRGVDVDFIYLPPIDGLTFQGGVTYAETEIGDFTAADLINPTRFTSLRRLPGAQLSFAPRWSASLAGSYERDVFSGLKLRANLSGKFTSRYNTGSDLHPVKEQDSMVLVNGRIGIGAQDESWTVELWANNLFDKEYVQVGFNGPYQVDEAVDAISVYDAFLGAPRTVGATLRFRY

SEQ ID NO: 15774 - protein, 541 aa, Psychroflexus torquis ATCC 700755
MGITSHKRQIAAAMMAASVTCGVEAQLAQNLTIHPKALALGNAVTADPPGIMAIHYNPAGLTKLDGRQLEVNLMSVYLDIDADFHAPDGYEIFGIDGLETDPLTGKQKDPVANKHSHTNNVALYLPGFGILRAPPGPAIAPSAGISINPPGSKLTFGNAFYLPLAAGFYRDKDDPGRYMPQATALQRTTYLSPTVGYKINDEWSVGAGIHLSHMGIAADQYMRAPNMLLGVAEVLQDAFNCESGDEPLQPWLALCGGNVGPWDDIGALSINVQETLSPTYALGVMWEPTEWFTWGASYTSEADMNMKGTFEIEYTDDWSGFWQSVNGSVLGAITSAILSLPSGAPREAGNVSMDLTYPQHFQTGISLDVHPKLTVNVDVGWTDYKQWDAFVFRFDRNLEFLNAARILSPQNATPNTLRLPLGFTDQWNWGFGLEFHASSRLDLRAGMEIRDSVIPDDQRQIMAPFGGANLYSVGMGYQWDKDTEIDMNLSYLHSVETIPANGSCNLNCDNITNIIYNPYAGLDVKTSLRVVMAGLSFRTKF

SEQ ID NO: 15775 - protein, 796 aa, Psychroflexus torquis ATCC 700755
MINKSFLVFLAFLFSVSAFSQHGRSGGMISGRVISTVEKEVVDFATVYLKGTNRGATTDEKGLYHLKAAAGDYTLVVSAIGYTTVEKKVTLKAGERIRVNVTIAPQVTELNEVVVSTSAVSRVNKSAFNAVAIDAKGLHNSTQNLSDALAKVPGLKLREAGGVGSDMILSLDGFSGKHVKLFIDGVPQEGVGSSFGLNNIPINFADRIEVYRGVVPVGFGTDALGGVINIVTNKNRKNWFLDASYSYGSFNTHKSYVNFGQTFKNGLTYEINAFQNYSDNSYYVDTPVEEFYEGGGSAINTDKVEHVKRFHDNYHNEAVVGKVGLVDKKWADRLMIGLTYSRMYKEIQTGVVQKVVFGEKYRKGNSLMPSLEYRKRNLFVRNLDVAFTANYNRNFTNNVDTATYRFNWLGEKTSLKGRKGEQSYQDMKSDNDNWNATFTANYHIGTAHTFVLNHVLNTFHRENHNSVSVDESNAIAKVTRKNITGFSYRLMPSEHWNLSVFGKYYNQYNAGPVSASTSGTSNYVRLTNNVSSVGYGAAGTYFILSGLQAKLSYEKAYRLPTNEELFGDEDLELGKIGLNPEKSDNLNFNLSYNRQLGKHGLYVETGLIYRNTSDYIYRSIETTSNRSYGSYSNYGSVETKGYHISARYNYSCWVSIGGNFTQMDVRDNVEKTQTGQESLTYGARMPNLPYRFANSDISFFWRNLWKKGNTLTVTYDNMYVHGFPLYSEALGAVETKDIVPTQFSHNLGITYSLKNGRYNVSFECKNFTDEKLYDNFSLQKAGRAFYGKVRVYFGGN

SEQ ID NO: 15776 - protein, 763 aa, Psychroflexus torquis ATCC 700755
MKHYIVMLVLACVSMSSYAVNPIKEGNMIAGHVIVKGTEESIPFATVMILGTNRGAVSNEEGQFEFRKLAAGKYTLRVQVMGYKTQEKTITVSAEATSVVHFQMEEVSFTTDEVVVSANRNEVSRKAAPVVVNVMSAKLFETVNSTDLAKSLNFQSGLRVENNCQNCGFPQVRINGLEGPYSQILINSRPIISALSGVYGLEQIPVNMIERVEVVRGGGSALFGANAVGGTINIITKDPINNSFQVASTMSNMNGKSWEQYMGGNVSLVAKDNSYGIALYETYRNRNPYDADGDGFSELGKLNMNTFGMRAYYRPNYFSRINVEYHTTNEFRRGGNKFNLQPHEADITEQTKHIINSGGVSYDRYWGEKHKMSVYGSVQHTDRNSYYGAQKDMNAYGKTNDLTWVVGGMYVGNMDRCLFAPATFTGGVEYQSNSLHDVMTGYHRDMQQDVRIAGGFVQNEWRLNRWTMLVGARLDKHNLIDHPIFSPRVNFLYKPNDNLQARLTYSTGFRAPQAYDEDLHVTAVGGEGVQIRLADGLREERSNSFSGSVDWSFPMGHWQSNILLEGFYTDLHHVFVLEDIGEDQNGDKIKERRNGSGAKVYGVNLDAKVAHGREAQLQLGFTVQRSRYNRAEVWTSEGEEEQTTKRMPRTPDYYGYFTFTSAPLKNFDFSLSGTYTGKMIVPHMAGYIEKSRMEHTPQFMDLNLKLNYTFVLKDHIKMQVNGGVQNIFNSFQKDLDKGEFRDAGYFYGPTQPRTYFVGIKIMN

SEQ ID NO: 15777 - protein, 867 aa, Psychroflexus torquis ATCC 700755
MRPDHVNLCCLCATILSPTAILFGQDALDKSALITKNPNSIVCTFLEDCTMENFSPALLSHARQDDPLYIIGNTHNWFVSNLHPSTNEERFLKEKGDLSIQDFRFLSFTDCSSSTEDSPSILYHKNGQLFLRNNGNMSFYRNHSEGSGGALSTDALFLQHNYLFTNFEENSSAKNGGAIQAQTLSLSRNVSSLSFSRNRANLNGGAICCQNLICSGNVNPLFFTNNSALNGGAICCINEQNLSEKGCLSLAYNQETLFSGNSAKEKGGAIYTKHMVLRHNGPVSFVNNSAKLGGAIAIQSGGSLSIIAGGGSVLFQNNSCHFSDQGTVRNAIYLEKNALLSSLEARHGDILFFDPIVQEVVSPEFSTTSALTPLRIQTNTNRAVIFSSENLSKEEKTEANLISKIQQPIELQSGCLVLKDRVILSAPSLSQAPQALLVMDVGTSLTTSSDLKLTTLSIPLHSIDTENSVSIQSPTLSIQKIFLSNSEHENFYENVELLSKDQKDIPLLSLPKGLPHPDLPDGNLSSHFGYQGDWNFSWQTSDQRETLVANWTANSYIPHPERQSALVANTLWNTYSDMQAVQSMINTTAQGGAYLFGTWGSAVSNLFYSHGNSGKSTDNWKHRSLGYLFGISTHSLDDHSFCLAAGQLFGKSSDSFVTSADTTSYIAAIQTQIATSLIKISAQACYNESIHELKTKYRSFSKEGFGAWHSVAVSGEIGASIPIVSNGSGLFSSFSIFSKLQGFSGKQDGFEESRGEARAFADSSFTNISLPVGIAFEKKSQKTRNYYHFLGAYIQDLKRCVESGPVTLLKNSVTWDAPMANLDSRAWMFRLTNQRALHRFQTLVNMSYMLRGQSYSYSLDLGTTYRF

SEQ ID NO: 15778 - protein, 853 aa, Psychroflexus torquis ATCC 700755
MSIKTNCYLAFCITAALQGISTSALANDDVLANQNIETIEVRGIRRSLEEALNTKRFADSVIDSISAEDIGKFPDKNIGDAMQRIPGVTVVRTYGEVNGVTVRGTAPEHSMVLLNGQNVASVGWFDLGGINRSFNFEMLAAEQISGMDLFKSVEANVNEGAIGGTVNLKTRKPLDLDSGTFFASIEGAYHTSVKEWDPAYSALGSWKTDDDTFGILVAYSKEESKVYRETLSNFGSPAGANFTDTNDIAHATYGAMSSILFDEDRERSSTQVTLQYAPSTALTLSLNYNLFELNNDHNNSALFGIVGFGTLDGNSVTENSAGVVIRATTNGVNGPGLAPLFNNTVLRTPEMQTDALNFTVEYAAEDWSVNFVAGSSSAQGRTKQSSTWWGDTANAANASFTYDVDGALEIIPTNSNYMKDHNNFMIFTEFTYINYVRDNDIDYYQADFTYQLDRGIFSTIEAGFKYQDQIFASQGDYRDVDVNKAIADGLTLADFNGGFVSGLHSKAGRSGSLSVFPIGSRRIWSYAEANQASSTTTLSKFSIDEAITASYVKANFSGEGFRGNVGLRFVDTEVVSKGLIDNIPSKGKKDYSNFLPSVNIAADIAQDLIFRFAAGSTVSRPDYDDMQMAETISVSFATATVGSPDLKPYKADQYDIGLEWYFDSASVLGATLFVKNISDYIETTSAIELYNGCSQTCLVTRSRNVGTANVSGLELQLQHNFGNGFGLLGNYTYTDSEVTNSVGKTVPINEVSKNSYNASVYYENEMFSVRLAYNYRDNWMRQYNNSGSDSVNDAYDQLDASFVWHALDNVDISIEAVNLTNEVMVLRQPDFGSVVHSVDEFGTRYFVGASVRF

SEQ ID NO: 15779 - protein, 870 aa, Psychroflexus torquis ATCC 700755
MVYACDQGARRARPAPPRRPQTALAMRGALAACALAGTLAAAPAAAQPAAAPASAGARAWHIDAGPLGEALARFADQAGITLLYDPAAVRGRASAGLQGVYSVPDGLARLLDGSGLDARQRGAGTYVLQALPAGPVAQLAPVTIEADGVRADPAWARTATRRELDARQVLDWNDIGKRVDPGVNYNRRTKSINIRGLDENRVVTRIDGIRLPWLDDGARGIQGGLNAVDFNTLSRLDVVRGADSSAAGSGALGGLADLRTLEPADLLRDGRRFGALAKSDYDSADASWGLNAALAGQVHDDTSWLLQAGTRNGHDLDNRADTGGYGSKRSQPSPEDYAQNNFLLKLQQRIDGGHRLGLTGEYFKRRADLDQMYQQGAGTSYQYGANRTHEETTRKRVSLDYQYNAPQAGAAIDSARAMVYWQRLRLDSSQDARRTRDGRAYARPGDPYFYGYPSGPYGRSNSIQESILGVNGELSSRFEGMVSQRVTIGGEWYGNRTEQYSDGYDNCPAIPPGTPAPMGPRLCDMLHTNQADMPRVKGSQWAIWAQDEIAFADGRYILTPSLRYDHYEQKPQQGGGYQNNPNAGTLPPPSSGGRFSPKLLGTWKAREALTLYAQYGFGYRAPSATELYTNYGGPGTYLRVGNPSLKPETSKGWELGARLGDDQLGGAVSLFDNRYQNFIDKNVPLGKGSPQWQPAWDGQYPLGVTGLANRARVRIYGAEASAHWRFAPNWRTWGSLAWAVGKDENTGQHLNSVPPLKAILGLGYQRDEWGIDAMLTAATRRDDVQYPEASASARYADFQAPGYGVVDLSAYWRPAAVKGLQLQAGVFNLFDKKYWEAINVPTAGAIAIPRPLDWYTEPGRSVRVSLTYQY

SEQ ID NO: 15780 - protein, 793 aa, Psychroflexus torquis ATCC 700755
MKKSIFIIFTLFASIMYGQNGTIKGKILDKQSELPLIGANVELLGAKISKGVITDFDGYFTLTDVPVGRKTIRVSYIGYETSTIPDIEVSTGKDVDVTVALTESYGSLDEIIITSRTNKIKSLNKFSSVSARQFGVKEVARYAGGRNDVARLVSNFAGVASPDDSRNDIVVRGNSPTGLLWRVEGIPIPSPNHFSALGTTGSPVSALNPNLLKNSDFITSAFPAEYGNAIGGVFDLGFRNGNKDEYEYSFQVGAFTGLEATAEGPLNRKNNGSFLVAARYSLIGLIGGAGTSDTPNYSDVSFNINLGKSKLGTFSLFGIMGTSSIDLIGEDFDEDDLFSAEDENSYVSSNIGVLGAKHLLNIGEKSYLKTVIAGASNSSDFEEDRIIDLATDDQRIIRFAENNNEETRLTFSTLFNTKINNKFTLRTGLLLENFSADLDRKQRDEQEDLNGDGDPDLVTIRSINGSYNVFQPYIQTKYRLTEKLTLNTGIHTMYSDLNEQFVVEPRASMSYRIDPKHTLNIGYGLHHQNIATPLLFLNEEVNGVITNPNENLDFVRSQHYVLGYDVKIAPSWRAKVETYYQKIDNAAIDGSPSSYSSLTEGADFTFSSDNTDLVSSGTGENIGLELTLEKSFSKGYHALITSSFFESTYKGSDGIERSTPFNGGHIFNFLAGKEFKFGENKKNIFSIDARFVTSGGNRFTPVDLEASQNAGYEVLQDDLAFSEQYEDYLRLDLKFAVTLNSNKKKTSHKFYVDFQNLTNRDNVFVRRYNRSTSSIEQINQIGFFPDFGYRFQF

SEQ ID NO: 15781 - protein, 342 aa, Psychroflexus torquis ATCC 700755
MRVLLFLLLSLFMLPAFSADNLLRWHDAQHFTVQASTPLKAKRAWKLCALYPSLKDSYWLSLNYGMQEAARRYGVDLKVLEAGGYSQLATQQAQIDQCKQWGAEAILLGSSTTSFPDLQKQVASLPVIELVNAIDAPQVKSRVGVPWFQMGYQPGRYLVQWAHGKPLNVLLMPGPDNAGGSKEMVEGFRAAIAGSPVRIVDIALGDNDIEIQRNLLQEMLERHPEIDVVAGTAIAAEAAMGEGRNLKTPLTVVSFYLSHQVYRGLKRGRVIMAASDQMVWQGELAVEQAIRQLQGQSVSDNVSPPILVLTPKNADREHIRRSLSPGGFRPVYFYQHTSAAKK

SEQ ID NO: 15782 - protein, 815 aa, Psychroflexus torquis ATCC 700755
MKKVTLFLLILPAILMGQKTTILKGTVKDKNKSPIENVFVAFDQTGTITDENGNYVLRIPIKKEIVLKFSHLSYHTLYHSITAKNRYIIRFSPTLLLETEKLGEIIVIDRRKETQGIIKIDPLKANSILGENAGVENILMTLPGVNNNNELSTQYNVRGGNFDENLVYVNGIEVYKPFLIRSGQQEGFSFINPNMVQNINFSAGGFQAKYGDKLSSVLDISYRKPKEIATNINFSLLGGSITFESPFLDNKLTVITSLRYRDNSLFVNSKQIETNFRPKFTDLQSFVTYQFSEKFSLNYLSNFSINNYNYTPISRRTRFGTITNPIELIVFFNGREENRYLTLFNAVSGDLKINEKLSFRGTVSSYNTQEEEHYDIAASYNLGEVDANIGSESFGEVSFSQGMGSQLNHSRNNLDAVINNAQIKGTYKRKKQQWNFGIKYQHENIQERIREWETIDSLGFSVRPPNIEVNNQPYVPFEVPITPYQNIREDNQVRINRISGFIQLNERLFWKTTEIWYHFGIRAQNWSVSSKNIMSKSQTILSPRAQIAFKPNWKKDMLFRFSGGWYSQPPSYRELKNFNGKINNAVKAQKSIHFVAGMDYSFSAWERPFKLTTEIYYKDLSDINAYSIDNVRIRYRADNVTTGYAQGFDLRLNGEFVPGSESWVSLGYLKTEENIDNKGAISRPSDQRLKFAILFQDYVPNLPNLKAYLNLVYNTGVPGGAPAYADVYQFQRRLRDYKRADLGISYVFSDANKQYEDGWLSKFKELTMGLELFNMFDIQNSITNTWVRDVSSKNQYGIPNFMTGRVLNFKLGIKL

SEQ ID NO: 15783 - protein, 223 aa, Psychroflexus torquis ATCC 700755
  misc_feature (108)..(108): Xaa can be any naturally occurring amino acid
LRNAGSRFHIKATHNFGDGFYAQGYLETRLVSDYEGRSDNFGNIITKYAYVTLGNKGFGEVKLGRAKTISDGITSAEDKEYGVLENKEYIPKDGNSVGYTFKGIDGLXLGANYLLAQERVAYRSSNSKPGEVSPQKISNGVQVGAKYDANNIIAGIAYGRTNYREDISIPANKLGKKQQVNGALSTLGYRFSDLGLLVSLDSGYAKTKNYKDKHEKRYFVSPG

SEQ ID NO: 15784 - protein, 868 aa, Psychroflexus torquis ATCC 700755
MHKNVLAKSVRLALISGAAAAAFASPAVFAADEDGAKVERIEVTGSRIKRSDLEGASPITTITTEDMKMEGNFTVADALRNSNLNSFGSFSERSGSSAQSQATINLRGAGSSRTLVLIDGKRFPGSPTLGGASANLNAIPMAAVERIEILTDGASSTYGSDAIAGVVNIIMKKNYQGIEFNVGGGSRDRDGGLTSKEFSVVAGYQMDKGNITFAFDHQDRKGISDADRDFTAPWMEDLNGDGVIQAYSETDGWSYYGASVKGPDGIYQPSPLCGDLAAEYGDNVFKQVRGDDQFGAGSDLCMYAYGNVSYNKASTDRNTVYVDANYEIAEDLEWFGRVMVTQSNSFGRYAPPAANWNNMAADNPHNPFDVEAKGYFRWVGIGTRDGNVDDYNQDYLTGLRGTISALNDAEWEVYYHHNIADNKSIGEYYLSYSGLAYNEANGIDLGSEAGINNMKATTLTQGSAIFDQYNAGIGFDAFELPGGSVAHYVGLEYFDQQYSEVYDAQSEAGLIGGSAGNSAAGDRQVWAMFYEAVLPITDDIELNLAARYDDYSDFGDNIAPKAAIRWQALENVVVRASYSEAFRAPALDQLFAATTFSAEDGIDKPYCEATGTPCSERQFDTYISANKELGPETSQYVNFGVAWDIVDDIGLKVDYFNLNIDDVIAQRSITSVMTGIYEGTLAPSNTFYVKRDPASAGQAIGAASEVGTGYSNANTLEISGIDVALNAKFETNIGDIGFNWTNSFVLDYTEEVDGGAESRDTSGWNGQPDYKSVFTTNYRMGDHSLSWNMNYTSSTFYFEDDASKGELDSWLIHNISYVYDAGNYGSILLGINNLTDEDPVLSPDGKFENADLYNNYGREYRASYTLKF

SEQ ID NO: 15785 - protein, 948 aa, Psychroflexus torquis ATCC 700755
MKKNVLIVLGLVTFSGLYAQDNKTEQDSLKNNELSEVTIIGSRSKNRVKTDVPVPVDVFNIADITKGAPQTSVTQILNYVAPSFTSNATSTADATDHVDPAQLRGLGPDQVLILVNGKRRHTSALVNINGSPGRGSVGTDLNAIPSFAIERIEVLRDGAAAQYGSDAIAGVINIVLKKNANYISGGVQYGANLSSGSNNFKGGSDGQTTQIDLNYGTSLGKPGSYLNLTAVGVTRQATSRAGIRNNGIFNAYNAVENRAAQNGVEINSLFSNINATGNSAQIISSLQQYAPQVSYFTTAQQNAIASATTIAQMQTALNFDVTNNELAYRGQQRADYNMSVGQSELASGQAYYNAKYPLTETTSLYSFGGISYRNGKSYAFNRLPNGSGTFTQVYQNGFLPEIESKILDASAALGVTTNILGFDTDLSTNLGTNSFNYDVNNTINATLGTNSPLSFDAGKVSFLQSTTNLDFSKKLDVLSGLNVAFGGEFRYENYQIKAGEEASYGLYDVNGALVTGILPSTSPLIVTDFFGNKRGAGAQGFSGFQPSDAKEKDRQSGAAYIDLELNATEKWLVNGAARYENYSDFGSTVTFKLASLLKLTDNINWRVSGQTGFRAPSLQQKYFESSSTQFINGAPYQVGYFTNDSQAAKSIGVENLKPEKSKSISTGFTFKIPEANITISTDAYYTRINDRIVLSGQYARPTDAQINAATSQTQKDALTLFQQAFDLKGVERASFWTNGIDSETKGVDLVISQKYDVIQDFVIRNDFALSFNETKRVGALNVPQSIIDAGGDPYIYSFFPESSRIYLEEAIPKLKANLTTTFSIKKLDIYLRNSYFGKVTDPGATDVNLDGFSSVYEHPEYSAKLVTDLSFGYQINEHFRATVGFNNIGDVYPDRNNPSTPAFTNTTPTLSPAPSTDLTNANQFAYSRAVSQFGLNGRFGFARLSFKF

SEQ ID NO: 15786 - protein, 401 aa, Psychroflexus torquis ATCC 700755
MNKMNLRIVPALLLAIFSGTASAAAFQLWEQNASGLGNAYAGSAAVADNASTVFFNPAGMTQLSGFQFSAGVTGVGPSYEFRDNGSTGAFKGSGNGGDAGGWNAVPNLYLSGHLTDNLSIGFGVSAPFGLATEYDSNWVGRVQAIKSEIKTVNYNPSLAYRVNDKVSLGFGINYQQLDAEITSYTPAGLYRVKGDDSTWGWNAGALFTLSPAMRVGVSYRSAVNYTLEGTRSVGANSVAAKADIKLPDTFILSVWQQVSDRWEAMGDLSYTRWSTLDRLDVRSSAGVDTEIFNYENSWRLAWGAAYKASDALKVKFGIAYDRTPVRDEYRSARVPDNDRLWLSLGGQWNAGRYGKVDVGYSYLYVKDPSIQQSKVVGVAHELRGDYNASAHIVGAQYSVGF

SEQ ID NO: 15787 - protein, 699 aa, Psychroflexus torquis ATCC 700755
MRTIISMLCCTLAAAVPAAAENLILDEIVVRGQKESPREESLTIREVRESPARDMGEALRQVEGLSYVRKGAIANDVVIRGLQRDNINVLIDGVRLYGACPNRMDSPAFHFDFAEVEQIRIVKGPYDVENAGSLGGLVDAVGKKPKKGFGSDLSFTYGSYDSINASGTASYGTDRLDGLLGYAYKYSKPPESGDGKRITEIYPATSNNRYRPGSIDSTAYEINTGWARFGINPTDNSRTEFSYSYQDADHVLYPYLLMDADYDRTHRFNWSYRIEKLSPLVSEVKLQAYWNRVKHLMDDRYRETSNPDNAALMYRTFLTRNYFMSTLAETETWGAKMNTSLAVGSGTLKAGIDYYNRGWDATNTMLMRNGTDWVYGDSPMIPDVTIHNTGMFLEYTVPLAERLKLTAAARGDLTRAEADRLTAGRIATLYQPYYPGRTLSADTDFGEASGNLQLTWTPITGLELFAGFGRGIRTPDPQELYTGLQRMGSNWVGNPLLEPTVNNQGDVGVKYATDSYYVNASFFYGYLHNYINVTDLPDPDGAGPLLRARSYRNVNATLWGGEFGSQFSLPANFFLKASLSYTRGNNESDDRPLSEIPPLRGTMALRYDVDSWFLEVAENFADRQDRVDAALQEQETAGWFTTDLKGGFTYGGLSVYAGVNNLFDKYYLSHLSYQRDPFSTGAKVPENGRNYYLTLAYRF

SEQ ID NO: 15788 - protein, 701 aa, Psychroflexus torquis ATCC 700755
MNLRLFASAALVALGGGMGAAMPAAAQEAPAPLLDVIVVTAPRIERTTPTAQTIAPRPVEGPDPTTLLARVPGGARVGNGALSGQAQYRGLFGHRLNLRVDGQRFASGGPNLMDPPFHYAPTSLVSALEVDRGVSPVREGPGLAGGMNAVFKRLDFTQGGEPELGYDLTAEARSGDDSRSVGGIAGAAGQAWRLNLLGAYEKGDDAEFPGGTIRASRFERSVYGLSAGARAGDQEVSLDVRRQHTGPTGNPPFPMDIRYFDSDFARVGWRGEFGEVQAEAAFSYAGVDHAMNNFGLRPAPASPMDRREALAKAYTRAAEGAVSFPAAGGRLRLGADAEATDRNVQILNPANPAFLVTSLPDVEATRTGAYAEWTGGLGPVMGELGLRFDRHEADAGRTVLGPALPAGPVSLAAAFNAADRSRDDDTVDVSARFWTPERDGLSWRLTLARKTRVPGYVERYSWLPGNTSGGLADGNIYVGDLALEPEVAWIAEAGFDWAGDRAYARPTVFVREVDNYIQGVPFDATPGVLDTLHERVAAMNGDPTPLRFANVDARLWGFDVAGGVKLSERWRLDAVASYVRGERRDVPDDLYRISPPSLTAAVSYDADAWSVTAETRLVADQDKVSGTNDEQRTGGYGLVNLYGDWRVRQGVRVSAGVENLLDRRYSDHLAGYNRIAGSDVPVGARLPGAGRSVFVRLSMAR

SEQ ID NO: 15789 - protein, 1038 aa, Psychroflexus torquis ATCC 700755
MKKYLFTIIALCIAIMHAQAQSTTITGKVTDPKGEVIPGATVLEKNTNNGTATNTDGSFSLTLQSANPTLVISAIGFAKQEIVVGAQTKFDIKLATDAEELDEVVVTALGVSKEKATLSYAVQSIKPSDLTDARDNNVINSLSGQIAGAQVTGSSGGVGSSARIILRGYTSLAGNNQPLFVVDGIPYDNSSSNVQGWGNGVDYGNAAADINPDDVASVSVLKGPAATALYGARGGNGVILITTKTGKGKKGIGIDYNFNLALERPFVTPKFQNQYGQGWNGQFEWVDGSGGGTADWADQSWGPKFDGQPRDQFHGKQQPWVAAPNNFRDFFETGVATTHNVAITSGGLKNHIRVGYTRFDHKGMMPNTDLSRDVVTTKAGFKLTDRLSGSLTATYTATNSGNRPVVGYGSSNGGYSNPTNQFIWGGRQIDFAKHLKDNYENPDGTQKNWLTYYSDNPYWTLHKNTNSLRRDRINGAATLSYELAKGIKLRGRVMNDFYRETRKQRVAKGTWVPRDEGRIFQQGYFVNEINQEIALLGNKNLSQRLNINFLLGANRMNSKTESNTNSALALITANNYSFDNAQGETPITTFNSELEIQSLFADATFLFDRAISAGFSLRNDWNSTLPQSNQSFLYYSARGSVVFSELLSEQLPKWFSFGKILVNYATAGAGGQPYQLDPIYVSETNTFRDVNLFRVSNVIPNPDLKNELTTTTEIGADLQFFNRRVGINVTYYQSKTENQIIYLPVSRASGYGSALINAGRLDNKGVEVQLSATPFKAKKPGDFQWDIQVNYARNQNSVVSLDPNGQIESFQLGSFFGIIVEAQPGQPFGSILGRSQRRDDQGRVIVDQAGMPLLTADLGVLGNATPEWTGGISNTFRFKGFDFNFLIDIRHGGDLFSGTNYYGHAAGQFEATGNNREDGFVVPNSVTESGEVNTTKVLPQDYYGNLYGRHDEYVYDASFIKLRSLTLGYTFPQKWVNNLRLQKLRISFYGRNLWLIKSNIPNVDPETGFSASGVNNIGFEYISTPSARTLGVRVNAKF

SEQ ID NO: 15790 - protein, 658 aa, Psychroflexus torquis ATCC 700755
MKGLALTTMCCLSFCTYGEQGPDLFSLSLEELTTIEIATKNKQTIYSSPSIVYVITRDQINEMGISNLQTLLNFVPGYQSTRDIEQGTANRISARGRSTALSESVLVQIDGNKINDLYTGGISILNRLIDLGNIERIEIIRGPGSALYGSNAFLGVINIITASNRNEMSVSVSHPNRVSSRFSLSHAFSEHKKLDFYLGVFDDAGDNYHLTDINGIEGETHDPINGLDAYLKQSWHDWLFTARYMKRQLNDFIALGSLGNDINKEQSQQWSFSAQYNGTWFNQLDYDVSFAHSQDKWQTQALLIPKEVEIFPDFSLATNFVGGPFLTSKNSKAAINVSYQASDNHLVSFGSAYEKAHISDVYTATTHDLFTLEPYQQSIKLVGDQSFSDRKSRKIVSLYLQDQIQLTTEWEVTAGIRYDYYNDFGHAISPRIAAVWKPEEKSSLKLMYGTAFRAPNFLELYDRNNYVDFGNVNLNAEEVETIEVSWLQTFENWHVEITAFNNDFKQLITLAAPVEHPENPFFSPSFTNNDGQKSRGVETELQFKLTQQFSIKVLWNWFTDDSDINIAQNTGAVMFDYQQAAWRFNLHGFYRGNNEAVANQSSYFVAAANASLSLSPHLTVNFALDNMFNQQYRTQSIVYEEGIANRGRAITLGMQYQF

SEQ ID NO: 15791 - protein, 190 aa, Wolbachia pipientis
YVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTV

SEQ ID NO: 15792 - protein, 514 aa, Actinobacillus suis
MKKTVHHMLVTSGVASGLPLLLSLGVPHAALAQAASASAAASASESAAQASPAAAATSAALAIDGVQTRSAAPAPDAAATPAPTGFWERSNLFGDMGGLRSKLGDHGITLNLQETSEYLRNLSGGTSRGGAYGGLTQFGFSVDTEKAIGLPGGTFNVSGLQIHGTSLTSRNLQLLQTASGIEAEGTTRLWELWYQQSFANGRADVKIGQQSLDQEFMVSQYASTFINATFGWPVLPAVDMPAGGPAYPLSSLGVRLRAKPSDAWTVMAGVFDGNPAGGVGDAQQLNRHGTNFNLRNGALFIGELQYALNAPPADPKAPQPAGLPGMYKLGVWYNSERFADPRYDTNGVALADPASNGIAATHRGNYGFYAVADQMVWRPGADSPRSLNVFARVMGAPGDRNTVDFTLNAGVTLRAPFAGRDNDTAGLAVSYAKVGSHARGADGDAGVFQTPGYPVRRAETLLEATYQYQMTPWWQLQADFQYAFRPGGGIPNPNEPGTRIGNEAIVGVRTTIAF

SEQ ID NO: 15793 - protein, 839 aa, Chlamydophila abortus
MKHPVYWFLISSSLFASNSLSFANDAQTALTPSDSYNGNVTSEEFQVKETSSGTTYTCEGNVCISFAGKDSGLKKSCFSATDNLTFLGNGYTLCFDNITTTASNPGAINVQGQGKTLGISGFSLFSCAYCPPGTTGYGAIQTKGNTTLKDNSSLVFHKNCSTAEGGAIQCKGSSDAELKIENNQNLVFSENSSTSKGGAIYADKLTIVSGGPTLFSNNSVSNGSSPKGGAISIKDSSGECSLTADLGDITFDGNKIIKTSGGSSTVTRNSIDLGTGKFTKLRAKDGFGIFFYDPITGGGSDELNINKKETVDYTGKIVFSGEKLSDEEKARAENLASTFNQPITLSAGSLVLKDGVSVTAKQVTQEAGSTVVMDLGTTLQTPSSGGETITLTNLDINIASLGGGGGTSPAKLATNTASQAITINAVNLVDADGNAYEDPILATSKPFTAIVATTNASTVTQPTDNLTNYVPPTHYGYQGNWTVTWDTETATKTATLTWEQTGYSPNPERQGPLVPNTLWGAFSDLRAIQNLMDISVNGADYHRGFWVSGLANFLHKSGSDTKRKFRHNSAGYALGVYAKTPSDDIFSAAFCQLFGKDKDYLVSKNNANIYAGSLYYQHISYWSAWQNLLQNTIGAEAPLVLNAQLTYCHASNDMKTNMTTTYAPRKTTYAEIKGDWGNDCFGVELGATVPIQTESSLLFDMYSPFLKFQLVHTHQDDFKENNSDQGRYFESSNLTNLSLPIGIKFERFANNDTASYHVTAAYSPDIVRSNPDCTTSLLVSPDSAVWVTKANNLARSAFMLQAGNYLSLSHNIEIFSQFGFELRGSSRTYNVDLGSKIQF

SEQ ID NO: 15794 - protein, 839 aa, Chlamydophila abortus
MKHPVYWFLISSSLFASNSLSFANDAQTALTPSDSYNGNVTSEEFQVKETSSGTTYTCEGNVCISFAGKDSGLKKSCFSATDNLTFLGNGYTLCFDNITTTASNPGAINVQGQGKTLGISGFSLFSCAYCPPGTTGYGAIQTKGNTTLKDNSSLVFHKNCSTAEGGAIRCKGSSDAELKIENNQNLVFSENSSTSKGGAIYADKLTIVSGGPTLFSNNSVSNGSSPKGGAISIKDSSGECSLTADLGDITFDGNKIIKTSGGSSTVTRNSIDLGTGKFTKLRAKDGFGIFFYDPITGGGSDELNINKKETVDYTGKIVFSGEKLSDEEKARAENLASTFNQPITLSAGSLVLKDGVSVTAKQVTQEAGSTVVMDLGTTLQTPSSGGETITLTNLDINIASLGGGGGTSPAKLATNTASQAITINAVNLVDADGNAYEDPILATSKPFTAIVATTNASTVTQPTDNLTNYVPPTHYGYQGNWTVTWDTETATKTATLTWEQTGYSPNPERQGPLVPNTLWGAFSDLRAIQNLMDISVNGADYHRGFWVSGLANFLHKSGSDTKRKFRHNSAGYALGVYAKTPSDDIFSAAFCQLFGKDKDYLVSKNNANIYADPLYYQHISYWSAWQNLLQNTIGAEAPLVLNAQLTYCHASNDMKTNMTTTYAPRKTTYAEIKGDWGNDCFGVELGATVPIQTESSLLFDMYSPFLKFQLVHTHQDDFKENNSDQGRYFESSNLTNLSLPIGIKFERFANNDTASYHVTAAYSPNIVRSNPDCTTSLLVSPDSAVWVTKANNLARSAFMLQAGNYLSLSHNIEIFSQFGFELRGSSRTYNVDLGSKIQF

SEQ ID NO: 15795 - protein, 288 aa, Ehrlichia muris
MNCKRFFIASALISLMSFLPSVSFSESIHEDNINGNFYISAKYMPSASHFGVFSVKEEKNTTTGVFGLKQDWDGATIKDASSSHTIDPSTIFSISNYSFKYENNPFLGFAGAIGYSMGGPRVEFEVSYEIFDVKNQGNSYKNDAHKYCALSRHTGGMPQAGHQNKFVFLKNEGLLDISLMINACYDITIDSMPFSPYICAGIGSDLVSMFETTNPKISYQGKLGVSYSISPEASVFVGGHFHRVIGNEFKDIPAITPAGATEIKGTQFTTVTLNICHFGLELGGRFTF

SEQ ID NO: 15796 - protein, 272 aa, Ehrlichia muris
MNYKKFVLSVALSTLFSFLPDSSFSDVVVSEEKRGFYVGTQYRVGVPNFSNFSAAETIPGLTKKIFALSYDATDITKETSFKQAYDPTYASSFNSFSGVMGCYFNSMRIEFEGSYSHFESERQFYREGSNNYKFFALSREETITSKKFVVLENNGVIDRSLNVNFCYDITRGDVPLAPYVCAGVGADYIKFLGISLPKFSYQVKFGVNYPVKSNIMLFGGGYYHKVVGSKYERVEIAYHPSIEEAPKITSASANLNTDHFGCEVGIRFAFIN

SEQ ID NO: 15797 - protein, 407 aa, Ehrlichia muris
MSNKKLSVLALGLICSTSAFANETASSFDKWFSEGSVHGAMKSYYFAQTFDKEGSHDSQIWANGGNIAFNTAELNGFELGGEFQGSYINSRNDRDGKTAGNMDADGAILSESYLKYTLGDTIFKGGRQHFSSPFVADSDSRLIKESFEMYQIRNKSLLNTEISAGYVTKYQTRTDKSYYADNDFVEFEQNGTGRPGEFYDIGDSGMWFAQVNTSPSKKIKIQASYADVIGEVKALYADVKYTLPIPLKSYIAAQFYTNSWDNPDFANNNLFGIKFGANHNNFEFFAAYTTVSGSEGEHRVFRGIGQGAYYQFTTTTKTAGVNAFEAGTDSYQLGVGYKYNQLDGKLRFTSFNNPEVGKDLDEWTLNLVYGFSGDFKNCLVSVDFSVLDYENNDNDATDLRAKFIYKF

SEQ ID NO: 15798 - protein, 683 aa, Ehrlichia muris
MSSITRGCGARARLSERFSIQPSRLRWQIAHATLLGLLASGALAAESVDHSEHAHHASSAELAPMVITGVAQQSPLTVATDPKIPRQPVPASDAGDYLQTIPGFSAVRGGGSNSDPVFRGMFGSRLKLLANGAEMLGACPSRMDSPSSYITPENYDALTVIKGPQTVLWGPGNSAATILLERDPEDFSELGGRIDASFLVGSDGRFDRNIDAAAGGEQGYIRLLANRSDSDDYQDGNGDDVHSRWDKWSTDLVLGWTPDEDTLLELTVGRGDGEARYAGRMMDGSQFERESVALRFEKTNLGENLKKIEARVYYNYADHVMDNYSLRTPPMMQMATNVDRRTLGGRMAATWQLDEYELVTGVDAQTNEHRRRGGVDYKSKPWEKDADFHNYGLFGELTRTLNDDSRVIGGARLDHATAKDYRSTGPSAGDSRSDNLPSGFLRYEHDLQSLPATAYVGLGHTQRFPDYWELFSGGADAFEKLDPEKTTQLDFGLQYSKGPLDAWVSAYVGQVRDYILFSYSPSKYSENIDARIMGGELGATYRLTSNWKTDASLAYAWGKNSSDGEALPQMPPLEGRLGLTYEQGDWSAAGLWRVVAAQNRVAEGKGNVTSKDFDESSGFGVFSLNGAYRVNQNFKLSTGIDNLFDKAYSEHLNQAGNAGIGLSADERINEPGRTWWARVDMSF

SEQ ID NO: 15799 - protein, 933 aa, Ehrlichia muris
MNNKLLYIVGMAFLLSTTANGQQHAADSLGNNGLDAEMIDLGYIKKNRSNLTQAVSTVSSEVFENKTATILQNSLYGLFPGLYAKQDVGWHAEAALNVRGRGGLGDGTPLIIVDGFPRSLNAITLEEVETMSVLKDGAATALYGARGANGVILLTTKRGAYNSFDVDINYKHGFTLPVNKPEMADAYTYARAMNEALYYDGLAPMYSESDLNAFRNQTSPDIFPNVNWVDEGTRSMGENNQLNLLVRGGGSKLRYMGLFDYKNDFGLLNEKYTEYTDRYKSQIRSYDMRLRMNIDVDLTSSTQMQFGIVGVLNESKRPDETIGTIFENLYKVPSAAFPIKTSNDLWGSNLLHKMNPLAVIADQGYYQTNWRKLEANMRITQDLSMLLKGLKAEAAIAYDNTATFWQEGSKTYSYEVISYSDETGKVGTVYNDNPQYVVNIGSGSNKVLEQTIRSNWEVKLGYDRAWNNHQLSVSALYRQEMEESLGVNSSWYRHSLMGMASYNFRNKYMVDVVANRYGTSVLLKGDKFRFYPAVSAAWVLSNEDFLKDRSFVDLLKLRLSYGRSAVDNLAYGLGKHYWSSLREYYFGDSNTEVSGYLERKIPMRSLELETADKYNIGLDVQLFKKLSFTADMYYDKRSNILVSNNKVSGMIGIDVPQQNVGKVESKGLELSLGWNDKIRDFRYYINGNVSFMDSKVLENGEGYQPYDYLYAKGHKVGQAFGLEAVGYFRDEEDIRKSPVQTFSTVRPGDVKYKDQNNDGRIDAYDEVAIGKSTTVPEMVYGLNLGFEYKGFGVDATFQGVGGISTMLTTPHVYRPLRNNNNISTWYLKDRIRWTESTKDIANLPRLSTLDNANNYRSSTQWLENGSFFKLRNLNVYYNFPQKWSEKLRMDKLQVYVRAQDLFSLDHIDYLNCENLSLGYFDTMSISLGLNINF

SEQ ID NO: 15800 - protein, 555 aa, Ehrlichia muris
MVKKLLSTFFITLLFSSYIQAQALKGRILDTSGSPIIGAYIIHTTSEHHAHTNESGYFVLPEVTKGDSLQISHVGYETQAYIVDNLSKEVTIRLKESAIELGEVIFSQDVNPVSTLSRIDLKTNPVNTSQDILRKVPGLFIGQHAGGGKAEQIFLRGFDIDHGTDINISVDGMPVNMVSHAHGQGYSDLHFIIPETVERIDFDKGPYNADKGNFATAGYVNFQTKRGLDKSSVSVQGGSFNSIRTVGLFNLVNKVNNNAYIAAEYLSSDGPFESSQNFNRLNLMGRYGVTFDDGSDFSLIASHFTSKWDASGQIPVRAVESGQITNFGALDDTEGGYTSRSNIALNHSKMINDRLFIKNNAYFSKYDFELFSNFTFFLEDSVNGDQIRQREDRALFGLESQLTYSNTFSGGDYALQFGVGLRSDDSRGNELAGTKNRDSVRFVTQRGDITEANYYSYVNFDLFINKWRINPGLRVDYFNFLYQDDLTPEYDPKSLNAAVLSPKLNFIYTANEKVQLFLKSGIGFHSNDTRVVLERPNNESILPRGLELMWVVILN

SEQ ID NO: 15801 - protein, 939 aa, Ehrlichia muris
MYNIINKHQIIKILLFSLCVFFFTLTEKQKIYAADVFFEGRTETLINVNKPFDSFFGGSDSTIGTLETGPTNLTFTTVGAFRNSVFRIIGGGRSSFNNPNTVKGNVTLTVYNTDVERIIGAGISNRGLVTVTGSVNMKLENVSVTRGIYGGVYTQNGHVLGSINMHLKNVQTPLLIGSGVSNGPNRITVNGDINIDVEDSRIQYVNITGEVDAGIKGNATLTVKKSTVELINSGRGNILGNLKISIADSNIRGLSPVDFGSSVYGDTSINVINSQINDITLIPRAGGMLVGPVTLDITSSTIQNIQCGPVSQNNQLNTLNVTVNTSNITNLNLGSVEGHTISTTATVTDSNITNLNVGTFNGLGVTENASVIINSGNITNLNVGTNVIAAATTINSSATIHDGLIANLTLGSQGNGRTMIATANVNGGTIGLLTMGSENFIPGTRPITELAILNMSGGLIERIIVGNANSSTINFTPGKRSIVKTINGPELPYLVNIQKGAMTQWGTKNMPFLLDTRNLILSGTLITSNIQLADLSITNLFVANGGTLVPRKLIPGNQPVIQFLGGPQSLLVIHQPLKVNLSLSPKLIGSSMVPLAFVSQSFSSPDLFVKQTRSGLIWSDLEFDPTTSIWYVNNIQASQDFYSFSIARETTNWLRQQHIWTLQNRSSKLLDNEHYGLWINVQGGHESLDTSIGSKAKMPWIMATAGYDYLQQLPRLDMKALYGLAFGASKGKSKWSSVNSTKNDAELGMVSGYVGLIHNKTGLYSTLTLQLASSKLHTNSTGFYRNFKWTETTPTEALELGWKYTFNNGIKMNPRGQLIFEQTSKHHFDLGIQNDKAILDKSQLITSSLGITVEYKLPVTTPINLYAGIERIKGQSGNFAISSQSLQMKFKHDNDTSVVRATIGTNILLGEHFNIHCDIFGDKGNDKGIGGQAGFTYKF

SEQ ID NO: 15802 - protein, 1010 aa, Pseudomonas putida
MIKKIVLSLITVLSFCSLALAQNKQVTGTVTDEKGEPIIGATVVAEGTSAGTTTGGDGQFTLTVPANATLSISFIGYETQKVSVAGKTHIDVTLGEEATGIEDVVVIGYGTGKKIGSVIGSVDQVKSEKIENRPSTNVVDALQGQVAGLQIMTGNGELTSTSSIRIHGLGSMGADTSPLILLDGAPIQASTLQTINQNDIASVNVLKDASATSIYGSRAANGVIYVQTKTGRRNQESVDVTLTGQYSMSSAVAPELNMMSANEMLDYIGAAVAVRLSGDALTTPDKIASGRQYFIRNFGLAKFMDENYNPMNDYKWWNEILERNAPMYQVDLSVSGGSAKTSYYFSGNYANKTGILPGSELDRYNFRTNIDTRANNWLRLGLNLGLGYQHSSVADTDESMGGLYVSNPVMASLITPPYQPLYDDNGQMLNFFDATQAINPLMTADYMPRWQNRITMNGMAFIELTPVKGLTIRSSLAVDAFDWRSHGASSPETPTPSGKFGTGSASELFQRFYEWTWTNTAEYKHTWNEVHNFTALLGEETLYRNNNSFSVASIGITSSRFLNIAMGTEVSGGLPTYSIAQSASNSVFGRLEYNFAERYFISGLLRNDASSRFGENNRNALFWAVGGMWNIKNETFLRDNQTISDLSLKVSYGTQGNSGIGDYNHRQYMAAGSAYGGYTTWMVSGIGNPDLMWESQNTLTVGANIELWRKLSLSIEYYRRQTNDMLMSIPLAPSGGYSGRAGNVGGMRNSGIDLSLNYDIYASKDWFVNFHATFNYNKNQLTDLWEPGLEFAYMGNGLQAYSVGDPFPTWTMQEWRGVDPETGLDTWTTADGGITSNFNQAALVNLGTSLYAPYTGGFGVTAAWKGLSLTADFSWVHGNYALNNTMYFVANADMGLSSQFNQCDLAWDYWQQEGDQARYPRLDQAINFDSRMLEKASFLRLKYIQLAYTLPSHIMEKTKFIKGLKVWVGGRNLWTVTGYNGLDPEAAEKGVDVDTYPNTREFTFGLEFKF

SEQ ID NO: 15803 - protein, 844 aa, Manganese-oxidizing bacterium
MAVASPAGGLDAPSRRIVFDAQMLALGPGGRSIDTSRFERGDVIEPGRYRLDLLLNSRWRGVEEVELRRQPGRESAVFCYDRGLLERAGIDLEKSARGQDRSSARDPLPEGLHCDPLERYVPGARVKLDIAEQSIYVSVPSYYLSLDSSKTYVDPASWDSGISAALLNYNSNLHVRENHGRSATSGYAGMNAGFNFGRARLRHNGTATWSRRMGSHYQRSATYVQTDLPAWRAQLLLGENSTSSEFFDAVSFRGVQLSSDDRMLPDSLRYYAPVVRGTASTNARVSVYQRGYLIYETTVAPGAFALDELQTASYGGDLEVRVTEASGEVRSFIVPFATTVQLLRPGTTRYSLTAGRLNDPSLERRPNMLQGVYQRGLGNDVTAYAGGAFTGSYMSGLMGAALNTPVGGFSGDVTLARTEVPGDDRLSGSSYRLAYSKNLPNTGTNFSLLAYRYSTGGYLGLRDAAFMQDRVERGEPLESFSRLRNRLDANISQQLGNGGNLYLNGSSQRYWSGGGRAVNFSVGYSNQWRDVSYSISAQRLRSQYEGFSSGDRRGETSTLFSLNLSIPLGGAGRGSPTLSSYLTRDSNSGTQLTSGVSGMLGKRGEASYSLSASHDRDSRQTSKSASLDYRLPQVELGSSLSQGPGYRQLSVKAAGGLVAHSGGITAAQTLGETIGLVHAPNARGAAAGYSGSRIDRHGYAVIPNLLPYQLNSVDLDPNGMADEIELRSSSRNVAPTAGAVVRLDYPTRVARPLLVDSRMPSGEPLPFAAEVLDAHSGQSVGAVGQGSRLVLRVEQDRGSVRVRWGNEPQQQCLVDYALGPRETTPPVLQLACRPASAADRERTL

SEQ ID NO: 15804 - protein, 375 aa, Manganese-oxidizing bacterium
MRTYITSAAALCVAASGACAGALDRTGQSVDVLFEDGRYLEFSLGYLSPSITGESIATVGGAPFPTFPAGGRSGDIGQSNFNFGAAYKADINETWSYALIIDQPYKAEVDYPDGTGYFGEASFAEFNSTAITGLLQYNMANGVSLFGGLRLQESDASAAVAFAGGYEVSADADWGLGYVAGIAYERPEIALRVALTYSSEISHENDVSESFTSPFFTGGDSVAEFETPQSVNLEVQTGIAQNTLLFGSVRWVDWSDFDLSPQQYTATFGQPLLSYVEDTVTYRLGIGQRINENWSLAASIGYEENTGNLFTNLGPADGGESIGLAAIYSQGKYEITAGVRYIRIGDTTTAVQGNPAAEFNNNDVIAFGVKVGYRF

SEQ ID NO: 15805 - protein, 637 aa, Manganese-oxidizing bacterium
MLNLKVKGLKKEQIYSATKTLEAFMTSPVSATVISRKMIQQTGATNIAEALRLAPGLWVNQKTNGNYEVYMRGNQTPSGGLLQDMKNGQLMVMINHVPQFDYLFGGVIWEALPVSVNEVDRIEVIRTPSTVFFGTTAVTGVIHIFTQTVQDNDLKVDINTQAGVSLQSIQEGNRDVSSFNNLSLSFGASDKLRFRLSTNYHSVKRSQDSYYLLNEDRYIQSDSLLFYKHDVIETNLNTKLAQERIGTNAYVFYNPSEKVFVTTQLSYQSSQAQTIHSDDTLALAQRRSNMYGINLNAYVHNFHFNGSFQQGKRDYAIGYDGNHYQINQFLASLNYRLRYKGVLIQPEAGLLRGKSSSIETPDSIRTLTNYYAFFKTDLNPVRNLRIVASVRGDIYEQQKTPYLSYQLSSSYKLGTHFLRGSFTYNEGLPLVRKERQNAHHSLLSGATPNKNRVAEFGWNARILSKIRASAEVFYTQGEYNYTTFDTVAVSSEEPVPNIFSITQAGASAQVSVWLNKFQVGGFVTMQRSGRNLEQLMNNEINGAPQIFGGFQLNYNGLLNRLTANANVYFYGKHDITTQYQTLTIPAKTLLNIKVDYKVWNENSIFFNARNVLNTSTIEHAYADSIAGMYLIGLKISI

SEQ ID NO: 15806 - protein, 1114 aa, Manganese-oxidizing bacterium
MLQNYTFIADKRGVRRSFLLFFSLFLLQVTAFAQNDVRITIRENNITVIEALKKVEKQSGLSIGYNNSLLRDKPALNLNLDKAGLDYSLSTILKGTGCTYELKGKYIKIIPQPAQEKPSSDKQIKGKVTDETGEPLIGVNIQVQGSASGVITDIEGRYSIEAPVGSTLNFTYIGYTPQNVKVTDRSVYNVTLATAVEQLNEVVVTALGIKREQKALSYNVQQVKADEISGIKDANFINSLNGKVAGVTINSSSSGVGGASKVVMRGAKSIEQSSNALYVIDGIPMYNFGGGGGMEFDSRGATESIADINPDDIESISVLTGAAAAALYGSNAANGAIVITTKRGQVGKLQVTVNSNTEFARPFVLPEFQNRYGTGSRGKDGGSTILSWGAKLNDASRTNYEPKDFFDTGLIFTNSVTLSTGTEKNQTFFSVASVNSEGIVPNNRYNRFNFTFRNTTNFLNDRMKLDIGASYIIQNDRNMTNQGIYSNPIVPVYLFPRGDDFGLVKVFERWDPARKINTMFWPQGEGDYRMQNPYWIAYRNLRLNQKKRYMLSAQLSYDITDWLNISGRVRVDNTHTKYEQKLYASSNLTITEESTQGHYTISKPDETQTYADVLANINKRFNDFSLVANVGASIVNNRYEDLSYRGPIREKGIPNVFNVFDLDNTKKKARQDEWQEQTQSVFASVEVGWKSMLYLTLTGRNDWASQLANSSTPCFFYPSVGLSGVISEMLTLPEFIDYMKVRGSFSSVGMPYPRNLTSPTYEYDEANQQWKPKTHYPIKDLKPERTNSWELGLDMRLFKDFSLGFSWYLANTFNQTFDPKVSVSSGYSKIYLQTGYVRNSGVELSLGYGHTWNNHLHWESNFTLSHNKNTIKDLVTSYIHPETGLPITQNRLDVGGLGKARFILKKGGTLGDLYTQSDLKRDNSGMVEIDPSGALTTEDNLPDIKLGSVFPKANLAWNNRFEWRGISLSALFTARIGGIAYSATQAAMDQYGVSERSAQARDNGGVLLNGRTLVDAQTYYSLIGNSSGLPQYYTYSATNVRLQEASVGYTIPRKWLGGVCDINVSVVGRNLWMIYCRAPFDPEAVANTGNYYQGIDNFMLPSTRNIGVNVKINF

SEQ ID NO: 15807 - protein, 755 aa, Manganese-oxidizing bacterium
MRNARQSRAVLRPMLLGSVACTSIAAAFIHPARAQVTDINTGLPTAQAVHPLTAFPSVGGVTLDMISVAGSGSGRGLVVDSSGSQVGYLARRLRSSTKTDTPLVDTPQAISVVTEAQIRDQNVQSIGEALRYVPGVAIAQGEGHRDEILIRGQRTTADFFVNGIRDDARYFRDLYNTQRIEVLKGPNAMIFGRGGGGGVVNRVLKEADGVPVREVLVQGGQFGNKRMAVDLGDRVSDSAFFRLNGVFEDTGTYRDFIDIRRYGVNPTMTFLLGPQTTLRLSYEFFSDNRIADRGIPSQFGRPWRYRENTSTLFGAPLISNGFVDAHIGNAQLDHVFESGVVMRSQTRIADYAKYHQNAYPNSPVSADETSFVMRGYGSQTDRTNTFNQTDFTYKFNTGPLAHTVVAGLELGFQEGIDFRRDFIWNSTGTRNLPVNPFAPTTTEGATLRNLASGRNNTYRLGVFSAFAQDQIEIDEHLQFIVGARFDRFDFQSRDRRPDAATGLPAQPNSRIDNLVSPRVGVVVKPLPNLAFYGSYSVSFLPSAGDQFRVLDPMTALSAPERFENAEIGVKYEITPALILTAALFNLDRDNQPIPSSTEAGFSAGPGKTNTRGAEIGIAGYATDWWQISGGYAYTEPRIVADIDDDGDVIRAGNLVGGVPLNTFSLWNKFDIGERFSVGVGYLYQDASFASSDNAVRLPSFSRFDAGVFYAFSETMRAQVNIENLFDRRYVISAHNNNNILPGAPRTVRFQLIARF

SEQ ID NO: 15808 - protein, 771 aa, Manganese-oxidizing bacterium
MNLALLALTITAGAIVTSPLQAQDLPSEAEGPVVKDPANTIVVTGTRSAGRSALEAAVPVDVVSEEELNATGYADLNRALNFLEPSVNFPRAATTATAANTRPITLRGLSPDQTLVLVNGKRRHTNAVLNVNNSIGRGSAGVDLDTIPQNAIQRIEILRDGAAAQYGSDAIGGVVNIILKDDAQGASFELLGGITEEGDGLNGLASTSGGLPIGRGGHLTLSALVRAQEATNRAFVDQRFDRVTYRIGDPEASLFGGSVNFGLPLGDAELYGFGTVAQKISNNGAGFRVPGTSLLYPDGFLPVIEPYIWDGSGTLGISADLGGFALDLSQTYGRNEADFRVFDTVNVSLGLDSPTSFDSGGVTYEQYVTDFGVSRSLGLLAGGNITAGAQYRRETYAIREGEPAASTGVGADGFAGFAPRRPVNEVRDAFAFYLDAELRPIEALLIGGAVRYDEYDDSGGETTWRVSARADLTEGLALRGAIGTAFRAPSLQQQNFSAVQGALSAGQLVSVATLPVSDPIARALGAGDLRPERSRNYSAGIVLEPTPRLAFTLDAFHIQIDDRIALSEQLRGAAVNAILAGAGIVGFSQVRFFTNAVDTRTTGVEATARWSASLSPETRASMDVGFALYDTELESLRANPVLPTLPLLGEKSILFLTEAQPRDKLTVQAVVEHRSVSARAALTRFGTYTSQPLVETQTFDGGTSFDLSLSYALSSAIMLTAGVQNLFDDRPEEIADQARFIAATGGSFPTGEETPLGVNGRSYFVQLRGNF

SEQ ID NO: 15809 - protein, 797 aa, Manganese-oxidizing bacterium
MRALYYLTSVLTAIALANSAWAQEGSAPATEEVADDTAVLDTVVVVSDRVGLLEKSSSESVFGMGKSLLETPRSATLVSDLTLERYGIEEVDDLIAIAPGTFTGSYYGVKGAVNARGTLAESYFNGFKRVENRGTYPTLLGAASQVDIVRGPPTPAFGPGKVGGLINVIPKTGRANGSDEMAGQAEVTVGSYGKFNANGQVGVPVGDRGGVYGYVEYENSDSFYRGVSPEHLMIQLSGEYDLTDTLTLTMSGQYFDSDGYVQSPGWNRVTQDLIDNQNYITGRNTAVVDTDGNGRITPGEAGGSFVVGYFGFPPPVDPRFQLTEGVGTAKLDARTIFISDADFSKSTTNTLYFKAEQQIGDDTLNVELFYDDMENQRFVSYGFPADYDAWAGEGRLSYDFDAGTEDSFIRSTNKVGFGYRRQDAIKKETYNSGYISLDRRDIIFGATPNDIIDDPFSVEPGIEGVGWDMTVDSSWTNKGLFALSDISIGEYASLLLGGRYDWYDATSIDTGALCYCPANIEFDAAQEEFSYSASFSLNTPFGLFPYVTYAETAALEIGQAGDITPGLISGDQWISDSELTEAGVKFELLSGTLVGSLSGYEQSRTRLSMFDNVVATEAKGIELEARWLATDNLSFTFAGNTQETTVKGPDASFGYIPVWATGLDPIDGYGAAYAVYNLATSPVGQPGDYEFRLVPQTVASVFGSYVSDPYEWGQFGVTGGITSVSETAGKLANPVILPAYETVNLSAFYTFNDYEIAFNVDNLFDELYFQPVTDTYSDMAVLPGRGTEYRVTFKKKF

SEQ ID NO: 15810 - protein, 223 aa, Manganese-oxidizing bacterium
MKRLALAGMALTAAATASAPVLAADLPQSPAPAYEAVPAPQQSIDWTGLYVGGNLGWAFGQFDNKAGNNTGLGVDANGIAGGLYTGYNFQVTPNIVVGAEADFSLTDLEKSKSNGGLTLRSKSDWNSNFRGRVGYAFDRYLVYGAGGLAIADLEVSGNGDTDSKTALGWTLGAGGEAAITNNVTAKLEYVYQDFGEQDFNLNGTGVSSDFNNSQVRMGIGYKF

SEQ ID NO: 15811 - protein, 1068 aa, Manganese-oxidizing bacterium
MLTLLLALIVQITFAQEQKVSGMVSDESGSLPGVSVVIKGTTTGTETDFDGKYTIMAKRGAILSFSYIGYKTVEKTVGISNVLDVTLSQDSNTLDEIVVIGYGTTTKKSFTGTASVVSTENIDAKAVSNIAQALIGEASGVTVTRTDGRPGASATIRIRGFSSIEGNRAPLYVVDGVPFTGDINSINPNDIASTTILKDASATAIYGSRGANGVVVLTTKRGEVGKDVIEFDIQTSFNQRTLPRYNLVNNEERYMGLVYDGLKNTGEFTGEADPAQYALDNLFADKGVAPLYNMWNVADGNELIDPATGSVRPGVTRKFTPTDWFDAGYRTGVRNEMNFKTSGGNDKTRHYFSLGKLSDEGFIQESQYDRYSARLNVTTKPIDRVKIGTNLDYSYSEYNDATGYGGGNVTYMLDFIPTIYPLYLRDTNGDIVVNPNTNNQMYDFGDNSAGNARDFSATYNGVGESIYNINRTKRHSINGNVNLVLDIAKGLTFESTYGVNIYSSNLDNTRNSIQGSAGVALGGTLFKSNETYTSQNLNQILRYNKTFGQDHNFDILAAHESFEATTEDFNLSKKGIVNLNPNAAGVPENYLDQNGVSSGSKTDTSLESYFTQANYNYAGKYYISTTLRRDGSSRFFKNKWGTFWSVGTGWIISEENFLKSSDVVNFLKLKASYGYLGDQGNAAFAGQLGFNIENLLGATSLVPRAVVDPNITWETSNQFQTGVELELFNGAIEADLDYYIKTTSNLYVNKRLSPSTGDAIILTNDGELVNRGFEFNVTGNIVRNEDFRLSLTVNGEMFNNEITRMPIENATGKPKAVNIDGRYGQSKGRSIYDFYIREWAGVNAENGDAQWIEHWVDANNDGEYTSGEGILDMLVYTAANPDKTIQERITNTYADATRKYVDKSLIPTVRGAFRVNTSYKSFSLSTQFGYSLGGYGYDSNYAVLMSNGKVGASSYHVDMENRWMNPGDITDVPRLYSNENIRVNGTSSRFITSTDYLALNNVRLGYNVPSRYLAKIALSSVNLWVSGDNLFLLSARDGFNPTTSVTATSDRYTYNPISNYTLGVRIKF

SEQ ID NO: 15812 - protein, 995 aa, Manganese-oxidizing bacterium
MTDDHSFRPRPTSLSAALLLGAWIAQPATAAYVEAGRPGDPASWRSAEYQQDWGLERMRADQAYAAGIDGQGVKIGEMDSGFDPSHPDTPASRYQPVTASGTYVDGTPFSVSGAMNGNNDSHGTHVGGTLGASRDGVGMHGVAYAAQVYVANTNQNDSFLFGPTPDPNYFKAAYQALADAGVRAINNSWGSQPKDVSYETLDGLHAAYAQHYGRSTWLDAAAGVSRQGVINVFSAGNSGYANASVRSALPYFQPDLEGHWLAVSGLDQQNGQRYNRCGIAKYWCITTPGRLINSTMPGGGYANKSGTSMAAPHATGALALVMQRYPYLNNEQALQVLLTTATQLDGTPTGAPTDTVGWGVPDLGRAMHGPGQLLGRFEANLPAGLRDEWSNPISDSALLQRQAEDAAEHAAWQRTLKDKGWENGLPAGASQQERTDYAIGMARDQAAAQRQYQGSLVKAGAGSLVLSGDSTYRGPTLVDGGLLSVDGSLLSAVEVNAGGTLGGSGRIGGLLARSGGTVAAGNSIGTLEVAGDLRFESGSTYAVELSESASDRIVASGKASIAGGNVTLAMENSPDLLSQSQVESLVGRRYDILDAAGGIEGRFDAVLPNYLFLGGTLDYAANAIRLDIGRNGTTLASVAQTPNQAAVAGAVETLGAGNPVYESLLLSENAATAQRAFQQLSGEIYPALAGLLLNDSRYLRDSVGERLRQASDGEAGGEAPEGWFKALGSWGKSADGSHGSEGYRHSVGGFLLGVDSQVASDTRLGLVAGYSNSSLNMDSSLQSSASIDSYHLGAYLGRQLQQWRLSLGAAHAWHRAEVKRDLQYGAVAGKQKAKLDAQSSQLFAEAAYALGWRSLELEPFAGLAYVHVASDDFRERGSAAALEGGDDNLDAAFTTLGLRAKRHFELDAGRRLALSGTLGWRHNLSDTTPQRHLAFASGSQPFSVESVALSRDAALLGVDASLAVNREVSVRLGYNGLLGSREKDHGVGLAVDWRF

SEQ ID NO: 15813 - protein, 292 aa, Gamma proteobacterium HTCC2207
SVAAMADVTLYGTIKAGVETSRSVFHQNGQVTEVTTGTGIVDLGSKIGFKGQEDLGNGLKAIWQVEQKASIAGTDSGWGNRQSFIGLKGGFGKLRVGRLNSVLKDTGDINPWEGKSDYLGVNKIAEPEARLISVRYDSPEFAGLSGSVQYALNDNAGKHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDDADIGNEYDQVVVGAEYDFSKRTSALVS

SEQ ID NO: 15814 - protein, 1539 aa, Gamma proteobacterium HTCC2207
MNYNRKLSLSLVALAALILPSHSAQSQSILLSASDFVLLGGTAVTVGGAGPDVFSNGNVGAAASISGFPPATVVNGTTITGGMIVGNALNDLITARNALSAMVSPPANNLTGVNGGDLATQILTPGVYKFDVAASLSLNGVLTLDAQGKNNVTWVINIGTALTTGANAQVVFINLGSNGGADNGLFWNAGTAFTFGANNVIAGNYLAGTDITFGTTVPAAGSGSGRALALAGVTFDGTATMDALGGPGNGDLTGGLAFDDNGNLVASGYVLLSASGTYSQGTSSVVLTPGQIYNTPGVIIDGDSSDTLLSPATLTVFQTIATLTGTNTYTGGTIVDGGTLIAGSANLPTNGDISLIDSNATGTAGSLVLDQPSDGTLGGVISGEGSVTKTGSGILTLSGANTYSGGTTVDDGTLVGTTTSLQGDILNNAAVTFDQADAGTYAGIMTGTGSLTKEGEGTVTLSGANTYSGGTTVSAGILVGTTTSLQGDIVNNAAVTFNQATAGTYADVMTGTGSLTKAGANTLTLSGANTYSGGTTVSAGTLVGTTTSLQGDIANSAIVTFNQATAGTYSGAIDGIGSVTKTGAGILTLSGANTYSGGTTVSAGSLVGNSTSLQGDIANNTAVTFNQTSDGIYSGIMTGTGSLTKEGASVLVVSGVNTYTGATTITAGTLQISGAGGLNGSSGITLNGATAKLLQTSTLAGTPAITLTQGTLDGTGSVGNVTVGNGTGGIVTNGNGTTASLTVASLTFDGAGTIILNKANNTGAVALAITGALTTTPANGQVSLDLLTVPTWTSGTYNLISYGSFNGLDTDFTLAPLTGLGTRLTATLGNTGANAGFITLAIVGDTPVWTGLASGDATTTAVGGLQNWALINAGTGTEFLTGDVALFDDTATGTTTVAINDNTFSPTSTTFTNSTLDYTLTGSNGINTGTLVKNGTGTLTIETPNTYTGGTTINGGTVALSGAGTLGASTSPLAINGGTLALGGTNQTVGAVTLADGTIDNGTLTGDSYTSTGGTVNAILAGTGTFTNTSGTTTLTGANTYTGDTLVNGGTLVLDDGSVSATTVASGAFLRGEGTINGDLFNSGTVSPGFSPGTLIVTGNFTQTTGGILVIEIASAVSFDQIIVSGSASLAGTLQLDLLDGYNPVGQSFEILTAAGGVTGTFSPVTGSAAIDATVTYNANDVTVSFIQLPFASFGETPNQIAVANAAQLDPALTAALNGVPTAAELPAALNALSPQGYQIWSDIAFARSLSLSERLARDPGVISGHDNFYFQVGQSRNRATGDSDVGTASFKSDTGLVGGDYAIGENLVLGGFFDYTETDAGLGSSGSSTKVKSKMPGIRAAWRKDAWFANAAIAYSFDDYESTRSIAFTGTSATAKSDTNGRQWLMDISGGRRFIAGPMTLSPFVGLLANAWKADGFTETGAGAFNNRVGDQSAHSLRSQLGLEASFDFIIGTVVLRPHVRGAWIHEFENDSRSINAAFGAVNYTIVTRKPERDSARLSAGLDARLSERLSLYADYGIQTGDTTRVTGEWSAGLSFRF

SEQ ID NO: 15815 - protein, 344 aa, Gamma proteobacterium HTCC2207
MKAIFVLNAAPKDNTWYAGGKLGWSQYHDTGFYGNGFQNNNGPTRNDQLGAGAFGGYQVNPYLGFEMGYDWLGRMAYKGSVDNGAFKAQGVQLTAKLGYPITDDLDIYTRLGGMVWRADSKGNYASTGVSRSEHDTGVSPVFAGGVEWAVTRDIATRLEYQWVNNIGDAGTVGTRPDNGMLSLGVSYRFGQEDAAPVVAPAPAPAPEVATKHFTLKSDVLFNFNKATLKPEGQQALDQLYTQLSNMDPKDGSAVVLGYTDRIGSEAYNQQLSEKRAQSVVDYLVAKGIPAGKISARGMGESNPVTGNTCDNVKARAALIDCLAPDRRVEIEVKGYKEVVTQPQA

SEQ ID NO: 15816 - protein, 803 aa, Gamma proteobacterium HTCC2207
MKTRRPFDLPEGWTFSGQAEGSYGDRVQKANALYSGLASFRTARWGALLAVSYSDATLENKHPSVYSNGAQKSTEQNVGFDFNGDGRIGSNTDPGNLPRDYFYNWVATELDNRSTDRQRTGINGSFQFNINDSWTVLADAAYTKLEDHDTSVAAQLHTGWATNQLQPGSVVDPNGVLEYGNFRYNRFQAHSMAGVADSDALNTNLELRYDDGGPFRASFRWVHGDAQRTYDEARADAAVTRGDQIPRAGGVTQWANVNGLPTVDASVDFHGTYPAVNLATDVSNPDNWQLMSTWAQGNKIDAKMDAFRADGTFEFDEGVVRGFQFGIRYGERDFKLDTYRYLSPVSSSCADPNRSLYYYKDPLIVDTCSGVSEARLLPFNSIPGYWAYFNDFDPLKVTGLGSQGLPAINPQAMKDPVAYLNSLYPGNVAYQQAADSYQVTEKTSSAYFMANLEGGTGTRVPWTANIGARIVQTKLAIDQYLSSGNVYIGNVEWNGVSPAIGTNRLNRQYTDVLPSANLSLDVTDAQKLRFAYNKAVARQDLPDLGRGLVSFYAVNGTPPRNPSLPSDAVLFLNGRSGNPDLDPYRATNYNASWEWYFADASLISVGAFLIDVKSFPTTVTNIEALPDADGVVRAGGPVERIVNGGGGKIKGFEIGYQQAFDFLPGWLSGFGTNINYTFSDADTDNTDIDGNTLPIGDNSKHQANAVLWYQKDKLQARVAYNWRSKRFSQVNSSAWGDELAIWNDDVGYLDASLSYDVNDHLTLYAQATNLTGESERRYAQWTNHYFDQNIFERRYYAGLRLRF

SEQ ID NO: 15817 - protein, 570 aa, Gamma proteobacterium HTCC2207
MRNSMTCLSAVLFASCGTAHAADIARPPAADPIAALNWTGFYLGAHLGAGFGTTKVDNPYGPSIYGDTVRVPKALAGLQAGYNWQAPGTAWVLGVEADASALDADGTDTCLAYSGQFVSANCRVREHVLGTLTGRIGHAFGSQGRSLMYVKGGAAFLTSDLTMTTNAVDYLNRPAAELKETRWGWTVGAGIEHALSSGWAVRAEYDYADFGTRGIDSPNGGFLQIPSNPNSLIDTLGAPTRARQDAHLIKLGLNYYFGRTGVTAESAALLPVKAPAARPWSAWQFDVGARYWYSHGRYQNDLTLNTITPQQEHLVSRLTYESEGHSGEVFWRIDSPRKLFVKGFAGGGGLVAGKMNDEDWFPTDPDFAAAYSNTYHGKVTGTIAYATLDAGIDLLGNSNGKIGVFAGYNFYRDRKDAFGCQQIALVGLPSPCSVAFPTTQIAISQHEDWHSLRIGANGSFTVAPGARLALDAAYLPYTHIAALDVHHNRTDVANKDSPAWGVGQGVQLEAILTYDVTPSFNVGVGGRYWAMWATDVLTAGFGSPVPTQLLPIRVERYGSFLQASYKFDVR

SEQ ID NO: 15818 - protein, 989 aa, Gamma proteobacterium HTCC2207
MKGKSFRKSGLCVAMGICLASMALPALAANTDGSLAGRVAAGAEVTVRSADTGFTRTVKADAQGNYRFPFLPIGTYQLQASKDGQAVGAPIQVVVSLGNEANVNLGGATDLAAVQVIGSRVITPVDVRSTESATNITKAELERVPIARDAQSVALLAPGVIQGQYGGASFGGSSVSENAVYINGLNVTDFYKRVGFSSVPFGFFKEFQVKTGGYSVEFGRTTGGVINAVTQSGTNEFKYGAELVWEPKSLQSGGDNHYDRSGDPFRIASRDKRDRTNLNVHASGPIVKDKLFFYAMYEFRDYRPESTNDAGSTFFKGKADKGFWGTKLDWQINDSHLLEFLAFSDKNETTTDNYQYDFARGSRGAASNTQYSEVGGTNWALTYTGYLTENFSMKALYGENKRDRIASSLNDQDCDAVQDRRVAGNPQIGCVSSALIENGADKREAARLDFEWQLGDHLLRFGLDREVNTSDNESFYPGPSRKFYQIYPTVPGTTLENGGVVPAGVNAYVRARQQEVTGTFETINSAYYIEDNWQVTPDLMLNGGVRVEAFNNKNGAGSTYIKIDDMIAPRLGFAWDFRGDGRAKVFGNIGRYFLPIVNQINVKQAGAFLDERTFYALQGLEAFQRNGATYYRPILGAQIGPIDNSQGDGTVQDQRSKVDGDIDPVYQDEVILGYQAMFGDAWSWGVRGIYRRLHNAIDDMEITSNGILCNGEPGGIGYVMGNPGKKVKLYTDTNCDGVKDGYVDIDTSRAGWALYDANGNYVGERGWVKPKRTYRALEFMLDRAWDDKWAFNASYTWSKSEGNVEGPSNSDFGFDNTGRTESFDDPFVNLNGDGPLPNDRRHQIKLRGAYAINDQWTVGATLNAQSGRPINAFGLGNPFDPTVYHSFYVCVANCTAKDFAQRTYELRQRGYGGRTPWTFDLGASLTYQRSFGGADLRVKLAVYNLLNQQRALEVDDSYETGVGVVNEFYRLGTGYQTPRYAQLTVSVDF

SEQ ID NO: 15819 - protein, 1061 aa, Gamma proteobacterium HTCC2207
MKNIRRIVLVMACLLCIPGIHAQDFTVTGKVIDNTGLEVIGANISIKGSTGVGTITNIDGQYTLKVNNPAKDVLVISYIGMRTQEVAVKGQKQINVTLQEDSKILDEVVVIGYGTSKRSDLTGSVVSVKNEDLMQTPTSDVAQALAGRVAGVQVMQSEGEPGASVSIRVRGGISITQSNEPLYVIDGFPSEDGMNSLDPGEIETIDILKDASSTAIYGARGANGVVVITTKKGAKDASKMNVSFNSYIGIRKVSKKLDVLSSKEYVLLDYERNLALYGESGVRRFQNAYGSFREIDENYGNREGVDWQEEAFGRVTTSQNYRINISGGNKELKYSLSYNYVKDLGAMIKSGMDRHNISFNISHKASSRFQANARLNYDESKTYGMGTSEGNNRFNKMEHILQYRPVNSLSGNDRDLITGDDDLIDDESNPMQSPILSAQEETKIRKIRSMQANGGFTFNFTKRFSFRNSTGMRYQISRQDIFYGEKSVTGKRSSINGNIAYNENGSFQTSNVFTYDYRGKIHKLNVMAGQEWISRWAKYLGAYATNFPNNDIGLNDMNLGTPSEIRSSVNDDDRLLSFFARANYNFREKYLLTATVRTDGSSKFADHNKWGFFPSVSVAWRMSEEEFVKKLNLFSDLKLRIGYGLAGNNRVASYTSLDLLTSTRYPIGESLSPGYATSGIPSADLKWESNKTLNIGIDMGFLEQRIIVSPEFYLNKSSNLLLNSRVPTSSGHKTMMRNIGKTSNIGFDLSVTSVNIQKKNFTWTTNFNISHNRNKIEALSGERYFLEEARFGYDQKTHKIEVGKPIGQFYGYKTSGLYQIEDFDYDAKNQTYTLKEGVPYMSGTFNRNDVRPGMWKFEDRNGDKIIDDSDMTVIGNANPDFYGGLNNQFKYKEWDFSLFFTFSYGGEVLNATKLTNTKTATTNYSVLDIANSSNRWMTVNSEGQPITDPAEMAAINAGKTVACIYDMEAGDKYIHSWAVEDASFLRLSNLSLGYTFDRKKLRKFNVQSLRLYFTGSNLFVWTPYSGFDPEVSTKGNNLTPGVDYGAYPRNRSYVFGLNITF

SEQ ID NO: 15820 - protein, 840 aa, Gamma proteobacterium HTCC2207
MTHSYSTTGNRVGAAARDYGRRGSMAALAAAVLMSVAVAPVAAQTPRGDVPIHIEAQPLADALLQLGRQTSLQLYFPPELVAGKRAPAVNGTMRPEAALDSLLKGSGIQYQRSGNQGFVLRPVSGTSRSTAGAIRYAPRHGPAHHRAGPGGSHRVTDIERSGPPDAAIDVLERTELEELKTGSDSLATVLSKVIPGMADSSHTVTDFGQTLRGRGMLVLLDGIPLNTNRDSARNLANIDPALVERVEVLRGSSAIYGGGPTGGIVSITTRPAGGEPKADTTVTMSTPLSRLRRGRLERQRAAALFGQQRDARLCVRPRRAPYRQSYDAKGHALRRSQARATCSTRTTTTSAASSASFAPDQRIQLASSAILTPSRTRAGRRIRAWPNCRRAACPRRALDGLQLADQNQIRNTLVNLEYEHRDLLGSQLSAQFYYRNYYSRFTPFDARAVPVRGGNVDQAMQDSEVFGSRLTVKTPLGRDKRTRVIWGMDFEQETSDMPIDIFDLKAYDASGGRIFNKIGTLTYMPPITTRSIGALPSCRHKFNEQWSTEGGLRYQYARASFSDFVPLSQSRVTNPATVSGGAVDYSAVLGNIGVAYKPVKDHEFYAAFSQGFNLPDIGLQVGNARAGFDIGSSDLQPVKTNNYELGWRGAFGNTLGSLAIFYTTSDLGDVQSFNNGLILTRTAEKIYGVEASADYLSTDERWGAGGTFTWMQGRETPQGRDSQQMTGYRIPPLKLTGYVQYRPVPQWNNRLQATFFAGYDYRLNGVTSFGRRDVSSYTTLDLISSYQVTKKDTVTVGIQNLLNRYYYPLYSQLLRNSNNTSHLRRPASRSPPPTAPLVTA

SEQ ID NO: 15821 - protein, 1208 aa, Gamma proteobacterium HTCC2207
MKKLVTLLALVSCAAWSQTSRATLGGRVTDPQGAAVPNADVIVISDETNVRQSTKTNDQGNWTVQFLVPAKYNFTVTAAGFKSVERKGIVLQTSDNKQIDTVLEIGSTTTELTVTAEVPLIDTTAATSGTVIGQEQILEMPSFSRVTTLLATLSPGVMQQDQNNNTAHLWSHDAASQVTVDGGRNNTRSNTFELNGMPNLKTGGQAGFMPAPDAVQEFRVVMNAYDSSIGRQAGGTIQMTTKSGTNTVHGSLYEFNQNNKLNANTFQANLAGQAKAPIHYNEYGGTIGGPVWLPKVYNGKQKTFFFFSYDGIRNQDPRSGTRSVFNTDERAGDFSQSYTTSVTNGVRTRFPIQVYDPNSVDAKGNRTLFPGMKIPTQQLSKVAQGILKYVPLPNTASDGTSNDANNFTPSSSRQNKMADITSRGDQVWNNSHKTFANLTWYHEDELSGDDFHNASTGAYQHRMAKGVGVDHVWTLGPTKILDLRANLSRYEEPNNDHGAGFDASSLGFPASFTAQMALSSFPQINGQFGGIGTGQAGSVTNTSYYTYAATLTHVQGNMTWKYGAEFWVLQDARKGIGNQGTYTFDNSNWTRQNALTSGGTGVGSSSAAFLLGLPNGGAFPRNADSMWTQHFHAFYVQNDWRVTSRLTLNLGLRWDYETPVVERFNRSTTNFDPTVVNPMSSAAQAAYAKILASNPNNVGVQILAQQLPASSFKLMGAQLFAGVNGQSRGTYDGDWTEFQPRVGAAYKLGPNTVIRGGFGRFSQASFDVGGQNGFSRTTSFNQTNDNYFTPSDTLDNPFRGGILAPTGSSLGALTNLGQGVTWNVQDVPRFQSWEYSLHLQQQFKGWLFEAGYTHNKTYNISQGYNMNLPSAALWKQYLGPQSVFDSTGRPLDTLLWNTLVPNPFQGLPNVTGNIATASTVTMNQLLNPVTILGGMTQNLNPAGKNQFDALVAKVEHRFSKGFAVINSFTWSKLFEDTSLNGQEILGRNIEHKLGGEDRPFHLSIAPIWQMPIGRGHAVWGTMPKVMDAVLGGWQLSGQFNIQSGVPVVFSTNSFFSGKNIALPSDQQSLLKWFDTSQFQFFPNKTSDITTFPAWTGVMNLPGANYKPAAGDTIKNGVYQDFATDNRTFPTRWGSVRASRTNNLDMGIFKNFKIHESLKLQYRFESFNTFNHARFAAPNTDPTSSSFGVVSPSQQNAPRTIQMALKLSF

SEQ ID NO: 15822 - protein, 1102 aa, Gamma proteobacterium HTCC2207
MLFISLGLGMAQAQVTTSSIQGQINDADGETLPGANIVATHEPSGTRYGAVSNLDGRFTIPNMRIGGPYTVTVSFIGYETSTFSGIILRLGEPYVVNVVLGDDATELGEVLVTGSRTGELESDKTGTSTSISTKQLTELPQINRSVTEFTRLTPQANGTSFAGRDARYNNIQIDGANFNNGFGLSSNPLPGGNSQPISLDAIEQISVNIAPFDVTQSGFTGAGINAVTRSGTNTMSGSAYFFGKNQSLQGRKIGENELEKVDAATKNFGFRLGGPIIKNKLFFFVNGEREVNTGANASGANLWKASTDGVSNPENNISRTTVSDLESVRDHLINQWGYDPGRYQGYANEAEQASTKFLARIDWNINDKHKLAVRYNQVVGTSPQTTNATSGPRPRTPFPAGARVGPNSIAFENSAYGFENSVKSITAELNSYFSPKVSNQFLFTYSKIQDTRTTPGDQLFPMVDIWDGGIGNGDMNYMTFGTELFSYNNDVVNDNFSFINNLTYIEGRHTITGGAAFEIQKFGNSYVRMGTSYYRYASVEDFLTTGTANEVAPIMFGLTYPYEGQETYARVNFGLASLYAQDKFSVNDQLSLTLGLRAELPIYLNDLTPNPSINDITLLDTEYNPKNYDSGSWPDSKLMLSPRFGFNYDVNGDRSLILRGGTGVFSGRVPFVWLTNMPTGAGVLQNNVEPGSYGQVEGWIGNVTFQPERYYYVENPPEGAEDVFIKTPEQGAPSSFALVDTDFKMPMVWRSSLGADYKLGNSPFMLTADLLYTRDINGVFQFGANRAISPDRMNSAGDDRELVLDTDDITYNPVMGANNATILSNTDVKGHAFSATLGISVPEYNGFSGSVFYTYSAAKEVSANSGSNASSAWGASPNINSPNDQMLHISDFAVPNRVVANFSYRVEYANHFATTVGVYYSGANQGRYSYTYGNDLNGDGVNADLLFIPENTSDFNFVDIVSNGNVVYTAAEQAAAFDQYVEDNDLEEFRGDYVPRNALVMPYLSRFDVRILQDIFTNIGDTRNTLQLSLDIVNFGNLLNKDWGIQQRLNGSQNLLSRSGDVSVNPNYVMGQVSGNLASSPYQNVSNFSTTWSMQFGLRYLF

SEQ ID NO: 15823 - protein, 750 aa, Gamma proteobacterium HTCC2207
MKFILIVLLQFLYLFAHAQSGVIKGKVEQVHNHIPILNSYVQLTNRSNQIAYTDVEGRFEFTALPAGTYYIRIYSLGYESLTDTIYLNPSETLYTSYALNETTVEIPEIPIAARREVAFTTISSIDFKLRPVNTTQDLLRLVPGLFIAQHAGGGKAEQLFLRGFDVDHGTDVAVSVDNMPVNMVSHAHGQGYADLHFVIPETVDNIQFNKGCYQTGTGDFNTAGAVRLQTKNFIPENKIKLEAGRFNTSRGMILLNLLPAKDTIERKHSAYMASEAFYSKGFFESPQHFNRFNVFGKYHGILSRNTFLTASISTFTSRWDASGQIPQRAIDNGSIGWFGAIDDSEGGKTTRSNANVQLTTDAGNLGTWTNQVFWSKYTFTLFSNFTFYKDDTTHGDEIHQYENRNMFGYNTSLKRNYTLAGKTIQTNIGAGYRGDYITNIGLAHVEKRRFLYDTKKGSVRENNMNGFIDASLLLSTRFTFNVGIRYDYFLFSYKSSIDDTSSASRGQGILSPKATIYYKLTNAVQLYLSGGYGFHSNDARVSVYKTNQSSLPRAKSADLGTNLKIGAKLFVNTALWYMYLESEYVYVGDDGLLEPSGSTRRMGIDVSMRYQVLKWLYADIDLNLAKPRYIELPEGENYVPLAPPVTSTGGLSVKQRNWSAGLRYRYLGKRAAVEDNTIIASGYFITDAVVNYQWKQMQFGISAENIFDQKWREAQFATESQLKNETTPVTEIHFTPGTPFYLKGNVSVLF

SEQ ID NO: 15824 - protein, 698 aa, Gamma proteobacterium HTCC2207
MNRSKFIAICLSACVANSLYAVEKENNETKLDGVVVSASGFSQQIKEAPASISVISGDELTKDSFTSLHSIAQKVPGVNVVGGEDGPASGISIRGMEKSQTLVLIDGKRVNSSSANPKGGAGDMNSNFIPPAEAIERIEVIRGPMSSLYGSDAVGGVINIITKKDFSKFSGNVGISTTINTHKGIGDGRQGDFYLNLPLYKDLFALQLWGYKKLRDEDNYKGGYQKSDKRNLSAKLWITPDEHNKFFILGSNERHDYSRTVGKTATIKTNKVLNAYDYEKKSYGVGYLGEFDSLNADISYIYDETQRTSLFDSLIPAKAKNHNFNSKFTTFFGAHTLTFGYDFSKQNVGTTFIVSNASRNGLKDPKTYSMSEHAGFIEDEWQILDEKLFLTLGSRLTHNEFFGNHLSPRAYLVYNATDTLSLKGGVATGYKTPNVNQISPEVGTIQGGWRIVDFGNKDLKPEKSTTYEVGAYYDNQADFRGSVTLFRNEFKDKILDTDGSNVNKIPAFGTCTNAPHVTCPGWGTYFNIEGATVWGVELSGDYDILSNLNLSSNYTYNKSKIKTGNPTINTPRGPMKFSETDLARLDGKSLTATPEHTLHATLTYKPVKSVKTFFGANYESKLTSVNFGAGNRVRENTKDLLTFDTGVSWDANKHLTLSLNAYNIFDKVRYDETLADDGNYYWYPQEGRRFWFKVAAKW

SEQ ID NO: 15825 - protein, 748 aa, Gamma proteobacterium HTCC2207
MHAKPRASLLHFIVTGGTMSYFRFSVLTTSLMLAAGAAYSETTTSNSDAHTLGNIDVTASSVDEHDASMTTESTERYGTTATDTATRMVLSPRETPQSVSVITRQQMDDFNLDSVAEVMQRTPGVTVKTQDTERQQLFARGFEITNFLYDGMPSTRIDTLGKQAALSDTFIYDRIEVLRGASGLLNGIGNPSATVNLVRKKPTRDFTGQVGAELNSWDGYRGEFDASGSLSKNGRVRGRFVSAYEQGESFLDHYENEKQVFYGVIEADLFDNTLLTVGMDYMDYDPMGSTWGGIPLFYSDGGLADLDRDLNPATDWSSWAQDSQTVFVNLEHQFENGWYSKFAYTNQQNNYDAQLASAGGGQLNRDGSGKTLWSGRFVEDKTQDTFDLYANGPFALFGRQHELVVGASYSDAERDYTGQSPVNFNNVIPDLLSWDGDIPKPVWAAPNTVEEQHTKQTSLYATARFKPTDRLAVIAGGQVVDWETDTQGVNWQGPLDEQYQENGEVVPYLGLVYDLTDHHSVYASYTSIFQPQTVRDTNNQILDPEEGNSYEAGLKSEFNEGRLNTTVAVFRINQDNLAESTGQPIPGGPPNSVAYQAVDGAETNGFELEAAGEILPDWQVQAGYTYRITEDPDGDELNTTSPEDMIRLSTQYRFRGDLNGLTIGTAVSWQNKTYAFVTRPGASADYKFVQESYTLVDLMARYQVTPALSVGANVSNLTDEKYYNNLGFYNGGYYGDARKYSLKMDYRF

SEQ ID NO: 15826 - protein, 394 aa, Gamma proteobacterium HTCC2207
MKSAFSLATLSALALSASSALAAESLTDALKGGKFAGELKAYYFTQEKKKNSEDILAAGVMMNYVTDSFYGFKAGGTFQSSATPFADEASKQMFKNDMWAQGAQLSESYLSYTYDQTTLKGGRMFISTPLVAGSGSRLIRESFEGYSITNQNIPDTTLGLLYINKFQARTDKEGHIGKFNKYQDGAYSLYAINKSIPGLTLTAAWARIEKEGSASDLDIFYGEAVYKGKIADFGYDLSGQYWKNRYNSGDESSSSPSLYGLKAGASYSDFSAYAAYSKVSDYELTASGRNEQLVHGVGNGTDTIYTYSLIRSYSYYPNMEAWAFNLDYAFTPSLKAGFLYVDVDDDKTEVSYTGGYISYAFSGSLKGLTLSAQYDNEGKDGDGDSFRFRTIYKF

SEQ ID NO: 15827 - protein, 226 aa, Gamma proteobacterium HTCC2207
MFKKALVLAVLCGSSFAAQAVTVDLRHEYIDSGINADRVAVSHRFDNGFGFSVEAKWKTGGDDQSRPFNEVVGNGHEDQISWRWKATDAIAITPAFTIESVDSKTIYKPNIHVQYSFENGFYVAARYRYEYTRVPEGKDDDDKVNRGDAWVGFALGDWRTELNYVYAQSEEGFTRNNGKNSSNEYNAKVAYKIDKNWAPYFEVGNIGVKESDERQTRLRVGVAYSF

SEQ ID NO: 15828 - protein, 553 aa, Gamma proteobacterium HTCC2207
MDDIVNSVPSWMFTAIIAVCILFIIGIIFARLYRRASAEQAFVRTGLGGQKVVMSGGAIVMPIFHEIIPINMNTLKLEVSRSTIDSLITKDRMRVDVVVAFFVRVKPSVEGIATAAQTLGQRTLSPEDLRMLVEDKFVDALRATAAQMTMHELQDTRENFVQGVQNTVAEDLSKNGLELESVSLTNFNQTSKEHFNPNNAFDAEGLTKLTQETERRRRERNEVEQDVEVAVREKNRDALSRKLEIEQQEAFMTLEQEQQVKTRTAEQNARIAAFEAERRREAEQTRILAERQIQETEIDREQAVRSRKVEAEREVRIKEIEQQQVTEIANQTKSIAIAAKSEQQSQAEARANLALAEAVSAQQNVETTRQTAEADRAKQVALIAAAQDAETKAVELTVRAKAEKEAAEMQAAAIVELAEATRKKGLAEAEAQRALNDAINVLSDEQTSLKFKLALLQALPAVIEKSVEPMKSIDGIKIIQVDGLNRGGAAGDANTGNVGGGNLAEQALSAALSYRTQAPLIDSLLNEIGVSGGSLAALTSPLTSTTPVEEKAE

SEQ ID NO: 15829 - protein, 1503 aa, Gamma proteobacterium HTCC2207
MNKLTEQNLLKKSRFLKYSMLASISVGAVMAMPIEGMAMSKEAFRTELSRRLSLNKDTTSTSPQIGTVIVPEPEVNTYTASEIREMAISKQSKTFNPLKDIPIDDHYRVVARSKSDVGKARKARPISRRKTLGDAEKVVQNQDDYTHALTEQTPKKPEMMITASSPTVSPASNDFVTAPNTPNTSLASPEHYTTALSTPSSTPTTPQPTSDSLASPEHYTTELSTPSSTPTTPQPTSDSKPNDNLESTPPNTNSKAVRRLSFSSSESQQTVQPSKSTVSPIPTAHPLPITKSSTEIAAGMVSNILRVNEILGIKLAEVQSTIKNTKGKKNKKPLQRLQKQIFLSQKKTKALKLEAAAIGIKIKELDEENKSLASWNKKKGGVKDKYELDKDSAKIKENNKKIDDLQQKLTNKNDEANSLSREVGGVVLTKLQGKATVTEMPLAGPFLNQQQQLELLTQQQKVNAARQAVVDKRRAEANEVKRNSAEYKDPVSEREEVQLERNQRHIAVEKTKKQQQVVDKQRTEREKKRKEENYQKEKARDIVEIREDIAKKMQQISNANTTSNRLQELELTVGAIEDKNQKKEAQKQLSKIKKQEKAIKAAADEAQKILNDAKKAASRTKLKKLQEQIGNHVAMVTNDKIEESIKKLEGLVLTSSTTSSTATISKQLLTAKSTMQLSHELQRTLPEDGYGYLMPIKVQQQIQANRSNEGSNPNSTTYLDLYPEEEGLKSIDLALGILPTSASVIPQYVEELNNLASFHSLNQIQQEKSLIVTNLLLSEASALSDDEFRAVANEVHPKIRPILTYNRRKEKEAKLVEAETAHNQVIQKAIKTPNSTKAKEAVENAARLFGQHNNSFKLMQDIRDEHRRKYYKTPKKVTDSINSLDLVVLEESQQLKEPRSNSLEALDLAGSVSSPDYKAKELELDTLNHDDPKFKKLMLEVFEMSKEKILLEGEIKHLDTESNKGSVYTYIKVLNNKIQTMEELLGSSSRSEELTHIKEAMAYISNSIQDVEELDERMLLAINARLQEHDKKISSLLLEKYTSEEAEDIFAQSLLQEMLVSDCESESTLPAGHEEKEDTEVTESGIQKAGDKELLALHVSSNECALALDDDREKESLELGGGSEDEERYDSGFEEEEEIIEQLSDSDGGNIKITEVDMAIPLEQKAKQEMQTQISENAPTLNQAKVVNTIVNNMIRNRLDTSMNIANNIVAVGAGDEEESRITRGLWMRGMYGTNNHGRVENMNGYRGTNKGATIGFDVEIDNNILGIAYSNVHSVFKFKNSKDNDKELIDSHVISIYGQKELPRNFALQALVSASKNFIKDKTTYSYGDTKIGSNVRHRNHSYNAEALLNYNYLLQNKCVITPNIGLRYGKSRDGVYNETGINVQEIALTMKENNILSGIVGTKVKVPLKDVLKFNNLGITFQGAVEHTFKEKTQRINRVVKIFDHKFKQDYLIPKQPKTSYNLGTGIIGSIKNTTISLDYNYYLNKHYRSHQGSVKLKVNL

SEQ ID NO: 15830 - protein, 2176 aa, Gamma proteobacterium HTCC2207
MTVLAGGFGLCGIPENLIEEIRRRGVRGLTVVSNNCGIDGFGLGRLLETHQIRKVVGSYVGENALFEQQALSGELEVDLTPQGTLAEKIRAGGAGIPAFFTATGYGTPIAEGKEVREFNGRPYIMETAITGDFAIVKGWKADHFGNVIYRHTAQNFNPLMATAGRITRVAQELRDGYYVNLGIGIPTLVANYVPAGMDVMLQSENGLLGMGEFPTEQQLDADMINAGKQTVTARLGASIFDSAQSFAMIRGGHVDLTVLGAFEVDVEGNIASWMIPGKMVKGMGGAMDLVAGAENIIVVMTHAAKGGESKLLPRCTLPLTGANCIRKLEGLIADDAVIASNTSGLPPDELAARMTHPQRLLIAHFWHPPHLIPLVEIVPGSATEPRHLAAVQALLGEMALEAVLLERAAPGFVGNRLQFAVLREALHIVHSGIASAEVVDQVMRASLGRRYAMVGPLEAADMTGLSTVADIARHLFPELATGDEMMALVEQRLQRGDIGQRSGRGFYLWDEARRERIQRRRAHQLRFALKPCLMSVLIALAALGLLMLAAYRGYSVILFAPIAALGAVLLTDPGAVAPTFTGLFMEKMVGFVKLYFPVFLLGAVFGKLIELSGFSRSIVAAAIRILGRRHAIPVIVLVCALLTYGGVSLFVVAFAVYPFAAELFRQSGIPKRLIPATVALGAFSFTMDALPGTPQIQNIIPTSFFGTNAWAAPWLGLIGSLFIIAVGLLYLERQRRKAQLKGEGYGTDLLNEPETPDDINLPNPLIAILPLILVGVFNLAFTHWIPQWYGASHELTLPGLAKPITTDVAKITAIWAVEAALVSGILLVVAFGFRNIRGRLAEGSKTAVGGAILAAMNTASEYGFGAVIAALPGFLVLSQALSAIPNPLLNEAISVTLLAGITGSASGGMSIALAAMADNFVAAAHAAHIPLEVLHRVASMASGGMDTLPHNGAVITLLAITGLSHRQAYGGIFAITLIKSAAVLSDTMSVQGKTALVTGSTSGIGLGIASVLAAAGVRVILNGFGDVEAAKAQVARLGAAPGYHGADLGDAAQIADMMHYAEREFGGADILVNNAGIQHVAPLDQFPVEKWNAILAINLSAVFHTCRLALPGMRERNWGRIINVASVHGLVASKDKSAYVAAKHGVVGLTKTLALETARTPVTCNAICPGWVLTPLVQQQIDKRIAAGTDPQRARDELLAEKQPSQAFVTPEQLGELALFLCSDAAAQAEITILDKNPQSNVLLAPLSLKVGGSIRPEWIFNNGPEPGYDKNGHDGGTRFRFSGDYALTQDTSIIGYYEWGVDLAHALSWDGHYNEDGKRDYQRQLYAGFKDDRYGTLTYGHQYGIYYSVVGIKSDVWDNDGHAGGTGIGISGDYDGGNKPKNSIKYTNDFGPVTLYANYLLPEDDLHTADNLIYRRKGGGGLGFDYKVTKDFTFSAAYSYTDAKIKDNLYNEKDYHQQLSGTALTWQPNNWYIVGTASYYKDYVPSTRQRTLSHFFAGDGYGLEGFVGYTFNIDKPFLKSVQPYVAADSLRLKGDEAYHANHVYLGAGTTIGYGLSVYVERTLANSSDNEPDSTWITAGAGAGRSHADRTARRLPGGVAFRQMQILDRRGHQLIQQHRRQAPFGALFVVERFEGGGLQQQFAQQRRDRQRAATLRQAGDDVLIDEQAVSLGRAGALGVVQHVARHPQRALRRHQPQAVFHFAADHAAYGIDQLRLLMTMRLDFPVLRDGGTLHGEQRARHLIDIDIAAWDLDFHENNSQFGGIEKYYVLIAQCGLAPVPIKKLIMSLDTADFPLVWMRRNGRDTQAELAEFSALLARAEPFVLMTDRSVGDEGEEHDRDARTQVALWKRDNRAALKRWAKGMIMLEPDDAKRAAAEAFAEYGAKFWGYPVIEQLLAWIEQSLDQPLTLDDIAAKSGYSKWHLQRMFKQHTGHILGTYARRRRLTAAARELRLTGTSVACIADTYQFDSQQTFTRCFRKQFGLPPASYRRSQDWSSYGLQPPLRLTEAPLPQADIVTLPAMQLVGNTQRRSFTLGQLAASKCELRRHAWRQLLRPQTLPEVMYGLTSLEIDRQRRGCPRMAYTAALPDEGAVGERVTIEQGEYARFTYQGQAEGLQNFIVRLYDTAMPQMNAIRRPGQDIERFYPAQEGSCPLGGAAIRCEYLIPIRRAEALAAAS

SEQ ID NO: 15831 - protein, 778 aa, Gamma proteobacterium HTCC2207
MTFKARLSACAALLALAPASTAFAQTEVNEQVTDVITVTTQFREQSLADVPINVSAFNEELIERLDIRNMEDMALFTPGLVIQEQSPNNTGYSLRGITTDSGVSTAEARVAMFQDGLSISRSRGSYVELFDIERLEVAKGPQPTLFGRGALIGGINIIQNKAAFENSASVFAGLGNYDAYEVGGHVNYAIADAYGLRVAAVNRVRDGYIPNLGDGDDLQGRDVLAGRVVFSGEPTSSFSFDLIGNWQQDSGPGSSFKSGVIAPQGGSTNPYSAADLRVIDGFESNQGLGLDRTVWGITALTSWDINPSWNLSTVTGYREYDSVEIFDPLGIGFEALNFGEDATGRQTSHEMRLSFDNGGRFTAFGGVTYFYEANTQRIPAIYNEAVTQALFVRLGQFGNVNTLAGLLGVPASALTDLANPFPYSIAALSQGIGLVPLRPNYTEESANAGSTEALDFFADASFDVTDRLTVTAGLRYTDESKNASGYGGTSMGPNRVTFGPALILTSSPNGAEISSSADFDDWTYRVNAAYEVSDRMNAWVSYARGRSPDLISIDSNSPTLFSTSPAEIVDSLEVGAFFTLDRGTLTASIYESKYDNFRTSVFDPLTSTFVPQNSGSATQRGLELQGDFRITDTLDLMATYSYNLAKFDKTSNGVAQELGGNRFRYAPEYSFSLGARWEALTRPWGTVTILPSFSWQSHVFTDNDNDRFVGVRQDSYGLLRARVRYDDPSERYFAEIYGNNIADQEYLIDAGNTGAGFGLPTFIAGAPRTYGFRIGASF

SEQ ID NO: 15832 - protein, 698 aa, Gamma proteobacterium HTCC2207
MSNKTIAFALVVASSAPVIAADNDNIMVVTASGYEQKIREAAASISVISQNELRQRNYNDLAQALSDVEGVDVNSSTGKTGGLDISIRGMPSAYTLILVDGIRQNGTSDVTPNGFGAMNTSFMPPLSAIERIEVIRGPMSTLYGSDAIGGVVNIITKKITKAWASSATLEHTFQENTAFGDSSKFSFYSSGPAVEDQLGLSLRGTIFRRDASRVESSNTGVELSRRGPNPVKADNYNLGGKLFWQLNTQSTLWLDGDIANQKYDNSANQLGTIGARGGYEDTLRYQRRKITLGNDNRLDFGTWNSSLSYNQTENIGRLITNASVPQGSGLAGEKRLLKNTNIILDSKLVAPLGDNHMVTLGGQYWNAIMKDGIVLANNGDEFAQDAWSLFSEDEWRLLDSLALTYGARYEYQTTFGGHISPRAYLVWDAQDNWTVKGGVSTGYKTPTLAQLHNGISGVTGQGTITTIGNPKLEPESSVNTEVGVYYENETGFGANVTLFHNRFRNKINSVSIDNTTSTYTNVGKAITQGIEVASTIPLWSDDWMLGINYTFTDSEQKDGNNKGARLTNTPKNMVNARLNWNINEQLSTWLKAEYRSKTARFTQNYANLSAANKVVYNNLGSEFKPFSVLNLGVAYKVTKDVTLNGAVNNLLDKDFTRTHIFAVGNGTTTAGDYFTSSQSTAGYVVPGRNYWVSVNVNF

SEQ ID NO: 15833 - protein, 784 aa, Gamma proteobacterium HTCC2207
MKYPLSYKNIARSIPFLSFIAFPLYAQETTELEQITVQESATAEVNKTSPTVISKSATTIQNEMVRDTRDLVRYTTDVGISDNGRFLKGFAMRGVEDNRVGISIDGVSLPDSEENSLYARYGNFNNSRLSIDPELIQTIDIVRGSDSFNAGSGSLGGGVNYNTLDPQHIVKAGNSVGALLRGSYASKNREWVRTLGIGYVGEKFDALLMYSQRTGHEFKSRGSGPEFRYSSSQHPDPVTQRFHNYLAKMNYQINDNQRIGLTLNGQTGGRYIDERSYTLMGSQWREADDQNERLNANLYYIYAPSTGWLAYSKFDLDYQKTDLAAVNYKGGRHFTTDAKELNEIYDRRMKTVFTRGSVELNAQPVHFYGEHTLTIKGYVSQRDFKNINQDRIGIGTNYDTQYHYTIQYPIRTKQYGLSLKDHVRWNDTFSSHLGLRYDHTKLKPKELNAPCSKACLEEGKPKPTRFSTVSTFAGLEAQLSPSWMLGYNISTGYRVPTASEMFFSFTNAYGTWKSNPSLKPEKSINHTLSLKGNSEKGLLDLTLYQTNYRHFLFEQESLIQRTEMRYGRPYTYQSQEQQMVNLDKAKIYGVELKTHVNLDQMIAVIPQGFKFYAALGYSKGKLSNNASLLSIQPLKIILGLDYEATNGKWAIFNRLTYLGEKRASDAKVYEIKRRCTEFVTETDPWTGQQITRCKKRELYPDLSTYKHLNKSAFVFDTFGYYKITDDITFRAGIYNLFNKKYHTWDALRGINANSTLNSVDREGKGLQRFYAPGRNYAASLEIRF

SEQ ID NO: 15834 - protein, 627 aa, Gamma proteobacterium HTCC2207
MPTASPINTAKSRAGSTFRRLSSLLPGLFFFLGLLALTLPFTAHAETDSDRELLELYYEPQDLTVSTATRSPRPLSRSAENITVITAEQIEAMNAHTLADVLATVPGVQVSGNTAPASITFTEFAGATTRYIQILVDGVPIDDQFDNFAAPGMVPVQIIERVEVLKGPASSSWGNSLGGIVNVITKEPALHASFSGAASFSGGENGTRDGRGEVSGTVGSFGYYLSGGNVKSNGFHSFNATENNNAYAKLRWNLADRGSLRLTFNSMETAPQIGLITFADYSDRLKIRFLQSTISLDYNLTDRLTFNTFFKGSRFDYTRIDDTLSTGERFSTITSDEITSGGAAILTWRQGVHTLTGGVEFDHGQTKTSFDYPLFLFNQTIDASNDKWGFFLNDTITWERFSITPAVRYDLTSHSGDFFSPSLGATFSVTDKTLLRAYAARGYNLPILNPAYSTKDNGWTVQAGLETTDIPFLWLKGTWFRNQFKERGDTVTRTLREGFEIEARTAPIYNSWLTAGYVFTDAKNLQTDEKLPAVARHTWDLGLHYDDRTFRGALTGAYRWWNTPDYFGAEYNNFIWDLNLGWRFFRSDNTEAELFATGHNLFNGAQYHDEIFKNPGRWFEGGLRIKW

SEQ ID NO: 15835 - protein, 461 aa, Gamma proteobacterium HTCC2207
MFRKSFAGAAIALSVCCTSTAMATNGMNLEGYGAKSHAMGGAGMAFDTGNSAVMNNPATLGYMKDGVSEIGIGIRGLHPNVDLNYSGMTDESGATGFYMPSLSYMQKDGNITWGAAVLSQGGMGTDYGNDSPLYQGGYSDASDANDPILLSGKDIRSEVGVGRVMFPIAYNLTENTTIGVSADFVWASMDLQMDMDGMHFGMMETGGSMLPTVTEGTLNYVRYDFSNGTPFIGSAVGYGTGFKLGFTHKLSKLLTIGGTYHSQTMMSDLESSNAKLTVVNTVDNTARTQEVSGKIKVNDFEWPATFAAGVALHPTNRLMIAGDIKYVDWSSVMDKFSTTFVADNTTANGAYAGKTLDMSMKQDWRDQTVYSIGVEYKATKRLALRGGASLSTNPVPDAYLNPMFPAITKDHYTCGFGYRVTDDTKVGAAFSYAPKVTETNGEGMVISHSQANWSFNLVHNL

SEQ ID NO: 15836 - protein, 778 aa, Gamma proteobacterium HTCC2207
MALATISALTCLSERAHAQNRLEEIVVTASRRDSTIQDTPYNISALSGDQITRSGVNDFGDLLRLVPGAAFLDQGARVGGNNPNIILRGINANAMIGSFDFPNVAVAPVSVYLNETPVFFPIMLKDLERVEVLRGPQGTLYGSGSVGGTLKLLTRRPETDQFTAEIRGGAYGTSSSDEGSYEASTTINAPLGDNLALRVNLATESVGGFIDAANRYRLDDSGAAVPADPSDPVNSLPVVDTVEDISDTSTDSARFALRYQPTDKIDAVISYIYQRDESDGRQIQNPFVGSRKDYVEYHATPEPYSRDVDLVSLEVDVDFGFATMTSATSYYENESDQSVDYSDFWVATTEAYYYSAFPRVISPERSITNDTGFIQELRIRSNSDGKFDWLIGGFYSDIESDVLSLYTLPGAAAWNELPRAAGDPPPYAFANNVDLNTLFDRSLTIQDIAIFGELTYHITDNWQVTVGARAFETDFEQDLVEALPHCGYYCASDGVDPNGSIFLNVNESESDQVFKANTSYNFSDNLMIYGTVVEGYRRGGANIALLNHPFFPDPPELLTFKPDLADNYEVGVKGIVNEAIQYTVAAFYIDWQDPQIDSFTPFGNPAVVNAEGARTQGLEVEMSGRLSDSLRFNLGYSYTSAELTEDFDAPDGSQGKSGDALPGVPEHTASVALDYVHSLASDSLSDVSFHLNGYYRSATDSSFEGIRFFPIDAFSIWNASATFNSKDQRWALTAFVDNISNELGITGGIPETRNGPIGQFYFVTRPRSFGLRATYRFE

SEQ ID NO: 15837 - protein, 926 aa, Gamma proteobacterium HTCC2207
MTYKDISYAVLLAATTAAGVHAPAFAQAPTVTFDIPAGDLTASLNTFARQAGVQIFFPSAELAGRKAPAIKGAMPAQAALSRLLAAGELEIAADDGHTISLRPARRDAAVALDEILVTAQKREQKTIDVPFALTAYSGKALERLGVTNFRELSTHVPGLMVEDQSPNNPIFVMRGITSSGGDSFTEPRVSVFQDGVSISKSRGSYIELYDNARVEVAKGPQSTLFGRGALIGALNVIQNKAGPAPDWSVAAEGGNLGYHQLDAMLNLPVSDTVSLRVAGRRKSRDGYEKNLDPAADGDLNAIDTNAYRVALSFKPNDRFSADLIYNHQDDETNGTGFKSMYVSPTDPATGKVLAGTRVDDPVWLSKPADFALGHHLGVDQYQNGVMALVKYKVSDALTLNATTSYRDIDAVEVYDADGTSLPLFTNMEDVGGTQVSQELRLNYDKGGRFSWFAGANYYRERSKARVDVRFDERMLLAQAAGMLSGGPFTGLPKTTPAPASLFESTAFTGALLQGLVTQSSKGNLVLTSAEAGALAARLDPHHVETSRNESDLDAYDLFGDMTFHLTDRFELSGGLRYSRDEKTTIWGSSVQGRSILGGAIGAAGIAATGAPAGVATARALIQGMTFYGPTLNGPVPLFGVSAQPTAHNGDFASRDLTDDGVTWRLTGRYALSPTANLYASYSRGRRPGVLSAGAPGAPDGTPTFAIAPAETAQAYETGIKADLLDRRLRIDGSLYYYDYDNFQTREQRGSTFVTTNAGTARAYGFESQADFAATPNLDLFGTYAYNHARFTRGAYEGNHFARSPDHMVSLGASMRWTGLGGRFDFRPTYTWRSKIFFADDNDRPELQAGLLVPDAGQDEFQNGFGLLNARISYAPERGSWEVEAFGSNLTDEIYRKGAGSAGKSIGLPTNVLGEPRVYGLRLTIHR

SEQ ID NO: 15838 - protein, 719 aa, Gamma proteobacterium HTCC2207
MNKVITQMYTKTLLSASILLALSPAALAEEVSRFDEVVVSATRTEQSKKDVSSSIESISSSEIAEVMADNIQQALNSTPGVEAEGNGRFGIAGFNIRGMDGSRVKMMVDGVQQPVPYNPGATEQRKYPNAIEIDTLQAIEVNKGASSTLYGSDALGGVVLLRTKNPEDVLVTEGNEQRFGIKSGYTSANEQFKTTLTWAMRQDKLETLLMATYANGSETQTHGSGSEIEGPDRGAQNPADSKLGNLLAKAFYQANDNHRLGLTAEYYNKRYDEDELNYNGYSIMPGFTYTDNYNQDTNERLRVGIEHQWLMNTLLADSLDWSLNFQDSSALAKNYDTTPSNGRRLRERESSDQSIQFDGQLSKAVDLNGNLHEFTYGASYINNDFDLDNTDYKLDAGTSTPGSSGIPDATIVQWGLFLQDQAYFIQDRLILTAGLRYDSFEATPSVDAGYTQSYEANKDSAFTARLGSVFHVNPNLAVFGQISQGFKAPTVYDLYYFYNQGAIIDANPDLKAEKSLSYELGLRGQNDSTNFEITTFYNEYTDFITQSKTGKQGGKDIFTKENLDEVTIYGAEFSSRIDLDKAFNAPQGTYTRLAIAYAEGEDKKTGDALDSVAPLTSNVGLGLDRDQYGALLNVKMVASKTDWQSNTNADAAGYTLIDLTAYYKPMQGLTIRAGLFNALDKKYWLYSDLTGRDATGETFNIDSKSQPGRNWGLNVDYQF

SEQ ID NO: 15839 - protein, 982 aa, Gamma proteobacterium HTCC2207
MKNTSFKKTQLATSMALLMGSTLALPTYAQDAETATPAEGEVEVIQVSGIRGSMIRSMDLKRSSSGVVDAISAEELGKFPDTNLAEALQRITGVTISRSNGEGSQITVRGFGPEFNLVTLNGRQMPGTGFTRSFDLANLSSEGVNTLELQKTARAENPSGGLGATVNIITMKPLAQSGQNATISVKGIYDTSNEAGDDVTPEIAGVYTNTFADDMFGFGVSFSHQERDFQQQSANIQGWVLQENDDLPQNIDPSNVVDNRTNITNAAFFPKDMNYSINDVQRERQNGQVTFQFRPVDEFTATIDYTASRATTGTNSVGWGIWNNFGANINAYELDENGTAVYADISGDDGSFTASRNTTRVDARSLGVNLDWMVNDDWHLRLDYHDSYNKTDNGYDEGLGSSGQIILGSNQLDSKVYDYREGEIPQVFVNWNNGTNEIMPSEIDSNFSQFIYSPGRSDIEQLQLDGTWYNSTWDIPLVKIDFGVARTEQSLTGFTAWSGLRGGPGFSPSFTEIFPDSMFVRNDTSGFLDAFDGGGASMNPGYYYTFDFDEAIARQLQFITADVVGESNAYSIDPYFSGDPSVSNVEETTDSIYVQTEWDFEVSDYYVQVNAGLRYEETEVPSTAEVRVPIQVNWVAAGEWITVFQEGVEEQDFTGKYDVLLPMFDVKVDVTDDIVARFSWGKSITRAPIGFLQGGRSFSGSPKIGSRVVSEGSTDLKPYESTNLDLSFEWYYDEASYASVGLFRKSVKNYIDTQGRLETFDGLNDIYQGPRWQEAVSALQAEGIQATDSNIYDYFREAGYADADGVVEPNSDDPLIEWNVVKPRNLDDSKTVEGIELAVQHTFGETGFGFGANATLVDGDVEYDPYNLEQQNPLVGISDSANFQVFYEKEGLSVKVTYAWRSDYVVGIGQAQGSADNPATQFDTFGQVDASINYDVNEHLTVFLEGVNINDETERGYGRFEEQFLFARQYGPRYTLGARYSF

SEQ ID NO: 15840 - protein, 416 aa, Photobacterium profundum
MNKKRLFTKTMIAAAITLTSQQALSAGFQLNAQSATGLGRAFAGDAVIADNASVMSRNAAAMSLFDAPAISLGLNVIDTDINIKNAQYSNPRSANSGSLDDQSVGDSTLVPNIYYIHPINDQWAVGAGIYSNFGTKTEFSDDYAANEFGGLTDVKSVNFALSASYRINQQWSVGGGLDIVYGSGKLKRSVKVGPPTAEQKINLLDVDADGVGVGWNVGTVFELDDRNRFGLSYRYSPELETEGDMSFAGSTSGNPDISNDKLKMPLPDMAEFSGFHKLNDKFAVHYSVQWIGWSAFDKLATTGGDTLNTYEWQDGWHYALGGTYYLNNDWTLRTGYMYDTSAQDQKTSISVPDSDRQWFSGGFTYHLDAKSNIDFGLTYLMGKDVDVNEVSPVGTTISATTRANALLYGIQYSRSF

SEQ ID NO: 15841 - protein, 1308 aa, Photobacterium profundum
MNKNIYRVVWSLVRGAWVVAGEWARAGRKSSSPRRQNRQRARRGVAAMVGGSILAQALLPLSALAQGAPTLRPARVAQEEAGQDAAWTRKLAAQAESLARRQAERQPGARVDGDYLKREAQAQVNDVLRDGVNLARESGLPFLRNLQGGLSHDFESGRTSLQLNTIDEVYRAGRNTGLLQLGAHNQNDRPTANAGAVYRREVNDALMVGANGFLDYEFGKQHLRGSVGLEVIAPEFSLYGNVYAPLSDWKGAKRNNRREEKPASGMDVGVGYRPAFAPGLSLSATHFRWNGAEVDYFDNGRTQAGAKGFKVGVEYRPVSLVSVGLEQTKVIGGGRETRMQLGLNINLSEPLSKQLRRDASGTPAFSPDARRHALVERENRIVLNTRRKEIILPLVVSKVSTLQADGRVTVIGATQPFATVTVRMPDGMTGTATADASGRFAYTSAGDQPSGVLALRARNAEGDSSREVTYRYVDEVVLGDLQVAVMALVPLPADRALEVRGKTEPKVDVKVSFSNGESVLAKADAKGLFTVRSTRKVTQGKVLVQATHPQTRKEARAVADYLPPATLAPTIDAVTAQADTGRVTVTGQAEPGAQVDVHFPDGTAKTVDAGADGAYAATSDGDMVSGDIHAQATDKAGNQSPEATRHYGDTTDITPPAAPTIANVATDATSGRVTAAGMAEPGANVTVNFPDGTRKTVVAGGDGAYTATSDRDMVSGDIRVQATDKAGNQSPEATRAYADAVDRTAPEVPTVTHVATDAKSGRITVTGMAEPGANVTVNFPDGTRKTAVAGGDGAYTATSDGDMVSGDIRVQATDKAGNRSPEATRAYADTVDTTPPAVPTITDVTTDATNGRITVTGVAEPGANVTVDFPDGTRKTVVAGGDGAYTATSDRDMASGDVRVQAIDKGGNRSPEATRAYADTVDKTAPAAPTITNVTTDAASGRITVTGMAEPGANVAVNFPDGTRKTVVADGAGAYAADSDGDMVAGDIHVQATDKAGNRSPEGTRAYVDTVDKTPSAAPTIVRVTTDRSSGVVTVAGTADPDNDVTVQFPDGGRKTVKAGKDGSYSVTSDNDIFSGIIQVSARNPAGNASPEVRQDYRDEFVPANAITNIETNSRNGIVTVSGKTSPDATVVVSFPGGDEARTRAKGDGTFSVSSPMDIPRGVVSLSTEVNGVQTVVATRTYEDKFTKGGLDFTAFLPYTPKFNGVSTSDTSAVLLSIPRYFYSGGAPVAKIMPPEADGSEFAKRAAAAMRAQVTPGRDSSEYDVRVSWPAGTFTPADVGQRADLAVKVFDKGTGKYMLLLAPVNFPY

SEQ ID NO: 15842 - protein, 411 aa, Photobacterium profundum
MNKKRLFTKTMIATAITLMSQQALAAGFQLNAQSATGLGRAFAGDAVIADNASSMSRNAASMSLFDAPSLSLGLNVIDSDIDVKNATYNGVPTGGLNSSLDDQSVGDSTLVPNFYYIHPINDQWAVGASIYSNFGTKTEFSSDYSANEYGGLTDVKSINFGLSASYRINQQWSVGAGVDVIYGEGKLQRNDPILESAVLKGKVLDVDADGVGVGFNLGTVFELNDRNRFGLSYRYSPELETEGDITYGGQDLSSQKLLMPLPDMAEFSGFHKLNDKFAVHYSVQWIGWSAFDKLATDGGVTLNDYEWKDGWHYALGGTYYLNNDWTLRAGYMYDTSAQDEITSISVPDSDRQWFSGGFTYHLDAKSNIDFGLTYLVGKDVDVSENTPGYSSITATTRANALLYGIQYSRSF

SEQ ID NO: 15843 - protein, 372 aa, Photobacterium profundum
MKKTLLAVALAAGFAGVAQAETSVTLYGLIDAGIGYNQVKGSNGDKASRIGAVDGVNSGSRFGLRGVEDLGDGLKALFTLEGGFSPNNGTSSQGGRLFGRQATVGLQSDSWGQLDFGRQTNLASKYFAGIDPSGISYDQATMGTSFSSANTVRLDNMVLYQTPSFSGFKFGVGYSFNADDNATTGGGFRTNNNNRVVTVGARYQNGPLDVALSYDNLRADSSRTKGQYDTDNVQSYIIGAAYDFEVVKVSAAFGQTFDGWFVGTNIDGLSDVDGTGLGSWKLADGSRVNSYLLGISAPIGGASNIWASWQRADINNSRLAGDDATSNTFSLGYTYDLSKRTNLYAMGSYGDNWAFQEDQRSTAVAVGLRHRF

SEQ ID NO: 15844 - protein, 213 aa, Photobacterium profundum
MKKTICSLAVVAALVSPSVFAHKQGDFVLRVGAASVVPNDSSDKILGSQEELKVDSNTQLGLTFGYMFTDNISLELLAATPFSHDISTDLVGSDIADTKHLPPTLMVQYYFGEPQSKFRPYVGAGLNYTIFFDEGFNSTGKGAGLSDLKLDDSFGLAANVGADYMINDQWFLNASAWYANIETEATYKAGGAKQKTDVKINPWVFMISGGYKF

SEQ ID NO: 15845 - protein, 127 aa, Photobacterium profundum
MNKLLLVAAGGAVGSVARYLVGVGAMRVMGPGWPYGTFTVNVVGGFLMGCLASWLAHRGNTSSETWRVMLGVGVLGGFTTFSSFSLETALMIQKRAYGQAFTYSAASVLLAIAALFAGLLVARKVFA

SEQ ID NO: 15846 - protein, 705 aa, Photobacterium profundum
MNKTVLAVAVSALCGNVHAADMSSTPSQNTSVSQTNVVMVTAQKIEKAPYEVNGSVTVITSDELEREGATELYDSLKNIPGVSVSGGAGRPQNITIRGMRGNRIKIIEDGVETGDGYGADDLSDKVGRNSFDLSAAKQLEVVKGAGSSLHGSGALGGLIVITTKDASDYLTPNKNTAVEVSTNYVGESDKLKGTVNLAQRIGSSEHLIRYSQWTGGESENYTGEVYDRDVDGFDLSLTSNFYIGEHQEIKTKVSYYEDTMDRNDHDNYKSGDFNENTVTSSNKYQATYLYNDADFVLFDDAKVLGYYQSTKSNNNKTRYKTKLVQNINYKFLLLENGQFDEEKVGLKTEFQRHLDNQNIVWGVDTVFKEHSRTLGKAIISDGSTSTSQTNPFADANTFNIGLYAHDDIMWDAWDIGFGVRYDFHQLTPKDKNQLASNGYNFALSDTTSSEISPSFSIGYNFTDELKTYFSYNHGFNSPNYAKVYGYVPHDGVPPFEIVPNYNLKAETSDNFEIGVKSRMGIYSVNAAVFYSDFENFIRTKQTGMNSDNGRITIQYVNLDKVKSYGFEMGASADISETVTASGSVGVVTAEEENGAYVETSTPWEGNLALHYSQDFDAFVRWNFAAAMNKVPTCSDGECVTTAGWGTVDLGLSYEPITDLFISGNLNNLFDREYVRYQDVGGMSDAQSKYNAEAGRNFNVFVKYNF

SEQ ID NO: 15847 - protein, 698 aa, Photobacterium profundum
MFFKSHLTLLIGAILAAPVVQAQNEVQNTASDTDEHMVVTGRDYGFKVDTNSTAMRVEATQLETPGQVTVIDEQLIDEQRASTLGDVLKNDSSISAGGVSRNRESFSLRGFSLDSGSGFLRDGKQHWSHYRQPIELLERVEVLKGPAGLLYGKSAPGGLVNMVSKKPTYETQVRVSQDIGSNNESRTIADVSGSLNDAQTLRARAIVSKQSYDSWRSYSDGSTPSTERFVGGLFVDYDVNDDVTVSFHYDKTNDNGSVDSGAYIVDGKPVLGRDFIWDAQWSNIENDVENVGFDVAATLSSVWSIKGGYNHQDFERRDTESFSKPDTYNAATGTYEYQGYDRWDNWQFDTAYIDLVGEFDALGVSHQMLVGANWLGYYYSSQRDSIRGQTATVGQPLEKPSGLDYHNGKKGDATERDSYGIYVQDMITFNDQWQVLAGLRFDREENDTDTYNNVLPKAGVIYHPASNGSIYVTYSESFEPKDPIDDDQDINNGKALDPVKGRLYELGSKWELMDNQLFVSGAVFEITQENKVISQDITNPDFESETTQAGKQVHRGAELSTMGYVTEAFSLSGSMTYLDAEIQDEFDASIDGNRPADVPEFSANVWTRYSFENNTDVNLGAIYVGERFGDEKNTYKKDAYTRFDAGVAHTVKYDENLDIIARFNVENIFDKEYLAGGSQTKTVLGEGRNYMATLQFRY

SEQ ID NO: 15848 - protein, 221 aa, Photobacterium profundum
MSKMKLKTLILSAVAAAAFAAPALAQSPAAWEMPKKGDWIITGRVTDVFSEADNAITTAAGVDSGLKVDVGDSVMPTLGFTYFLTDHLAVEAILGTTKHEIRAQGGATDVAVHETWVVPPIVTLQYRPLTEGRFSPYVGAGVNYMLFYSGEDKNGFKVDLDDNFGYALQAGADIGIQGPWNLNVDVKKVWVNIDADINDGALKSDVDLDPWVVSVGVGRKF

SEQ ID NO: 15849 - protein, 373 aa, Photobacterium profundum
MKKTVIALAVSGLALASVAQAAPQQNTAYAGAKVGWASFHEGVRQFNDKYSNDARYNSDTTAYGINRNSVTYGVFGGYQILNQNNFGLAAELGYDYYGRVRGNVGDFREFKHSAHGLNFALKPSYEVLPNLDVYGKVGVAVVRNDYKFYGAENTNEPTEKFHKLKASTILGAGVEYAILPELAARIEYQYLNKAGNFNKALVRSGTQDVDFQYAPDIHSVTAGLSYRFGQGAVAPVVEPEVVTKNFAFSSDVLFDFGKSSLKPAAATALDAANTEIANLGLATPAIQVNGYTDRIGKEASNLKLSQRRAETVANYLVSKGQNPANVTAVGYGEANPVTGATCDAVKGRKALIACLAPDRRVEVQVQGSKNVTM

SEQ ID NO: 15850 - protein, 376 aa, Photobacterium profundum
MKLKSLMLGAAAAAAATTAQAADLPVAPEPVDYVRVCDAYGARFYYIPGTETCLRVGGRVRTQVVVNNVLEDGAFSDRDSDGYSWLSRGYLYLDARTATEFGTLRTYVSIYSTVTNGENSTTLDNAYIQWGGLTAGRLTSNFDIFTGQAFVGVVDRDWSDVTTNQIAYTAAFGNGFSATIALEDRSDREYGNYGGTRTPDVVAALGVSQGWGSAQLSGALHQVYPDAAANRTNNGGEDSLGWAVGGGAAINLPMLNSGSNIFFQGFYADGALSYITTYDGVADYNGGDTSTGYSLSAGAYIQATSTIGLALDGSYADIDAAAGLNDVTRYAIDGSVQWEPVSGFVMGADVGYANVDTDTQGDQDELLFGVRMQRTF

SEQ ID NO: 15851 - protein, 368 aa, Photobacterium profundum
MNKKLIALALAALPAAAMADVTIYGQIRGGYEYNKTYNSTLSKDANGKPQGSSEINDWTSRLGFKGGESLGNGLKAIWQVESAISVDGTNSTGFGTRDTFIGLAGDSWGQVRLGRLSNYPNMDMEQVDPGYYSSQSVGGLGMFTRLDTRVNNSIRYDSPNWSGFSYMALWGVDEARNVATDGSGSRTNNQLINIGLSYENSGYFAKYSFVNMGDSNKLGAGLKDWHRLEAGYNANNIYAAFGYQQVRGYVGGVAGAYSDTTGVLYNVKALNASGSSLGSNQQVKTKELALTGGYTFGAFTPYLSYAKGYDLSAGGNTVSKSGYDQFVLGLDYALSKRTDVYTSYGHVNWKADGVASESSFGLGLIHRF

SEQ ID NO: 15852 - protein, 381 aa, Photobacterium profundum
MKKTLMVAALTGVFATAAHAQSSVTLYGLIDAGITYTNNQHGHSNWQQTSGSVNGSRWGLRGAEDLGGGLKAIFTLENGFGINDGSLKQGGREFGRQAFVGLSSNQFGAVTLGRQYDSMVDFVGPLALTGTQYGGTQFAHPFDNDNLNNSFRINNSVKYTSANYGGFKFGGLYGFSNQADGFANNRAYSAGASYNWGGLNVGAAYLQLNNNGATGAAAAFNAGGAVSSDNTFFASRQQTWGAGASYAFGPATVGLVYSQTNLSGLAGIGAGASGQTGGVAFGGDSAHFQNFEANARYALTPAVSIAGSYTYTRASLAGTRPHWNQFNLQTAYALSKRTDVYLQGEYQQVNENAVVNADINGLAASSNNKQIAVTAGLRHRF

SEQ ID NO: 15853 - protein, 1593 aa, Photobacterium profundum
MKAKRFKINAISLSIFLAYALTPYSEAALVRDDVDYQIFRDFAENKGKFFVGATDLSVKNKRGQNIGNALSNVPMIDFSVADVNKRIATVVDPQYAVSVKHAKAEVHTFYYGQYNGHNDVADKENEYRVVEQNNYEPHKAWSASNLGRLEDYNMARFNKFVTEVAPIAPTDAGGGLDTYKDKNRFSSFVRIGAGRQLVYEKGVYHQEGNEKGYDLRDLSQAYRYAIAGTPYKDINIDQTMNTEGLIGFGNHNKQYSAEELKQALSQDALTNYGVLGDSGSPLFAFDKQKNQWVFLGTYDYWAGYGKKSWQEWNIYKKEFADKIKQHDNAGTVKGNGEHHWKTTGTNSHIGSTAVRLANNEGDANNGQNVTFEDNGTLVLDQNINQGAGGLFFKGDYTVKGANNDITWLGAGIDVADGKKVVWQVKNPNGDRLAKIGKGTLEINGTGVNQGQLKVGDGTVILNQKADSNQKVQAFSQVGIVSGRGTLVLNSPDQINPNNLYFGFRGGRLDANGNDLTFEHIRNVDEGARIVNHNTDHASTITLTGKSLITNPNSLSVHSIQNDYDEDNYSYYYRPRRPIPQGKDLYYKNYRYYALKSGGSVNAPMPENGQTENNDWILMGSTQEEAKKNAMNHKNNQRISGFSGFFGEENGKGHNGALNLNFNGKSAQNRFLLTGGANLNGKISVTQGNVLLSGRPTPHARDFVNKSSARKDAHFSKNNEVVFEDDWINRTFKAAEIAVNQSASFSSGRNVSDITANITATDNAKVNLGYKNGDEVCVRSDYTGYVTCNTGNLSDKALNSFDATRINGNVNLNQNAALVLGKAALWGQIQGQGNSRVSLNQHSKWHLTGDSQVHNLSLADSHIHLNNASDAQSANKYHTIKINHLSGNGHFHYLTDLAKNLGDKVLVKESASGHYQLHVQNKTGEPNQEGLDLFDASSVQDRSRLFVSLANHYVDLGALRYTIKTENGITRLYNPYAGNRRPVKPAPSPAANTASQAQKATQTDGAQIAKPQDIVVAPPSPQANQAEEAKRQQAKAEQVKRQQAEAGRKSAELSAKQRAGEEERRQTAQSQPQRRKRRAAPQDYMAVSQDRPKRRGHRSVQQNNVEIAQAQAELARRQQEERKAAELLAKQRAEAEREAQALAARRKAEAEEAKHQAAELAHRQEAKRKAAESAKRKAEEEEHRQTAQSQPQRRKRRAAPQDYMAVSQDRPKRRGRRSTLPAPPSPSFDSSAYAAPRALHNPDWYENDYEEIPLDALEDEDVSESVDTSDKQPQDNTELHEKVEAVSLQPRAAQPRTQAAAQADAVSTNTNSALSDAMASTQSILLDTGASLTRHIAQKSRADAEKNSVWMSNTGYGRDYASAQYRRFSSKRTQTQIGIDRSLSENMQIGGVLTYSDSQHTFDQAGGKNTFVQANLYGKYYLNDAWYVAGDIGAGSLRSRLQTQQKANFNRTSIQTGLTLGNTLKINQFEIVPSAGIRYSRLSSADYKLGDDSVKVSSMAVKTLTAGLDFAYRFKVGNLTVKPLLSAAYFANYGKGGVNVGGKSFAYKADNQQQYSAGAALLYRNVTLNVNGSITKGKQLEKQKSGQIKIQIRF

SEQ ID NO: 15854 - protein, 324 aa, Photobacterium profundum
MKKTLLAVAIPALLFANASSAVELYNDAANTFSIGGHVAMGLAGSDEGETQVASVSPRINFEATRDLGEGYTMFLRTEWSVNTLDGGANSFSTRLGYLGLSHADNGTAIIGTQWSPYYSVGGVADLPVAFANGSLYSDHYNLGTGRAERMVSYSNKLDLGTAGALKLGLGWQGKHAAYDTRVQAALTYSVMDVTLGYAHNTGDVAADKAVSNIVSAKYGSYGNGLYAAVSYADNEFMNNALAETSQTSAIAAYALPSSVNLSVNYETVENDLTNKTLNESTAFQVEYKPFNNVLTYVGYQVDLGDDDATTADDNKWALGARLYL

SEQ ID NO: 15855 - protein, 376 aa, Photobacterium profundum
MKKTVSACLALCLCVGMNVTAQETLKVKFRSRALLDTSVSGYGKESTQGYYRVEDFRVGFKATYGQYEVKADVGLGGGKVAIKDLLLNYHWGNHTVSFGNGYEPFSMDMLISTADLRFNQSAASVLAYTNSRKLGATYYYHAPHYLFCMGVYTHNDINKLGDTQKNAFVSTSRAVWRCSDSQQERLWHVGGAFSFRTKEVNTSASPEGSVSSDGVTSLFSEPLLEASFPDMGTEVKGLVEALYLAPRFMVQAEYFFDRMNRTSGEKAYRPHGGYIQGGFLLKGRGFEYDAKYGVPGRPSTAKAIELVARFNYTDMNDDRAEIYGGEEKDLSLGVNFYLNQYIGVKINGSYVWVGSHCNAFYQKNFFLAQARLQYIF

SEQ ID NO: 15856 - protein, 367 aa, Photobacterium profundum
MKKTLVALAVLSAAAVAQAAPQANTFYVGAKAGWASFHDGLTQFDHKDGGEFGINRNSVTYGVFGGYQILNQNNFGLATELGYDYFGRVRGNTTFAGDDKEKTAAKHSAHGAHLSLKPSYEVVPNLDVYGKVGVALVRNDYYVQQNVAKDSRIKAHNLKPSLLLGAGLEYAITPELAARVEYQYLNRVGNLDKAARKTANIEGTNFQYSPDIHSVSAGLSYRFGQGAAPVEAPEVVTKNFAFSSDVLFDFGKSSLKPAAATSLDAAHAEISNLGLANLAIQVNGYTDRIGKEASNLKLSQRRAETVANYIVSKGTNPANVTAVGYGEANPVTGHTCDAVKGRKALIACLAPDRRVEIQVQGSKEVTM

SEQ ID NO: 15857 - protein, 841 aa, Photobacterium profundum
MILRMKLIYKILILFLKDFCFRFLVFDFLSKKIYLVLFWVRSFETLLELISEFQKCKKTNLNIIKSSRFWNGFLKTKSFQKVFLFQKMRILGSLVVFVNKSLFRNLRTYFRNLWCGNSYRNLATEKSFKFGDSALRDITCGNYCILLKIFPRFVDFFGVLKITPKWILKIISILFISNVIMAQEPNTEKEETKKKEIVVTGKADFTNLNSASEDTVRSEQIRSRPISRTGEIAEFVPGMIATQHSGSGKGNQYFLRGFNLDHGTDFASHVNGIPINNPSHGHGQGYTDLSFLIPELIEEIKFKKGVYSAEEGNFSSAGSMNVSYFRSLQKGIVSLEGGTLGYARALVAKSYKIGRGSLLYALETSHYDGPWTVKENYKKVNGVVSYSGGDEQNGYRILAMGYRGNWHTTHQIPKRAIGHELRRFDTVDPTDGGFTNRASISGEAQHTDKNTHAKILIYGLYNDLSLFSNTTYYLDDPIRGDQIEQTDRRTVSGLKSSYKIRSVWDEIKFENLFGFQMRRDFIRNALYHTEKRAELDIVRSNQIIETNISVYYESKIHWSSKIRTIIGLRGDQFQFHVDDRNSELNDRKRFSTANPKGGIVFGPWLNTEIYLNAGRGFHTNDARGLTNKENTFTPIVRSYGGEFGVRSMVFENWKTVLSLWQLDLDSELIFEGDSASTVASRSSTRRGVEWSNYFEPIKGLILDSEVSISRSRFRGDESTGNFIPGSIEHVYSGGITLKETNGFFGSIRGRYFGPRALIEDNSVRSPPTTLFNFQIGKKFNDVWSIVFEIMNIQNAKVSDIDYYYASRLKSEPEGPDEGGYNDIHTRPASPRSIRFGVRASF

SEQ ID NO: 15858 - protein, 773 aa, Photobacterium profundum
MIYLYIKPLSSAMIVAGLIITMTAVEQADAKTTINVGEVTGSADSTHSPLHKKLKKLDNKYTNKQVFRETQSAVVLGNKNKKMISPNAGAAELLATAPGVHIMSENPQNGSGRYNISINGMGVGWWSGNTYRNQISVLFDGIPMNNQITNDGQWNSNQIPILAMIHGVNVIYGPGNPKDRWYDSLGGTINFVPLQPTTKANAKANLSVGSYGSKTASFSLNTGHWYGWSTVLAGGYTSANSFYQSPSNWPQHSWSVYMKTAHPFSNGMFTFGFYYEKSNATHSLTIPVTPIAGYSVNGYGKPGQLLSQQTSGFYYVPSSDLWYKNDIVDSYILYSQQIFDLGGGWTLKNTPWYRHAYRLHQAYFNYGASSYNPEAAEHYAPTNNSFGDRLGANLHSHYNDVDLGGWLSYQQYNTNEELWNPLLGTSQSNPYVYNNVELNTLFSNLYVQDTIKLMNNHLRITPGVALASFYTSMSDLVNPDTKSIYLTATPGAKTNFTRFEPSLGINYKFLKNFSFYANYSETYQNETDLAYGAYLQKIAINPADIPITRAVDYEAGLRYHNNTTNIGINYYHDYLTNLLNGVSGSITQFNASGYNLGNAIYQGVNVYAKWRPMWQLYVYGSANIQHSYYTKDYNNSGVSFNGVRLSGIPHYSFNLSVSYKFRTRYGILEPVLTDQYSGGQSLYNNVTGGPTNQTINAYNIVNLSASYKTFVFNHIIPGAKETDFSVGVYNLLNRKYESDIYLSTGGYNPQEQPSLFAYAGAPLQVFGGVTVKF

SEQ ID NO: 15859 - protein, 745 aa, Photobacterium profundum
MRYEVLEPGRSRTKGARVARVGRGRWRPSLYLGLLIAAHPAVAFAETAPVPASAAGAEVRKEEATAVKAAAGELKAISVTASRGVADDPSVATVGKMPLALREIPQSVSVTTRERIDQQNLFSLDEVMQQSAGVTVQPYVLLTTAYFVRGFKVDSFEFDGVPVVIGDMASAPQDISVYERVEILRGANGLLHGSGNPAATVNLVRKRPQYQFSANASVSVGSWDRYRAEADIGGPLNAAGTVRSRLVAAYEDRHFFYDHAKQDTRSIYGITEVDVTRDTLLTFGAQYQTTRSIPDMSGVPMARDGSSLGLSRSTFLDTAWGHFDWDTTRAFASVEQKLGAGWKAKVSGEYQSVRSDLKYAGSYGAINPATGAGGALTGGAYQFSSYSRSIDANVQGPVHAFGLTHDLLFGVTYANSSSGQMTAQLLGNVVGTPVNVYRWNPSSVPEPDVGPYQQSQQNDISQKGVYGLGRIKLAEPVTLVLGGRMSWWNQDSLGAHYNTGHQFTPYGGLIWDFARDWSWYASYAEVFQPQTKSMWGGGILTPVKGRTYETGVKGELAGGKLNVSLAAFRIDLDNSPQVDLAHPCAGPNCYYVNGGSVRSQGFEFEANGRITPWWSVWASYTYDTMSYADNLANAGSSFAPLLNPRHLFRLWTNYDLPWQERRWSVGGGVQVQSNYSAQAGGVTMSQGGYALASLRLGYRYDKHWSAAVNVNNLFDRKYYLSLSNPGWNNRYGEPRNVMLTVRGQF

SEQ ID NO: 15860 - protein, 169 aa, Photobacterium profundum
MNKFTVISTLILASSVALPAFAADTDWFVGGGVGYQQDTIKGANEQNGEDATYQLRGGAIINDHHRVMGTYSYMDKSSQNLFLASYDYLIPVAQKVNLFAGVSAGLADNKISNESSTDFVWGGQVGAMYEINDSWSTDLTYRYLDQDYSEQATKLDYSQQVVWSVDYKF

SEQ ID NO: 15861 - protein, 295 aa, Photobacterium profundum
GVETSRSVYYEDGKAAEVTTGTGIVDLGSKIGFKGQEDLGNGLKAIWQVEQKASIAGTDSGWGNRQSFIGLKGGFGKLRVGRLNSVLKDTGDINPWEGKSDYLGVNKIAEPEARLISVRYDSPEFAGLSGSVQYALNDNAGRHNSESYHAGFNYKNGGFFVQYGGAYKRHVRVDENVNIEKYQIHRLVSGYDNDALYASVAVQQQDAKLVEDNYSHNSQTEVAATLAYRFGNVTPRVSYAHGFKGSFDDADRYNTYDQVVVGAEYDFSKRTSALVSAGWLQEGKGESKFVSTAGG

SEQ ID NO: 15862 - protein, 122 aa, Photobacterium profundum
MKKALLLTLSLSLSFWLHAERNGFYLGLNFLEGSYIKGQGSIGKKASAENALNEAINNAKNSLFPNTKAIRDAQNALNAVKDSTKIANRFAGNGGSGGLFNELSFGYKYFLGKKRIIGFRHS

SEQ ID NO: 15863 - protein, 737 aa, Photobacterium profundum
MEFKIIIMKTFPLNSLAAHCQLAITRPELILCSAILSMPYAYADASDTQKKSTKDIEIINVVGAKDLHDNRYKTQAMNTATGLDLSYLETPQSVTSVTSQMMHDQQLNSVIDAMTSVAGINARPMDNDRYSISSRGIAVTSILYDGVPTTYDTRFNYGDNLIDTAIYERVEIVRGATGLMTGAGNPSAAINLIRKRPTQEFMGSTSVSVGSWNNLRGMVDLSSGLNDSGSIRGRVVAAYQDKESFQDRYEQQRTTLYGIVEADITASTLLTLGVDYQDTTPEGTMSGGLPLFHSDGSRTNYDRATSTAPDWASAHTQGLNTFASLEHRFDNGWELKGTYSYGDNSLKYDVLWATGYPDPVTNIGATAGSIAYVDGSRTQHNLDLRAQGMFALFGQEHQLTFGWTGQRQEFANPYYYPTAAVPPLGDFRDPNFQYPKPQWKETHTTGTFGETEQSAAYVATKLNLTDALALLAGLRLNKWQTDQDNFGSMYDFKVDNELTTYFGLTYALGEQYSLYASYTDIFAPQTLQRIDASYIDPVKGKNYEAGIKASLMDESLDMSLSVFEIRQDNVGERTGDVLPGTTIPVYREVNSTKTQGFEFESTGKITDDWNIYFGYTQFSTDDPKGNRINTTSPRQQLKLFTTYTFSGDWNKLQLGAGVNWQSRVYQTVNSPLGRVEVEQDSYALASLMASYAFTEQLKLSANVHNALDKTYYSQVGQYSQFQYGAPRSMSVNLDYRF

SEQ ID NO: 15864 - protein, 172 aa, Photobacterium profundum
MKKTLCGLAVLSALVSTNVFAHKEGDFIVRAGLAAVVPNDSSDGILGSNEELAVDSNVQLGLTIGYMITDNISFEVLAATPFSHTISTNLLNLGDIAETKHLPPTFMLQYYFGEASSKFRPYVGAGINYTMFFDEGFNSTGSGATLTDLKLKDSWGLAANAGFDYMLNEQWF

SEQ ID NO: 15865 - protein, 270 aa, Photobacterium profundum
MRKSLVALSVLAATALPSLANAADYSDDIHKNDYKWMQFNLMYAYKELPRSNDAHTGHDYLEMEFGGRSGIFDLYGYVDVFNLTNSDSQDKSGSKDKMFMKFAPRISLDALTGKDLSFGPVQEVYVATLMNWGGDNGGVNNYFVGLGSDVNVPWLGKVGFNVYSLYDMNAKDWNGYQVSTNWFKPFYTFENGSFLSYQGYIDYQFGMKKKVAGLNTSNGGAMFNGLYWHSERFAVGYGLKAYKDVYGLKDGGIAGKTSGVAQYVSLSYKF

SEQ ID NO: 15866 - protein, 272 aa, Photobacterium profundum
MKKILSTLSIGSALALSSTVFAVDYSDDIHKNDYKWLQFNLMYAYEELPRDPDAHSGHDYLEMEFGGRSGIFDLYGYIDIFDLTESSASDKDGKPKMFMKFAPRVSLDAVSGKDLSFGSVQELYFATLFNWGGGTEADFEPNNSFWGIGSDINVPWFGKVGLNFYGHYNITAKDWNGYQISTNWFKPFYTLDNGSFVAYQGYIDYQFGAGSSFQGNSQASHGGVMFNGFYWHSDRYSVGYGFKLYNDVYLIEDTNAFESTGISHYVAATYKF

SEQ ID NO: 15867 - protein, 415 aa, Photobacterium profundum
MSKNIKFSAIAVTAAFMSLNVNAAGFQVNEHSASGLGRAFAGDAAIADNAAVLSRNPAAMTLFKTAEISGGFSIVDPSIDVEDKSFGQTAKDVAPVAFVPAGYYIQPINDRFAVGLALFSNYGVTTEYPADFNAGSSAGETSLITVNFNPNIAYRINDNFSIGGGVSLVYGEAELNRHLGSLSAAVPDSSPSDKTITMKGDTFDWGWNIGALYEYNENNRFGLSYRSQVDLDFEGDFTDYLGAITGTPNNTITGKLPVVLPAIAEFSGFHQLNNQWAVHYSVQWTQYSKFEELKATSNECSPGYNGESGTCLLKEEDYDDSFRYALGATYTINTTWAVRAGFAFDEQAGQATLSIPDTDRYWYSAGATYTYNQNMSFDLGLTYLYGKEGTFEEDGSTFTSSGGAIISAAQMNYTF

SEQ ID NO: 15868 - protein, 386 aa, Photobacterium profundum
MNMKCATSFVLVVCAGAAHAQNSLTLYGIAETGINYVSNANGGRQFNMVSGEWYGSRWGLKGTEDLGAGQSVIFRLENGFDIDTGKLGQNGLLFGRAAYVGIDSKQFGTLTVGRQYSTVYEFVGANLVASSRWGGGFIAHAGDVDNLNNTFRVNNSIRYNSISYHGFTVGGLYSLGGTGGNFNKNSGWGAGIGYTGGGLQAAVAYTDMQDPFVSAYNNGANAPAAVTSPIYNAYASARSLNILAAGAIYTIGKLYFGGTYSNSRFLQLGADPGNAGAGARLRGTAALNDYEAEIGYQFTPAFSTTAAYNYTRRASVNGDVGAKYNQVSIGADYIVSKRTDFYLVASYQKASGVNSNGTPAVAALNFLSPSSVNHQGVVRLAIRHLF

SEQ ID NO: 15869 - protein, 751 aa, Photobacterium profundum
MNKKIHSLTLLVNLGIYGATLPVMAEDKTDSAALTNEDTIVVTAAQQNLQAPGVSTITADEIRKNPPARDVSEIIRTMPGVNLTGNSTSGQRGNNRQIDIRGMGPENTLILIDGKPVTSRNSVRLGWRGERDTRGDTAWVPPEMIERIEVLRGPAAARYGNGAAGGVVNIITKKGGSEWHGSWNTYFNAPEHKDEGATKRTNFSLNGPLGGDFSFRLYGNLDKTQADARNINQGHQSERTGSYADTLPAGREGVINKDINGVVRWDFAPLQSLELEAGYSRQGNLYAGDTQNTNTNQLVKDNYGKETNRLYRQNYSLTWNGGWNNGVTTSNWVQYEHTRNSRMPEGLAGGTEGIFDPKASQKYADADLNDVTLHSEVSLPFDLLVNQNLTLGTEWAQQRMKDQLSNSQTFMGGNIPGYSSTNRSPYSKAEIFSLFAENNMELTDSTMLTPGLRFDHHSIVGDNWSPSLNLSQGLGDDFTLKMGIARAYKAPSLYQTNPNYILYSKGQGCYATGAGTGIGCYMMGNDDLKAETSINKEIGLEFKRDGWLAGVTWFRNDYRNKIEAGTVPLQRINNGKTDVYQWENVPKAVVEGLEGTLNVPVSDTVNWTNNVTYMLQSKNKETGERLSIIPQYTLNSTLSWQVRQDVSLQSTFTWYGKQEPKKYDYQGNPVTGTDKQAVSPYSIVGLSATWDVTKNVSLTGGVDNLFDKRLWREGNAQTVRDTQTGAYMAGAGAYTYNEPGRTWYMSINTHF

SEQ ID NO: 15870 - protein, 700 aa, Photobacterium profundum
MSKKLLSLLIASIVSGQALAQDEVNRTGVDETIEITATRTKIPQSAIPATVTVIDGEQLRQQMMVAESLSDVLGKLIPAFSPSRQKLTSSGETLRGRQPLYLIDGVPQSNPLRDGSRAAYTIDPFMIERVEVIHGASAIQGLGASGGIINIVTKQAQEGTTQEVNAGFTAPDSEISEGLSYEAGYLVRHAEGDWKFVAGAQYRDTGMYVDGKGQLIGVDTTQGDTMDSKSYDVFFKGEYRIDSTQSLALMINHFDMAGNGDYFATVGNRELGVPALSVEGEYPGDAPENEVTTSSLTYKNTDILGADLNWQLFLQDFSALYGGGNYATFQDPQYGDDIFDQSRNDSRKYGSRITMNWAKVADLPVDVTAGVDFMNDKTFQELAQTGRKWVPETEFENWAPYAQLSYQANGLTLSGGLRYEYGKLKADSFTTLASYGSVFVEGGEPSFNELLTNLGAVYALNDNWRVFASYSEGFSMPDVGRVLRGISTPDLSVSSFLDLQPVLADNEEIGVEFNNNAWRASISYYRSESDLGARLQADADGIYSVKRERTEIDGIEASAEYAFSNDTAFGLNYADTDGEFDSDGDNQVDTQLGGRNIAPKRANLYWSQQWTGQVSSRVQWNKFFDRDIYSGAEAVNNFDGYNTVDASVLLETRDYGQFALGIENLFDEYYFTYYAQTVGGDNRNFTGRGRTVSLNWNYAW

SEQ ID NO: 15871 - protein, 290 aa, Photobacterium profundum
MTIYTLSHGSLKLDVSDQGGVIEGFWRDTTPLLRPGKKSGVATDASCFPLVPFANRVSGNRFVWQGREYQLQPNVEWDAHYLHGDGWLGEWQCVSHSDDSLCLVYEHRSGVYHYRVSQAFHLTADTLTVTLSVTNQGAETLPFGTGWHPYFPLSPQTRIQAQASGYWLEREQWLAGEFCEQLPQELDFNQPAPLPRQWVNNGFAGWNGQARIEQPQEGYAIIMETTPPAPCYFIFVSDPAFDKGYAFDFFCLEPMSHAPDDHHRPEGGDLIALAPGESTTSEMSLRVEWL

SEQ ID NO: 15872 - protein, 1025 aa, Photobacterium profundum
MKKVLLGLAFTLLTVMSVLAQSKTITGRVTSSEEPDGVPGASVVIKGTTQGTITDIDGTYSIEVPSEANALVFSFVGYLTKEMPIGSNSVIDVVMDLDVKVLNEVVVVGYGTQERREITGSVTSIDSKSIENLVSPSFESQLAGRAPGVQITTPSGILGAAPIIRIRGVNSISSSASPLIVIDGVPVVSNDRSAVNAANPLSNINPADIASFEVLKDGSASAIYGSRAANGVILITTKRGSTGKAKVSYSTSMGFNEEVDRFDLLTGDEWVTIANEKRSNANQSSLANPGVNTDWQDLIFRKGFAQQHNLSIAGGSEATKYFFSLGYTDQESPVRPNELSRYSFRANVDHNISKAVRVGTSLSYSYTEIFGLNNGANSLSGAIYNATRSLPNVPIYDEENAAFDGYNVTANGATTGFGANLAGPDNNIPNIGFVLDNNLYRSRTHRVIGNAYGEVDLFTGLTARTQIGIDLTMNDDFQSLDPRHGDGRSSNGSVYMAYNPAFRWNWQNTLNYQTVIGDDHNLNVTAGLEYQFTKLYGFNASGTDISDNFYRLNNIISGSYNNQFSGGSYSERGFDSYFGRFNYSYKGKYLASFTLRNDGISDLAIENQRGTFFGGSVGWRVSDEAFFNSGLISDFKVRASYAEVGNTEIGTFAAYGGYSPVLGGAGAGIGYAAIANNNLQWETSKKFNVGLDMTIGRVTIAADYFKNDIDGLILDAPTALSLGVPGNNISQNIGSMTNSGLEFRAYANVINRGKFSWDTDFNITFIKNEVNELISPLTGTYNRTEVGNPIAQLYGYEWAGVNSANGNPMYVSGDVIVQYNLSPGNLGYKAYDPANPGDVSVTGSAPTQEYLGNTLPKWQGGWSNNFKFGNFDAEIFTRFSGGNYIMNESVRGLLGQGFSNNHASILNRWTESGQETDVPKLYSGQDQNMWQNSASNSRFVEKGDFVKIQNIVVGYTVPTSALQTAFKGAISNARFFAQVQNPFIFTGYSGLDPESNSYSGQLSFGVDWNVAPIIRTYTLGLNVGF

SEQ ID NO: 15873 - protein, 819 aa, Photobacterium profundum
MMLAQKQNFMNQFYKKYHYSIQKYQITDLLFFLFLYPFSTSYGNEQFSFDSRFLPSGYNYSLNSNLPPEGEYLVDIYINKIKKESAIIPFYIKGNKLVPCLSKEKLSSLGININNNDNAECAETSKAGISNISFEFSSLRLFIAVPKNLLSEIDKISSKDIDNGIHALFFNYQVNTRLANNKNRYDYISVSPNINYFSWRLRNRFEFNQNNDKKTWERNYTYLEKSFYDKKLNLIVGESYTSSNVYNNYSFTGISVSTDTDMYTPSEIDYTPEIHGVADSDSQIIVRQGNTIIINESVPAGPFSFPITNLMYTGGQLNVEITDIYGNKKQYTVSNSSLPVMRKAGLMVYNFISGKLTKKNSEDGDFFAQGDINYGTHYNSTLFGGYQFSKNYFNLSTGIGTDLGFSGAWLLNVSRSNFKDKNGYNINLQQNTQLRPFNAGVNFDYIYRKKGYVELSGIGWHGNLYNQLKNSFSLSLSKSLDKYGNFSLDYNKIKYWDNAYDSNSMSIRYFFKFMRAMITTNYSLNKYQSYEKKDKRFSINISLPLTKDYGHISSNYSFSNANTGTATSSVGVNGSFFNDARLNWNIQQNRTTRNNGYTDNTSYIATSYASPYGVFTGSYSGSNKYSSQFYSALGGIVLHSDGVAFTQKAGDTSALVRIDNISDIKIGNTPGVYTGYNGFALIPHLQPFKKNTILINDKGIPDDIALANIKKQVIPSRGAIVKVKFDAKKGNNILFKLTTKDGKTPPLGAIAHEKNGKQINTGIVDDDGMLYMSGLSGAGIINVTWNGKVCSFPFSEKDISSKQLSVVNKQCNRPENSGD

SEQ ID NO: 15874 - protein, 208 aa, Photobacterium profundum
MKKLLLAALLTSTSTLAMAQISTDGLYVQGNVGVSKLNAKVDGKKYKDNATQYTIAVGKDMGAIRFQADYTNFGKMKENGSKGKRDEVRYEEWKASLKAHSLGVSAIYDFNTATGLTPYAGMRVGANQLKFDGQDLYNKITPDGRLQLVKDIESKKSNKVSVGAVAGVQYTFNPQLALDAGVEYHYLGKIESLKLNQYGAKVGLRYNF

SEQ ID NO: 15875 - protein, 827 aa, Photobacterium profundum
MGDVVNGKLTIGRWGRRLLMGVSVLALGQTALIARAEDGPAAGGPTAQAGAVYVFDIATKPLPRALADFSAVTGLQVLYSGSAAYSHTAPALQGSYGARQALGLLLAGSGLAARFTSPTSITLEAIKDAEDALVVDPIAVEGALLRGGLPGTEGTGSYATGATNTATKLTLSPRETPQSVSIMTRQRMDDQNLNEMADVLDETVGMTFKEGGPIGSDANAVYSRGFEVHNFQVNGVSRSTKYGFGDDLSDMAIYDRVEVVRGATGLMSGVGDPSASVNLVRKRPTDTFQSAAELQAGSWNRYRAEGDVASPLIESGRLRGRLVAAYQQGESYIDRLETSKKVLYGVIEADLTEDTLLTAGVQYQHHRSDHASRAGIPMFYSDGGRTDFSRSTSSAADWAYFDNTQLTTFAALEQRFDNDWTVTLDLEHARRSYDALIGYGIRGTPDRETGAGMGLYAGRWAAKPIQNSVGLTATGPITLFGRQHDLMAGFSTYHASYEDPSYPLWSIPGYDTSIGNYYTWNGAIAEPVLEENGSESFLERQVAGYMATRLRPTDDLSIILGGRLTSWSQETESRYADGSSSYSEQSENGKVTPYAGIVYDLSDIWSVYASYTSIFKPQSLQDADGGYLQPLVGDAYEAGIKAAFYDGRLNASLAVFRINQDNLGVADGAALTPSGGQAYKAAKGTTSQGIELELTGEVLPGWQVGGGYAHASPTDVKGKRLLTDIPRDTVKVFSTYRLPGAFDRLMIGGNLRWQGAIYANNVGPNGERATQKAFSVVDVLASYRLTEAVTATLNVNNIFDEKYYSSIGAIGYYGEPRNAMLSVKASF

SEQ ID NO: 15876 - protein, 1057 aa, Psychromonas sp. CNPT3
MKRAGTGQKRNRSIFRFSTLAFAMHVVSMGGLVVFPMQQAYAETAGVKSYNIPAGRLANVLNQFAEQSGTSIAMDAQQLQGLHSLGLKGNFAVEQGFEQLLKATEFNAVKVGQGYTLSKKSMPRVTTSNVQAASLPPSSAVIEEDASVRLTPIVVYGKEDRDTEGYNKVYDANRSSVYAGKDYVERFKGTNPADVLQGMVGVYSGDARNSGALDPSVRGVQGVGRVPLTIDGTEQSIAVWRGYNGVNNRNYIDPNLIAGIEVIKGPSLERNTTTSVGGGVVVKTLEADDIVRPGKSFGAELKVEGSTNSIDPSLPDMSKVGQNYDDTTPWIDMNGSKYDPDIYKKNRTRSDNSHFSGDDLAGRLAIATKQDKFDLLAVYAVRERGNYFSGTHGAGYYKRATPDSSLDFIPYFAYAYQPGDEVPNTSSHMESWLLKGTYRPTDDQTLKLTYRDTKNIFGEIMPSRIVWGITPDLGVPQWPLSNIHSKAYSLEYKFKPENNRWIDFYANIWQTDTESQTYTRGGWPTTIDFRDNTIINTAISHSDNTRKGITVSNKTRLLDQLDLTLGGSFLKEKLTSDDVYGEFGPSYSLYQALPRAGHREEKTFDFNFNYRPVSWLSFDAGMRYRSYWAIDDFLNKSLQSEIDPSLNPLFTKKSRLKEYTFEYQTMPESYTSTQQRLINVLKQRYATKNPEWDGQLDTVPASESTLYNMIWSQKNTLSWKADANGQLSLADNPLNQLNASGPKYVVTGGNFMSVVDQVPVESADKVKDSGWAPQLGASIHLTPNSRIYARYAEEYRLPSLFESTVGFSAMLQYQAIKPEHAFNYEVGYVYDMRDWFSTARNADIKLAYYYNKTKNVIERDQNLIFTNMDEQKLSGLELQSRFDNGGFFTDLSVAYNLKNEVCDTNSAINKMILGGTVQTEQGLEFREPYQRCVDDGFPNGYLVTMATPELSFHGLLGARFFDEKLELGARATFYKAYESPLRKNNDASVNKGYYLNVPLAWDDTWIFDAYARYQVDDYNTVEFVGSNLSNQFYIDPLTRSAMAAPGRTMKISWTTKF

SEQ ID NO: 15877 - protein, 231 aa, Psychromonas sp. CNPT3
MNNTEVEDIIGYTEYTGIEAELGFGSGLTLLGALGCDYGDYRVEGELGYQNNNVDALDIYIPCCNTEDNAVINVDLDGDITVLSLLMNGYYDIDLGGGVELSPTVGVGLAQVSMGDVTITGISEDYSNCCNGDNNGGDIIIVPDDPPFDDEITEVKESPQERQMRAGDDLNLDVHEVTFAYQAGIGLGIPVAENIMLDARYRYFATTDFTVLVANTNIESHNALLGLRVMF

SEQ ID NO: 15878 - protein, 172 aa, Psychromonas sp. CNPT3
MKKLTIVALTCLFSTHLLAAPVGNTFTGIGVGVDVTTTKYKVEGVKGKDSTGPALVVDYGIEQGNNFVGVVQGKAKVGSTKVFSDVKQKNKYTIAYQQGYRVGSDLLPYVKVDASSSKIGNETYRGFGFGAGAKYAVSSDVELGAEYTRDNLKRSGTKLKGNAFTANATYRF

SEQ ID NO: 15879 - protein, 390 aa, Psychromonas sp. CNPT3
MSANAETQTPQQPVKKSGKRKRLLLLLTLLFIIIAVAIGIYWFLVLRHFEETDDAYVAGNQIQIMSQVSGSVTKVWADNTDFVKEGDVLVTLDPTDARQAFEKAKTALASSVRQTHQLMINSKQLQANIEVQKIALAKAQSDYNRRVPLGNANLIGREELQHARDAVTSAQAQLDVAIQQYNANQAMILGTKLEDQPAVQQAATEVRNAWLALERTRIISPMTGYVSRRAVQPGAQISPTTPLMAVVPATNMWVDANFKETQIANMRIGQPVTITTDIYGDDVKYTGKVVGLDMGTGSAFSLLPAQNATGNWIKVVQRLPVRIELDQKQLEQYPLRIGLSTLVSVNTTNRDGQVLANKVRSTPVAVSTAREISLAPVNKLIDDIVKANAG

SEQ ID NO: 15880 - protein, 379 aa, Psychromonas sp. CNPT3
MQKIGGDKVKRALLASTALGLLLCTGYAHSSVTLYGVVDSNIEYVNKLTNASGASGSVVRNSGGGFASNRWGVRGVEDLGGGLKGIFTVEGGFNVDTGTQFNANKLYDRQTFVGVSSDEYGQLTFGRQYSTIFRALANFSPSAYAPMYEPLSFLLGMNLRNDNSVNYVIQRGSIGARLHWTFGNGVFGAGETPGEIRANAGYGASLEYSAGEFGASIAYDQFYPTLTTLGDNGIGNFRKAAIGAGYNLGKFRFSGGYRWGRNEFSNGSVALRDDFLWFGVNYQVAPKVNLMLAYYYDKLHTLRAQYNGAELDRPNPYQVSFMASYDFSKRTNVYLTTAYSKNVALAFGGLATTAASGAYLLGAGKSSQVGAALGIRHIF

SEQ ID NO: 15881 - protein, 363 aa, Psychromonas sp. CNPT3
MTSKQTITYAALSALCFVSNTSFAKINDDIDLSGYIMLDYNKFDSSLLEGQYDSSDSESTSEIRRARLSFKSDISKDWKSKFQLGFADGETEIKDAYLEYSGWKYADLTIGKQKEGFGLEKLTSSRKLLMLERSMISETFSPGRSLGISLSGDIASVNWQLGYYEPDENEATSAITGRVAWVPWQQNTNLLHLGIAFSERQYDGNEFRVNEPLEVYTADSLIEGDKINADSLSQQGVELLWLKDRFTMMAEWQQAQVTSIENTTNDYEGGYLQFGYQLSGGYRKYKNAKLGASSEPGWELTGRYSLLKLKQENQDAKTYALGVNYTLNKNIKFMADYIKADYFEAGGTITSGNAISLRLQYSF

SEQ ID NO: 15882 - protein, 355 aa, Psychromonas sp. CNPT3
MKKTILAIAIPSLFASAANAAVVYDKDGTTFDVYGRVQANYYGDHNTADSTAASGYKDVDGELVGSSRLGWSGKIALNNTWSGIAKTEWQVSAENSANKFDSRHIYVGFDGTQYGKIIFGQTDTAFYDVLEPTDIFNEWGDAGNFYDGRQEGQVIYSNTYGGFKGKLSYQTNDDKAVKVTDVGQGIKETAVYGADVKRNYGYAAAAGYDFDFGLGLNAGYSYSDLENTKTNNTGDKKEWALGAHYAINGFYFAGVYTQGDLSYDNTTGGDKDKGRGYELAASYNVDAWTFLAGYNFKEAKVNSNTAGAEYKDLLDETLLGVQYAFTSKLKAYTEYKIQGIDKLDDEWTVALQYNF

SEQ ID NO: 15883 - protein, 356 aa, Psychromonas sp. CNPT3
MKKTILALAVPALLAAGVTNAATVYNNDGTKIDLKGSIRLLAEDGARRDADLSDDSSRIGLGINHDLGNGLSGLGYIEMGYDTQMPETNSKSTIKNRLAYAGLSLDGVGTLTAGRITAPFDDVAVSDYTWTYGGVMDFGKMQNNADRGPFGQKNTFLARTSNSVKVESAEFNGFKAAGSYTMQTGDNTSDVKNAYTLAAFYTSDFGLTFNAGYGHGKSVGQEASLNTAAINAVDADIWGIGAQYQIADFSIGLDYGQAKLDWNTAGESNSKADLLGVGVKYQIIEQTKVYAGYYGRDYSDYKNWDRHDLYVVGTDYAFSKNVVTFLEYAHDDYKYVKPTTDVKNDDRIGLGFRVYF

SEQ ID NO: 15884 - protein, 692 aa, Psychromonas sp. CNPT3
MHPDRPKFRYRGTEADIINHFNFYRMKEIQTKRTPRFRRWCRKGYAAFASLRRQVTIGVLSVSMSTILLSTTTPVQAQTVDSLTIARELEIETVEVTGVKATPTRSAMSSTSVFDRKAGASAPVQTLESVLRLSPAIDLRERSGRGTQADIMIRGGSFDQTMVMLNGINFTDARTGHQSHSLPIDIDCIAGIDLIDGVSGVGAYAGALNIRTMPLKSRYLRIEAAGGDDGYAYGNLSGAVTKGRFSLFAAGSYRRSDGYIHNTDFENYNGYLRMNYDSEKAGFFDFQAGYQNRSFGSNGFYAAYNPDQFEHTSTVLSSLRWVKSVGRFTLNSSVSYRKNFDRYDWTRGTPMNHHNTDNAGAEFWADCTWKGGVTSLGGDYTYNHIYSTNLGEPLPTPHGKYTHAKDRHVGNLWLRHVKQWERFDVSGSAGVSFTPYGTSALWSLSGGYRPVRGLRLEVGAAQSMRLPTFTDLYYTSPAQLNNLDLKPEHAITYRFAADYARSGWNASLFTYYRQGRDIIDWVWREELGKWHSEQESKLDTYGLEVSGGYTTTGFLHRISVSYGYIHTSKVDRVITSSALDYMKHKAAATVEFRFLRNCSLTLTGAVYDRNGSYTYYLRNADGSLMLDPDGKMMTEVRDFKPYFLLDGRLSWEKKGWKLYFDVMNMTDTRYFDFGGLEMPGVWFSGGIVVTIG

SEQ ID NO: 15885 - protein, 358 aa, Psychromonas sp. CNPT3
MKKSILSAVILTALTSGSAFAAHTFTNDAGDSLTIDGRFDVRYHDKGGDHNGEWNSGSSRFGLKGQMGLDNGWTGFGHAEWGYNSGANGDNIYDRLLYAGVEHDKYGKIAAGTKQWSTFYDVAWFTDMGRVFGSRGSGYYNLSDWGIASGTGRAENSITYRNNINDNWKYGFTYQTTREDVGLADGKTATLKNGMGASTLYTVMDGLTIGLAYHQNEFDDVDAGVQNIKDGDTQRIGLLGVNYTNNGLFVGFTYSQGSNWETTSKAEFYDHRGAEFFTYYHFENGLRPTFNVNYLTDTDDNANGYERQLIIPGLEYHFKKNKFLVWTEYQFDNGNDKAVGNHYENSDDQFAAGIRYYF

SEQ ID NO: 15886 - protein, 735 aa, Psychromonas sp. CNPT3
MKFMQQFMAVCFVMAALSAGAGESGPDKVILDDVVVTGTKLVTPTKQTNETVYTGSEITRDGLDALGSKAAVSVYEAINILPGITVESIDPYGLAAEQKNIRVRGVRGFLGAMTVAGVPNYGGNPMGPREYIYDTENFDSIAVYKGAVPADLGTGVGARGGAVDLRPKWPEEEFGVNVSQGIGTHNYSRSFIRLDSGSLPRTGTGLSLSLSHTDAEKWKGPGDLGPRKNVNVMLRQPMPTGDEVKFWFNANDLNQDLYRPLTYSEVESLGSFYNKDYNSSLTGNKSDDINYYRYNRGDYANRDFLAEIPVTLSDTFRLKFKPYYTDEDTEILQGSASQGGIVIKRKRDIERYGMITQLDSHFSWGKASLGYWAEVSDMIIRQQNYDPITFAFKGYGMYMKSDDKGVAHSPFLKLAGSIGQFDWQAGLKYFHYTDPSSQGYVASAPDYTLKAASDLFREEKTYDEILPTLGVAYRLTDTVELNASYGRNQIRPYAYVPLVNIYNQNRTAFQAAGVTLDDMFSGYDMEISDNFEVGARFRFDRFEVVPTLFYSRHQNLLTTVYDPRVNLSYNQNVGDATGYGIEIESNFLINDHLNFFLNPSYTALTYDDDLTFQGAVRDTKDKQVLDTPEWTVKTGLIYTWKDFEIIPMIRYMSSRYGDAEHNEKVDDYVMADLKMGYTFNHFSFVDKLRLSLELTNLFDKEYVSVINAMDDSRAGNTSYYVGAPFTAMMTVSFDF

SEQ ID NO: 15887 - protein, 1066 aa, Psychromonas sp. CNPT3
MKIKFTGLLTLFLALAVQFSFAQTKEVTGTVTDGSGVPLPGVNIVIQGTTTGTQTDFDGNYAISASEGQTLVFSYVGFGDSEQVVGASSTINVSLTAGEALDEVVVTALGISREKKSLGYATQEVSNEELTQTRNSNALNALSGKVAGVQISNASGNLGGSSRILIRGIGSITQENRPLIVVDGIPLDNSNYNSTSAQNGGGGRDFGDTGFDINPDDIESMNVLKGGAAAALYGSRASNGVIQITTKSGKKGKGEVTVNTGITFEEVNILPQTQKLYGGGGGNYTIGDQGGFNQATINGSTYNLVDYATDESWGPRYEGQPVLHWDALEPGTPGYLQTRPWVAPANDGSTLFKTGYSYNNGVAFSQAGEDSNMRMSINNTQTEGILPNTKLNKTSINFNGSTKIGDKLKVDASVNFTVTDGFNRPASGYTGESVILQLYQFGQTSLDYERLKNYRTADGTQRTWNRVAYDDPTPRYTDNPYWVLNENTAEDKRTRWYGTVGATYNFTDDFYAVAKVYGDTYDFRINQRTAVGSQAQASYSESDRDFQEINYEGRLHFDKTVFDDKLSINAFVGGNRRVNEYHFLGSNTNGGLVVPGFYNLSNSVDNPTVSESDTQRQINSLFGSVSLGYDNFAYLTVTGRNDWSSTLPAENNSYFYPSVSGSFIASQFINADWLSFLKLRAGYAEVGSDTTPYQLSNVFIGSNPFLGSVPFSLNNSNRNPNLLPEEKRTYEFGVEASFFNRRLGFDVTYYNELTKDLITPVQVDPATGFSSTVLNAGELENKGIEILVNATPIMTDDFSWDVTWNFAKNENTLLSLAQGLETLQIASFPFNGVSLNAVVGERYGQIRGTNYVYDDAGNRVVNANGSYAETQDVENLGSILPDYNMGIRNTFTYKGISLGVLIDRQKGGVYRSLTNIWGNYSGILEQTAANNIREEGLVLPGVTGDVTYNDDGSYTVSNTAENTQVISAQQYGTDYYFGNDAQNVFDASYWKLREITLGYNLPKNWIGNAFSEVRVTAFGRNLLVWGLDNDNFDPEIATTGSGNIQGSEGGSLPSTRSYGLNVQLKF

SEQ ID NO: 15888 - protein, 1081 aa, Psychromonas sp. CNPT3
MIHIKRNICLVAVSCTLLAGIPLQGVAQTGRTAKVQATQSNKITVSGTVLDKTTNDPLIGVSVVVKGVANAGTITDMDGKFTLKLPYAEAPLVFSYLGYQPQEIVPGAKKELTVLLQEDTKALQEVVVVGYTKQRKETMIGSVATITTKDLTQSPTANINNALAGRLPGLIVNQYAGGEPGVDQSELFIRGKATYGNQSAIVIVDGIERDMSYLAPDEIETFTILKDASATAAYGIRGANGVIVITTKRGKAAEKATVNLKASIGINQPIGFPEYLGSADYATLYNEARLNDAKMTGADISSLNLFSQQAIDNFRRAKGDNSDGLGYDWDYYDFAFKPGLQEDVSLSIRGGTDKVRYYVLANYFSQGGNYKYSNAGEYDSQTKFTRYNFRSNIDININRYLSTRLDLGARITDRNAPGTTAGRLMTICATQPPYLPILVEENAHPQNEEYIQQNPRGMLYGDNIYRYNLLGELSRTGYLNEKNTYLNGSFAMNLDMEFLTKGLKAEVMFSYDASEGRWINRKLDTYKDGYREYPKYATFMPIEGSDAYMAGGHYTGAYKTGNKYDIDQTIGNGFSHNASDGRTYIQARLDYNRLFSNRHEVTAMLLANRGNRTVNNELAYHSQGITGRFAYYYNQKYLMEFNFGYNGSENFAPGKRYGFFPAGSIGWVVSEEEFMKKASWIDFLKVRASYGLVGSDNVSSRFPYLAFYGGGSGYDFGNNFGTNVGGTSEGNLANANLTWEKARKLNVGIDFTTLNQRLALTIDAFYEYRFDIITDMNSDGIMGYPDIVGKDAALQNLGEVSNRGVDIELSWNDKIGKDFRYYIRPNLTFSRNRLEYKAEVARKNSWRKETGKRLYENFVYVFDHFVADQEEADRLNKIGYQPWGQLIPGDVVYKDLDRNGVIDDEDRTAMGNPRSPELMFGIPFGFQYKNFDFSVLLQGATKSSILLNGAAVFDFPQFEQDKIGRVKKMHLDRWTPETAATAKYPALHYGTHDNNKNGNSSLFLYDASYLRLKNVEIGYNVSPKLLRKFHVQQARIYVQGLNLLTFDKLGDVDIDPETKSGDGASWYPIQKVFNFGIDITF

SEQ ID NO: 15889 - protein, 1007 aa, Psychromonas sp. CNPT3
MLNVQSLTKRTVAQIVVFALLLLNSTLAFAQSQVNGLVTDKTGEPLIGVNVVEKGTTNGVITDFNGQFTLNVAQGKTLVFSYVGYTTQEITVKGSSLKIIMEEDSKTLDEVVVVGYGSMSRKDVTSSITTVKADKLNIGVYSDPGQLLQGKVPGLTVVQSSDPTSGTASISLRGASSLRTGAAMEPYYVIDGIPGMSLSLIAPEDIESIDVLRDASATAIYGSKAANGVILITTKKGSKSEHTSVNYSAYLAFDNIAKRLDMMTADELRTYAKENNITLPNDKGANTNWNDEVLRTAISHNHNVSINGGSEKTQYSASMSYQNKQGIVRGTDFERFGGRAFLQTKALNDRLTLAFNMNAAQSKGTTVDSAKDGQSVFDAMNYYSPLVPVTNADGSWYSDKTISQNFNPVSMINEDTFENNKKLLQGTAKGTLDITKDLKWNLSLSYQDEQYIWNEYHTSKSQYNTRNGEAKRIATENKKKILETYINYDHTFANIHKLGLMAGYSWEQNDDNDSFGLDVYDFYNDNTTFYNLNLANKMDWQNGGITSNNNGHLETLRMISFYGRINYSFNSKYLLQATIRRDGSSAFGKNNRWGTFPSASLAWRMSEEKFIKDLNVFDDLKFRVGYGVSGNSLGFGAYSAIQTYSTSGWFNYTNANGTQNSYHTLAAASNANPDLKWERTAMLNIGLDFSFFGGRLGGTIEYYDKRTSDLIYTYEVSTNRYPFGTMPANVGDISNKGIEFTINATPIQTKNFSWQTSLNLSHNKNNVESISNSEYSVDYIRAADPEIAGYSSNADVQRIMEGHPIGTFYTYEWAGYNNQGVSIFYVHDPETGERTGETTTDPETDRDRTIIGCAQPDLNLGWSNNFQYKNWNLDLFFTGVFGQDIYNATAEQYSNVSFVKEGRNVLKSVATEHRATDTQSQAPSNRWIENGSYFRLSSVSLGYTFGKIGNWINSLKLYATCNNVFTITGYSGRDPEINLGGLEPGMDRRTNYYPRTRSFMIGLNVNF

SEQ ID NO: 15890 - protein, 710 aa, Psychromonas sp. CNPT3
MYRYLAGALALAPLSPAFAQTTDPARATSSDTDGEDTIVVTAARTQLPASALPLTVDIIDREALERQVLVSGSTVDAVSALLPSFSPTREKLSGSGESLRGRAPLYAINSIPQSTPVRDGSRDGYTIDPFFIDRVEVIYGSNALQGIGATGGVVNQITVGAPRKDGISFRTLSQVTLPDGFDGEGIGAKTGAFVGYRAGPLDASFGATLEKRGAFFDGSGNRIGVDGTQGEIQDSDSWSVFGRLGYDLANGARFEVVANRFELEGNANYVSVSGDRSANLPSTSERGETPGAPPSNTAELVSASLTDPDLAGGTFVLQGFYSRTSDVFGGGVFGTFQDPAIDPSGTLFDQSANRSRKLGAKVSYERALPGFEDLVLTAGFDALFDRTAQSLVQTDRVWVPQSDFRSLAPFLQGNLALADGLVRLAGGLRYENVELNVGDFTTLASYGSVDVEGGSPSFDDVLLNGGVIIEPVDGLRAYGSYAEGFTIADVGRILRGITQPGVDVDAFLSLEPVVSNNRELGLEWDEGALKASASYFWSSSDFGSLLVLRNDVFEVERQPIEIEGFEASLAWQTPISGLSLSGGYATLEGQTDADADGLVDEDLDGANMSPHRVSLAADYTSGRFSARAQARMYLEREFNDASTATDFEGYTLLDAFVSYRADFGEISLAAQNLTDEFYVTYDSDTVRVTDNSRFYSGRGRTLTLSLRSEF

SEQ ID NO: 15891 - protein, 352 aa, Photobacterium angustum
MKKTLLALAVPALLMAGSASATTVYTAEDGSTIDVYSRLGFNITDRAGMGEEGDSVGNFDARIGLGGSQVVNDKVSVIGWAEYQVNAAEARGNGDWSPRYVWAGIDASEAGKVTFGRVASGIIMLSDLGDVFAASDVVLGRQMELVDNSAAQTFRQDGTIQYQNSFGAFDMSVAYILGNSDSDQDGSYNAVGRYTFDLGNAGTLAPVIAYQANSTGENADNPDADYTFWGAGLQYKLNELTLAAMYNQDEIEGVYSDKSTDKSYELTAVYNINDDWTARMGYRSLENSGGDEAEYKDTTFEVQYHLTARSSIYTSYVMRNGENGKAVPASTNVMSWNDAEEDYYHLGLRYEF

SEQ ID NO: 15892 - protein, 688 aa, Photobacterium angustum
MYKKITILLSLVLASSLYACTKLDDVIVSANRSAQKLDDISKSVSVIDGDTIKRRQSTNLTGIIADEPGISYAPDGMSSGQIILRGFSTQNFRAPLFVDGNRFRGRNTLEYMLFDPNQIERIEIIRGPASSLYGTDSFGGVVNVITKRATGDVQAPFNITDTYISSEYQSVNHAIANRFQLGGVGDGFDILLGINYKDGDNYGTKEGVIPNSDYLYRGFDLKVGYSFLDTNRVELTARYTKVNRGRAAGQFASPGAGNAPGVLQRQMREEPMREKYLALGYSAQMQNGSLEASLYRRELYTHINVIPNLNSPQKWVDNYVIGPVVYGGKSIVAYSGESLSQTYGIDWYYESRDGSEQSVNGKNRIKSAPNSTQLNIGVFGLLEYGFEGGTLLSASLRHDYFKTGLETSFIKNNEIKKLFESAGDTSTNKTTSGFGMIYPLFGGLDFVLNINSSFRAPSVTEITAVGDGVSGVFTLPNSSIKPETGLSYETGLKYKDGLIISNLTAFTSSYKNLIVTRNITYKNTPARQLQNVGESSISGIEFDIAYKLLSNLIFKTNASYLYGEDKTSHKPLPQIMPLNGFISLMYEPKSIKKSYIEYTTQWASNKTRTDNLSERERSGYAVSNLYFGKEFGNMGAFKSVELNFGIENIFYKKYSMPSVPEDIRYPVSKTNPLLNPGRNFKIGLRASF

SEQ ID NO: 15893 - protein, 1259 aa, Photobacterium angustum
MNKHIKQTNRYLWSRRGTQTLLCGAALLVAPLVIAQDDEEDEEIFELSPFTVEGSEDQGYRATSTLAGSRIRTDLKDVGSAISVITEEFLRDTGAVDNSSLFQYTTSTEVGGIGGNFAGEERLGMLNPNANTRVRGLQAADNTRDYFLTDLPWDGYNVNRVDMQRGPNAILSGLGSPAGLVNNTTDSAIFEDEGEVQVRFGSYGSTRFHFNVNRVILEDELSVRVAAVKKDDKYRQEEAWAEDERFFVAMKYEPKFLKSESNTTTLTANFESGNINSNRPRTRPPVDRLSGFWEEDSEGRSQITGHPLALGGEETLDGSDDPAQYPPVYVRGVQQTGDAYFNQVNFNNPWYGENYTDGPIVYFANADQGDGDATYASVGGISASDNNILYTRLIDPNGDAEGPREVAIDAGGTGYPFYRAISSPAGLGAAARNLGLPLAQFGGYGNELLYDRSIFDYKNHLLDGDNKREFQDFQVSNVKLAQTFYNNRLGLEVALNKETYGFGQTSPFGWGPEITIDVNSHLADFSPNPNVGRPVIFRRTQGSSSDSVRDRDSSRYTVFGELREGDLFETDSFLGKLIGKQRLTGVKSSDDIILYEQGFKNWLADDTYRAYMGNSGLATNEAEVMAAVYLGPSVIGTSSPAGLNLQPVPKLNPNAINSIRIWDSYWSPTNPNAPTVDYLDSEWISPYQDDPSTQQNNPANYTGWRDHPASFLIDTEGDRLSLITSARSSSQEIESEAFVWQGFFWDGAVVALYGNRDDTTTQINVTAPRIPGDPREIFDPTGATPFQSGGSYLAYTEADALAERARNEALGSVNKFEGSNESKSVVVHLDQFLPELPASTKFSVFWNESSNFQPGEARVNHLNQPLAPPNGDTEDYGFVISTFNDKLTLKLNRYESTVYGSTYDPTDGALWYVGTAETSLFAAGMRDLVVIEGNTPGWDDSWRTYGQQNPYQVGDVPYDNWLRSQGIPESEWADQTVEEADAWMARATANLRENLAPQEFWDAWGATQSDARWQNGWWDPWSESTGVQPNGFTSTSDITSKGTEIEVNFNPTENWNFAMNAAKTEAVRNNLAGSLKEWVSARNEVHNGDNGDIRLWWAGDRNNTLKTRWNNDFYSRYLLGLATEGTAVSELREWRVNMVTNYNFRDGKFKGLNLGGSVRWEDEVGIGYEQTEGVNEDGVPVLVYLSDSPIMGPTETHLDLWAGYSLDLNDNVNWRIQLNVRDVLSDGGLVPISVNPDGSVREYRVQGDPNWFLTNTFSF

SEQ ID NO: 15894 - protein, 379 aa, Photobacterium angustum
MKSSWIDVAAAPVGSRAHRPGKFDEEKQMKGWFRMAAWCGCSAVAPAFAQSSVTLYGSLDTGVTYTSDVASAPRGGRQLALQAGVSRNDVWGLTGREDLGGANFAVFRLESQFQTSDGALTVPGSAFSSQAYVGLGGDWGTVTLGRQFDFVGDLLPAFAIGANTPAGLLAWGLPANASAGGALDNRVWGVQVNNAVKYVSPTFGGVAFGGMWGFGNVPGTVARSSVQSAMLSYTQGAFSAALAYFGQHDVTAGGNLRNFSGGAGYNVGPFRVFGMVSDVRISAAAPLRATTYDAGLTYAVTPSLQLGGGFQYQQRGGDIGSANQVTLSADYSLSKRTGLYAVFARGHDSAYGAQVEAALGGAASGSTQTAVRLGLRHQF

SEQ ID NO: 15895 - protein, 326 aa, Photobacterium angustum
MKKTLLALAVLTAGSANAGINLYDANGVKVDLSGATEVQYREDYDPSKDAELRIDDADLAINTTVAISEQLNVVAGTAFEYEDGDVRNDELWAGFGGDFGTLTFGRQYLISDDSGVGKDYELGSESVDFVQTNGNEVIKYVYDNGTFYFGASHDLKDSGDVVDKDGNVFANDDTSITDARIGYRVAGLDARVYYYTGDHVAGTTFDKDGYVDVDGYNVEAEYGFGSVGLAASFGQVKYKNAYGVDLLRANVYQVAADYTIDKTTFAIGYNNYDRRDEAGDNYAVYANVTQQLHSNVKVYAEIGNTDAKFDGRDADFGYVAGMEVKF

SEQ ID NO: 15896 - protein, 690 aa, Photobacterium angustum
MNKKPLVIAVTFAIFNATSVGAYAANNQAVTELEEVLVNATRIDESLAKSSRAIVKISAAQLEESQPSSAAQALKHEANITVTNGPRPSAQGVEIRGLSGNRVLQTVDDARQNAGSGHRGTYFIDPEMLKSIEVLKGPSSSLWGSGAIGGVVAQYTKSAQDFLEDGEHFGGYLKQGYETNGSRTKTSGSIYGVQDSIDWLVNGSYLDSNNIKIGKDESLNNSASQGHSALGKLGWQLDDAQRLELSLRSNNSNELVPSNPSAEVSRSVPLVRRETTDNNLSLVYELNPSDNAYLDAKALIYVNQTDYDENRVTKGQIDATEFNTLGLSLSNKSIFGAGLGRTELVYGVDGYKDTIETVRDDKGQTGQRPGNIDGEVSTLGVFVVGKVSLSDTVSVEPALRYDSFSNQSNNLGLETDDSAVSPSLALVWQSTPWLNLSARYDQAFRAPSIEEMYSSGSHYCIPPIPRFLPNGMCNTFAINPDLKAEKAKNKELKADFSFSELSATGADDELNLTLSVFRNDVDDFIVQSVSNPLMGIPGFEQTTSWNNVSSAELTGFEISSRYRYNQTRLSVNYGQTQGKDADTNEYIANIPANKLSLDLSQGIMEGDVKLGTRLSYVASQTDVPLDNNVAQYDDYKLWDVYVAWEPSMGDLAGLRVDFAIENIGDEQYKQAWQTLFEQGRNMKLSARYQF

SEQ ID NO: 15897 - protein, 219 aa, Photobacterium angustum
MMNKNIVSTVIAATLLAAGFTASVSAHQAGDIIVRAGAVVVAPNESSQDVVIPSANLGEFKVNNNTQVGLNFGYMLTDNIGVELLAATPFSHDVSLAGVGKIAETKHLPPTLVVQYYFGDAQSKLRPYIGAGVNYTKFFDNKFTNDLGGDLTNLDMSDSWGLAAQVGLDYQVNKNWLVNGSVWYAKIDTDVEFKYKGAPVKIETDIDPWVYMISVGYTF

SEQ ID NO: 15898 - protein, 291 aa, Photobacterium angustum
MRKSLVALSVLAATALPAVVSAADYSDDIHKNDYNWMQFNLMYAVNELPGESDHDYLEMEFGGRSGIFDLYGYVDVFNLTNSKSSDKNGEPKIFMKFAPRISLDAVTGKDLSFGPVQELYIATVFEYGGDAGYTGVLTNGDGTAQLDSDGKPQYGAAKGPNNAKVGLGSDVMVPWFGKVGLNLYGFYDMNEKDWNGYQISTNWFKPFHFFDNGSFISYQGYIDYQFGMNNDVPGLTSSNGGAMFNGLYWHSDQFAVGYGLKGYKEIYGLKDGGFAGKTTGIAHYFDVTYKF

SEQ ID NO: 15899 - protein, 1112 aa, Photobacterium angustum
MELNLKTQQNKLISLFRVSLMFFLFFFVQQTVASSQSITLPSHNITIKDAFSEIEKQTGMSVDYDESVINLNKQVNASVNNKSLNETLALILKESGCTFVIRNNHIIISAQTVQQQQKQVTISGTVSDNLGPIAGANVVEKGTTNGIITDMDGNYTLSVPQGAVIQFSYIGYVTKEITVDSQKNINVQLAEDAQKLDEVVVVGYGTAKKSDLAGSVVRADLGTLQESPNISLGSALQGTVPGLNVSSVSEAGKDPDMSIRGRTSISGGNSPLIVLDGIIFRGNMVDINMNDVESIDILKDASAAAIYGSEASNGVILITSKTGKVMSKPTIEYSGSFSYQQPTNKDMYPEGRDGFLRKIADRFLEESRIGDDMLQPNPNWDPTSHLMDRNALDGYENGTETDWWNMLTNKTPYIQNHNLSVRGKNELSSYFFSMGYTDQKNLVINDTYKRYNIRINMDTKITSFLKVGVQSFFTVSDYSGESPDLSTVVGLPPIVAATDENGDYIREPYKNSLNPLLTIQQDDTNKRYNLFGNFYADIDFPFLKGLNYRMNFSQNLIENKIYNFNKWGANFTGSGSKENNSEYNWTVDNILSYKNKFGKHAINATFVYGVEKRQYEMTKAGATNFSNDILGYNKLDAGQADLQTAKSGAWTESSLYTMLRAIYTFNDKYIVTGTVRRDGFSGFGKNHKFGVFPSAALAWRISEEDFFKNNVDWMENLKLRLSYGQNGNRTVGRYQTMAQMGAGVGSVKVDDSTVNAGYLFGDGVSAEQMQWIKSLANADLKWETTNTFNIAADFSALNSRIFGTVEYYTSQTNNLLFNINIPQMNGLDKIPSNIGKMSNKGFEMTVTGIPIETKDFSWDVTFNFSRNRNKVKSILGIDADGDGREDDLISDKIFINHPYGVCYDYNIIGMWQIADKQNGLIPDGFEYGTYKVEDVNNDGKYTADKDRKIIGYSDPAYRFSIQNSFRYKNWEFKFMINSVQGGKNYYYGQPGKDLANPDNIYQNNLFNFDYWTPENPNARYRQLGYYTQALGYTFSPYVQRSFVRLQDVTLSYNVPASFLSKFKVNRLKLYVTGKNLLTFTDWDGWDPETGTGLNTSKYPVMRSYSIGLNLEF

SEQ ID NO: 15900 - protein, 326 aa, Photobacterium angustum
MKKVAIAVAAVVAGGLINSAQAEMYIGGKVGMTTLDDACYLNSPCDDDAFGAGMHIGYDFTDIIGLEYGVDYLGDYKANFKSGANTVDTIDGDLWALTLAPKFNWHLNDTWNLFAKIGGAYMISGDEKDFVPTGSLGAEYTIDKNWSVRAEYQRYQDISDDVLDDMDANFFGIGFNYKFAAAPVVAAVVTEEVLEEEPVMMTKTHKEEYGSGTFEFDSAKLTDSVSERLDNFVNFLNEYPQAQVEITGYTDSSGPAAYNQKLSERRAQAVADYLIAAGIDADRFTVTGMGEENPVADNSTHEGREQNRRVEVVVPEFQYEELVQPE

SEQ ID NO: 15901 - protein, 688 aa, Photobacterium angustum
MLKFTIPALAVGAMTAAAAATEAARAAAAPTDDAAVLLPPVEVVASPLTTPLVIVTDPKTPRQPLPASDGADYLKTIPGFTSIRSGGTNGDPVLRGMFGSRLNILANGMPTLGACPNRMDAPTSYIAPESYDKVTVVKGPQTVLYGPGASAGTVLFERVTPRFERPGMRFDGSVVGGSFGRNDQNVDVTAGTPDVYGRVSANHAHAQDYQDGNGNTVPSQWDKWNADAALGWTPDDHTRVELTAGTGDGYARYAGRGMDGAHFRRETFGLSFDKRHLGDVLDRIEARVYYNEADHVMDNYTLRQPDPTSSMPMRMASEVRRRTLGARAAATFRFGDDFKLVTGVDAQSNRLDARSAMGRQNYGDQPWDAQATMWNAGAFGELTWYASEASRVIGGARVDYVSARDKRATTSGMMASKPNPTFDDDRARVLPSGFVRYERDLASLPVTWYAGVGHAERYPDYWELFSAKRGPAGSVNAFSAVQPEKTTQLDIGAQYKSERVDAWVSAYAGYVQDYILFNYAAGMMGPTTQATNVNAQIMGGEAGVSWRPVAPLRVETSLAYAWGRNATSGDPLPQMPPLEARFGLEYTRGAWSAGGLWRIVAPQHRYALNEGNVVGKDFGPSAGFGVLSLHAQYNVSKKVQISVGVDNLLDKAYTEHLNLAGNAGFGYPANAPVMEPGRTAWVRVSAKL

SEQ ID NO: 15902 - protein, 417 aa, Photobacterium angustum
MKKLLLVLTIAFSASVMYAGGYRVGVQGHKQLAMGHTGVAVVTSAESAFFNPAGLVYLDGKLNVSLGAAAVLSNTSYQNREFGYTSEADNPVGTPFYAYGSYKITDWLSAGIAVYTPYGSRVEWPTDWEGSHLVNNIELSAIFVQPTISIKLSDKLSVGGGPIYVTGAVNFNRNLSRSLTDEEGNRSNVTIDASGINAWGYTVGAMFRPTENINLGFNYRSKIDMNVERGDGTADFENLPGALAPGFADGDFTASLPLPAELTFGASFKPSDKWLIAFDYTRTFWDAYESLDVQFFNAAGLSRNPRNYKNSSIYKIGAQYDATQKVTVRAGFYFDESPIRDGFFAPETPRPDSVNFTAGFSYNLNSRWAIDASVLYVHSNEIENSYDYFVEAGQRTSFGGEYKSNALVAGIGVSYKL

SEQ ID NO: 15903 - protein, 745 aa, Photobacterium angustum
MNKIIKVTLIPLSLLTCNVYATDITTVQEVVITAKRESSLNEANIEISNQKIDDEMVGDINDLVKGELGVSVVQKGRAGTSGFNIRGVDEDRVSILVDGIHQGESFENDIYKGYGYFNGSINDIELDAIKSVAIKKGSDSLFTGSGSLGGAVSFETKSAEDIILPGNDYGFYNKTMYGSKNNELKNTTGLAFKKKYGDLLVLYTDVNGHELETRDEGIDIYGKSRSRADPIDKKSFNLLVKSTLTPNENNNVILTYEQFSTQKDIDEKSWELFGSSHRIIDSSGDRSRYSLEWEYLSNHIYLDRLSTKIYNQKIDQTDNSYVYYFKDEKLSQHYERSIKQDSFGIEQKATSKNYEVLSIPMINYFMIGYKRKKLQNDNVDISIIGGKSYVSENSIIEPVETDSFYIAGTHEMIVSESELISFGARYDFFQNDVTLSGKSISNHLYGTSLDAPEDTKFSGITLSAIYDNQLTDKINVKYKINSGFRAPNANELYFSFGDKVAANRIEPNENLKQETGITNEIHFEYVEDDWQFYLNPYYTKYHNFIDLKSETIKVPNPWSAYPGQPEFNDQNYMQYQNVDEAYIYGLDMRFDMNLSTFLDIYDDLKYQTGISYSKGKGSDGDYLMGVNPLEIMNNIIYTTYDYRIGFYSNFIDKKDPKETVRNGKQSKYTSDSVLLMDLVINYTMTKNIKINAGVFNLLDKKYKTWDSVRSIPEFGSTNMVDSDGVGLNRFTAPGINYKVGLAINF

SEQ ID NO: 15904 - protein, 614 aa, Photobacterium angustum
MTFKIRPLSLTLGFCLGTSTVYATPQSLDKIVVSANKAEQKTPSVTANITIITADEIEQKHYQTLDDALKTVPGLAIKKSGGAGQQTSIFVRGASSSDRQVLILQDGIELTDPSGFGASIANIQLSSVERIEIIKGPQSGTWGANASAGVINIITKKGGKQASVNLKAGSFNTKQLSSTLGAGNDKVDFLVHFNQHTTDGFSVIRKYDESQAQFENDAFKQTDVGFKLGLTPVKNHRFETTVNKTSATADYDSGSNPDDATSNSAYDSTTRQLQYVYSGQAVNTKLFVQDHHIERTLNDTSYGTSQYEASIEEYGGQATFDYRSTDQLTLSANSKNYRDIDKKRTFYNTGVGINNTNTLTENLVLTEALRYDDFNRFKNATTGKIGIKNNFSTNVFISANYGTGYNVPSLYQLSTNNPEQLKPESIDGYDVTLGAYNATLTYFKSTTQDLITALGSWPSNYYANASGKTLNEGVEFAYQRSIDSLEADVSFNATWLNARNKDNQVLAYRPEQTANLTLDYYGLPQTQIGLVTRYTGTTYSADNQKGAQIGEYFVTDLTANYQVNRHVSLYGQVLNLLNQQYVEGVVDYPATNPVPNYVYSTGGIQAFVGVKGEL

SEQ ID NO: 15905 - protein, 429 aa, Photobacterium angustum
MSVNKRFLTVSIAAALVSSFNVQAAGFQLNSQSATGLGRAFSGDAVIADNASVVAKNAAAMALFDRPAMSLGLTVIDTDIKVKNTSLAITSPLGTQSFGVNDASIGGVSYVPNIYYIHPINEKIAVGASLYSNFGTLTEFPNGYGGAVPSDIFGGTTEVKSLNLGLSASYRLNKQLSLGAGIDVIYGSGKFTRGRGLSPLPSSVTGTSDLVDIDADGFALGFNLGSVFEVDDNNRFGLTYRFSPTLEAKGDMTYIPNASLGKPYDLSGEKLKMPLPDMAEFSGFHKLNDKFAIHYSIQWIGWSSFDKLETTGGTVIKDYEWQDGWHYAIGGTYYLNNDWTLRAGYMHDTSAQDQMTSISVPDSDRNWISGGFTYHLDSKSNIDFGLTYLMGKDVDVKEQSALSTTTLGTLTATTRANAWLYGIQYSRSF

SEQ ID NO: 15906 - protein, 369 aa, Photobacterium angustum
MSIKARTSRRQCSAQRVSVRFTAASALAVACGLASAQSGVTLYGRVAGGIDYTNKIDTGSSQSAGRLQYGSNQWGTSMWGLRASEDLGGGLKAVMNLENGFTSADGVASGGLFNRYAVAGLSSSTYGTLLVGRAMGIPDSEVYTIDPMGLQFMSAATFQGNRTWGSRTKAITYNSPVWGGWSFRAQAGLNGTAGNFNAGRQLAASIGYQNGPLMLKGFYEDIRDSAGQFTNLYTASRLYTAGGTYQIGDAKLFGGYSQIQSSGNTIADADNPTGATRQQTYWIGTNYQMTPAATLVGGVYRTHRNHGGGTGTLLTLGVNYALSKRTLLYGTVGTVLNGKQSTFSVEANGGKPAAGASQQGVYTGIVHVF

SEQ ID NO: 15907 - protein, 679 aa, Photobacterium angustum
MNKQLTLIASSLVAALSPSVYASNDVSQFDEVVVSASRVDETNQDKTRTVAKVSSEELDEMQVNSVAEAVKFIPNVSVAGGNVASNQSINIRGLEGNKVLQIIDGNRQNAQFDHRPSFFLDPTLISDIEVVKGPVSSLYGSGAIGGVVIQNTITADDLVEDTGFGGKVKTGYQSNGNVVTTVGAIANKQDNVDWLLAGSYQDSGVMEQGNGYKLYGTEAINKTGLAKFNWQFTDSQSIGLDYRISDYDGHPPVVGSDEPLITEDKLIDRTSTDQNITLKYAYNPESNLIDSAFRIYRNDTDIKELGNGSSEKDISSITTKGFSVTNKSDLDRFQVFIGADGYEDKLDTKRPVTTSGRPTPPDGAKATTIGSFAHVNYSLLESLELDAGLRYDTFESKAEGFENNKQDAWSPSVGANWQATDWMAWSLRYDEAFRAASTSELFMDGTHFAMGPITNVFVPNPNLKPEQAHNIELKGTFNFDHLIGDDELLITASVFQNKVKDFINLDVTVPSRSEMMACMMANHGSGDGCGGTSTSNNIDNAKLKGFEVVAQYRYDRLNTLLSYGQTRGKDEKTGEWLSNIPADKWVAQVDYGIWEIDTKVGTRAIFASTQDRRPKDNNEGPYKSYELVDFYASWEPTSNMEGLTVDFTVANAFDENYRTPWTQVYEPGRSYKISAEYKF

SEQ ID NO: 15908 - protein, 797 aa, Photobacterium angustum
MSTKTLLYNNQMNNLKFLLLLATWIGGIVGNQAHAQSRKVTLSGYLKDAQTGEGLIGATVFVKELASGTVTNTYGFYSLSLPKGKYTVSFSYIGYVAQTQKVNLQTQQTLHVELAEEVAQTDEVVITAEKLDKNVQSMQMSVQKISAKQIKSIPTFGGESDIIKVLQMTPGIQSVGEGTTGLFVRGGSADQNLILLDQAPVYNASHLMGFFSVFNSDAIKDVEVYKGGMPARYGGRLSSVVDIKMNEGNSKQFSGSGGIGLISSRLTLEGPIAKDKASFVVSGRRTYADMFLRLSNDKEIKDNRLYFYDLNAKTNVKLGENDRLFLSGYFGQDVLSVGNNFGFSWGNATSTLRWNHVFNSRLFMSTTLLYSRFNYSLFVNEGVQNFEWTSQLQNVSGKFDFSYFVAPELQVDFGYHNIYHTFSPGKLEPKGTSIFKKLEVPQKYALEQAGYISIDHKLTPALSLQYGLRFSAFSNIGKDRIFTYTKDAQGNSVATDTTHYGSGELYHTQMGFEPRIGARLLLNARSSVKVSYNRTRQYIHLASNSSAGFPSDVWVPSDPNIKPQIADQVGVGYFRNFHDNMYEFSVEGYYKWMQNQIDFRDNANLLLNEAISQELRPGEGWASGVELMLRKNKGNTTGWVSYTLSKTERKAAGINNGNPYAPRHDRRHSFNLIVNHEFSPRLSLALNFTYATGASVTMPAGRYIIDNKTVPYYTERNGYRMPAYHRMDLSLTWKRPQKRLFGKKFQGEWNLSIYNAYARKNPFSIQFRENENNPGKTQAEMTYLFGIMPSISYNFKF

SEQ ID NO: 15909 - protein, 189 aa, Photobacterium angustum
MKKILLPLALVLTTASGAALADQTGPYIGASVGNATTDLKADHWEYNYDENVLAYGVYGGYNFTENLGLEATLGQTGEQDNIKKGYATLTPRLMMPINDQLSLFAKAGVAYVAVDGDYDGAGDINRHDIDVDGFGWTAGAGVNFAVAEHVDLRAGIDYLSTDLEKADNDKDLNIDSETTMYYVGVNYNF

SEQ ID NO: 15910 - protein, 495 aa, Photobacterium angustum
MKNYLEPVPRKLRVNALATLLLSLAATPAFAQASSSAATEPAAGASDAAAPAQQAADAAAPAPTGFWERSNLLGNMGGLRDVLGDHGITLSLQETSEYLYNTSGGTNRGGAYQGLTQFGFNVDTGKAVGLPGGTFNVSALQIHGTNLTQRYLQTLQTATGIEANSTTRLWELWYQQSLLDGKVDVKVGQQSVDQEFMVSQNAATFMNATFGWPVLPSTDLPAGGPAYPLSSLGVRLRVKPSDAWTAMIGVFDGNPAGRSDGDAQVLNAHGTNFNLRSGAFVIGEVQYALNAPPADPKAPQPAGLPGTYKLGFWYQTQHANDPRYGTDGLSLANPESNGIAATHRGNYSFYAVADQMVWRPSADSPRSVNVFARVMGAPGDRNTVDFAANAGVTLKAPFKGRDNDVAGIAVGYAKIGSHARGLDGDTGVYTTPGYPVRRAETVVEATYQYQVTPWWQMQADLQHFFRPGGGIPNPNAAGARIGDETVVGVRTTITF

SEQ ID NO: 15911 - protein, 355 aa, Photobacterium angustum
MSKARFAILPLALLISGAVNAATVNPFYAGVRAGGVHYSDFDSKNYANGTYDQELQNRNAIDRDDFAAGLFMGYNVTPWFAIEGGYTWLGEATLKGDEHHNLGKVEQQAIDLVGKFTYQATDKVDLYTKVGGAWQFTRAKVEGVGSDRDDSLIATAGLGAEYHFTDNLSARAEYQYYHNMETKPTGTDTKFNWDANYYGVSLVYGWGAPAPVVAPVVEEVVEATTVQVEPVTVSIPFAFDSYKITHADKERLAPIAKRLQDNPETELVVVGHTDSKGAEAYNQKLSEERAQKVATFLMNEYNLDSSRVRAEGRGELNPVASNKTEAGRTDNRRVDVTASGYEIVQEAGSTVTVEQ

SEQ ID NO: 15912 - protein, 112 aa, Photobacterium angustum
MSKKYIALLPFALVVSSAVSAATVNPFYIGARLGGAHYSNFQQNYQDITGINLNKDDVATGVFTGYNFTPWFAIETGYTWLGEAKFENNKIKQQAIDLAAKMTWNLNDQWGL

SEQ ID NO: 15913 - protein, 700 aa, Photobacterium angustum
MFSKSQLALVISAVLSTPFAYAETDASTTDEHMVVTGRDYGYKADTNSSSMRMEATQLETPGQVSVIDEQLIDEQRASTLGEVLKNDASIGAGATTRNREQFTLRGFSLSSSSGFLRDGKQHWSHYRQPIELLDRVEILKGPSGLLYGQSAPGGLVNMVAKKPTYETQVSVSQDLGSNNDSRTTADVSGALNDDQTLRGRAIVSKQTYNSWRQYSDGTVPSTERFVGGLFLDYDINDDITVSFHYDRTIDEGSVDSGAYIKDGKTVVNDKYIWDAQWSKIENDVENIGVDVTANLTDVWRINASFNHQDFNRHDVESFPKEETYNPATGEYVQGGSDRKDNWVFKTASIDLIGEFDALGVSHQMLFGSNWLGYRYDRLEYSFNSSVGQVGEPAPAPERNPNKDPRDTTSKYDTWGFYAQDMITFNEQWQALVGVRLDRQVEEGLAEEAVSPKFAVIYHPMDIGSIYATYSESFEMQGEVSGSEYVNDGQKLDPLRGKLYELGTKWELMDNQLFVSGAVFDITQENSTIDVDLGGGKKEKTQSGERVHRGVELAMQGFITEQLSMSGSATYLDAEYAKDEKYEGNRPADVPEYTASVWTRYAFTNSTDANLGAIYVGERYGDAANTFKKDGYARFDLGLSHTIKYDQDLTFVARFNVENLFDTDYLAGGGSTGKNGYATDGASNVVIGEGRNYMATLQVKY

SEQ ID NO: 15914 - protein, 82 aa, Photobacterium angustum
MPVYLCKTSLSGMLRDPQLLMLWLRLGDESVNASIDGAAFRVGAGVQADITKNMGAYASLDYTKGDDIENPLQGVVGINVTW

SEQ ID NO: 15915 - protein, 179 aa, Photobacterium angustum
MRLKTAFTLLSLTLLSQAAVANENIIGGSIGYGTQNFNLKYDANDGDTVAFDIYYRHMLSDYMGIEAGYTRSYDGIFSDFTSLLSSADVSSYGGPRLSLYGQYPLSHGNALYAKVGVAYHDVDYKMKNVKHNESKVGADLQVGWEKRFHNGMGINVGYQFADSSILTMNNFYVGTSYRF

SEQ ID NO: 15916 - protein, 213 aa, Brucella abortus
MRTLKSLVIVSAALLPFSATAFAADAIQEQPPVPAPVEVAPQYSWAGGYTGLYLGYGWNKAKTSTVGSIKPDDWKAGAFAGWNFQKDQIVYGVEGDAGYSWAKKSKDGLEVKQGFEGSLRARVGYDLNPVMPYLTAGIAGSQIKLNNGLDGESKFRVGWTAGAGLEAKLTDNILGRVEYRYTQYSNKNYDLAGTTVRNKLDTQDIRVGIGYKF

SEQ ID NO: 15917 - protein, 377 aa, Neisseria meningitidis
VLSALPLAAVADVSLYGEIKAGVEGRNIQLQLTEPLQNIQPQVTKRKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPAHFVQQTPKSQPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 15918 - protein, 381 aa, Neisseria meningitidis
VLSALPLAAVADVSLYGEIKAGVEGRNYQLQLTEAQAANGGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPIQNSKSAYTPAHVVVNNKVATHVPAVVGKPGSDVYYAGLNYKNGGFAGNYAFKYARHANVGRNAFELFLIGSATSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 15919 - protein, 379 aa, Neisseria meningitidis
VLSALPLAAVADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPEFSGFSGSVQFVPAQNSKSAYKPAYWTTVNTGSTTTFVPAVVGKPGSDVYYAGLNYKNGGFAGNYAFKYARHANVGRDAFELFLLGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 15920 - protein, 377 aa, Neisseria meningitidis
VLSALPLAAVADVSLYGEIKAGVEGRNIQLQLTEPLQNIQPQVTKRKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPAHFVQQTPKSQPTLVPAVVGKPGSDVYYVGLNYKNGGFAGNYAFKYAKHANVGRDAFELFLLGSGSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 15921 - protein, 381 aa, Neisseria meningitidis
VLSALPLAAVADVSLYGEIKAGVEGRNIQLQLTEPLQNIQQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNKQNQPPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 15922 - protein, 380 aa, Neisseria meningitidis
VLSALPLAAVADVSLYGEIKAGVEGNNIQLQLTEPPSQGQTGNKVTKGKSRIRTKISDFGSFIGFRGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPATLANGANNTIIRVPAVVGKPGSDVYYAGLNYKNGGFAGNYAFKYARHANVGRDAFNLFLLGRIGDDDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 15923 - protein, 381 aa, Neisseria meningitidis
VLSALPLAAVADVSLYGEIKAGVEGRNIQLQLTEPLQNIQQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNQQNQPPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 15924 - protein, 381 aa, Neisseria meningitidis
VLSALPLAAVADVSLYGEIKAGVEGRNIQLQLTEPLQNIQQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNKQNQPPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 15925 - protein, 179 aa, Neisseria meningitidis
VLPFKTRIDGIEYKKGTKVHDPLKASFIAGGAAFGYKMDDIRVDVEGLYSQLNKNDVSGATFTPTTVANSVAAFSGLVNVYYDIAIEDMPIAPYVGVGVGAAYISNPSEASAVKDQKGFGFAYQAKAGVSYDVTPEIKLYAGARYFGSYGASFNKETVSATKEINVLYSAVGAEAGVAF

SEQ ID NO: 15926 - protein, 385 aa, Neisseria meningitidis
VLSALPLAAVADVSLYGEIKAGVEGRNYQLQLTEAQAANGGASGQVKVTKAKSRIRTKISDFGSFIGFKGSEDLGEGLKAVWQLEQDVSVAGGGAIQWGNRESFIGLAGEFGTLRAGRVANQFDDASQAIDPWDSNNDVASQLGIFKRHDDMPVSVRYDSPEFSGFSGSVQFVPAQNSKSAYKPAYWTTVNTGSATTTTTFVPAVVGKPGSDVYYAGLNYKNGGFAGNYAFKYARHANVGRDAFELFLLGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 15927 - protein, 380 aa, Neisseria meningitidis
VLSALPLAAVADVSLYGEIKAGVEGRNIQLQLTEQPSKAQGQTNNQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYKPAYVDEKKMVHAAVVGKPGSDVYYAGLNYKNGGFAGSYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 15928 - protein, 379 aa, Neisseria meningitidis
VLSALPLAAVADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 15929 - protein, 354 aa, Candidatus Wolbachia brouquii
GEIKAGVEGRNYQLQLTEAQAANGGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVRSQLGIFKRHDDMPVSVRYDSPDFSGFSGSVQFVPIQNSKSAYTPAHVVVNNKVATHVPAVVGKPGSDVYYAGLNYKNGGFAGNYAFKYARHANVGRNAFELFLIGSATSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQI

SEQ ID NO: 15930 - protein, 180 aa, Candidatus Wolbachia inokumae
YNGEILPLFTKVDGITYKKDNSDYSPLKASFLAGGGAFGYKMDDIRVDVEGVYSYLNKNNVTDAKFTPDTIADSVTAISGLVNVYYDIAIEDMPITPHVGVGVGAAYISTPLKDAVNDQKSKFGFAGQVKAGVSYDVTPEVKLYAGARYFGSYGANFDKSGGEKDKGGHTVLYSTVGAEA

SEQ ID NO: 15931 - protein, 198 aa, Wolbachia endosymbiont
GPISDEETSYYVRLQYNGEALPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARYFGSYGANFGKTAKDDGGIKVLYSTVGAEAGVAFNF

SEQ ID NO: 15932 - protein, 197 aa, Wolbachia endosymbiont
FGPISDEETSYYVRLQYNGEILPLFTKIDGIPNATGKEKDSPLKASFIAGGGAFGYKMDDIRVDVEGLYSWLNKDADVVGGTVADNLTAISGLVNVYYDIAIEDMPITPYVGVGVGAAYVSNPLAKKVTDDKASGFGVAYQAKAGVSYDVTPEVKLYAGARYFGSYGANFGKATKDDAGIKVLYSTVGAEAGVAFNF

SEQ ID NO: 15933 - protein, 201 aa, Wolbachia endosymbiont
FGPISDEETSYYVRLQYNGEILPLFTKVDGITYKKGDSDYSPLKASFIAGGGAFGYKMDDIRVDVEGVYSYLNKNDVTDAKFTPDAIADSLTAISGLVNVYYDIAIEDMPITPYIGVGVGAAYISTPLATAVSSQNGKFAFAGQARAGVSYDVTPEVTLYAGARYFGSYGANFDKTDKDGKGELKVLYSTVGAEAGVAFKF

SEQ ID NO: 15934 - protein, 203 aa, Wolbachia endosymbiont
FGPISDEETSYYIRLQYNGEILPLFTKVDGITYTKDNSDYSPLKASFLAGSGAFGYKMDDIRVDVEGVYSYLNKNNVTDARFMPDTIADSVTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYSTVGAEAGVAFNF

SEQ ID NO: 15935 - protein, 202 aa, Wolbachia endosymbiont
GPISDEETSYYVRLQYNGEILPLFTKVDGITYKKDNSDYSPLKASFIAGGGAFGYEMDDIRVDVEGVYSYLNRNDVTDAKFTPDTIADSLTAISGLVNVYYDIVIEDMPITPYIGVGVGAAYISTPLKDAVNDQKSKFGFAGQVKAGVSYDVTPEVKLYAGARYFGSFGAHFDKDAAAGKDKGELKVLYSTVGAEAGVAFNF

SEQ ID NO: 15936 - protein, 201 aa, Wolbachia endosymbiont
FGPISDEETSYYVRLQYNGEFLPLFTKVDGITYKKDNSDYSPLKPSFIAGGGAFGYKMDDIRVDVEGVYSYLNKNDVTDAEFTPDTIADSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEAGVAFN

SEQ ID NO: 15937 - protein, 197 aa, Wolbachia endosymbiont
FGPISDEETSYYVRLQYNGEILPLFTKIDGIPNATGKEKDSPLKASFIAGGGAFGYKMDDIRVDVEGLYSWLNKDADVVGGTVADNLTAISGLVNVYYDIAIEDMPITPYVGVGVGAAYVSNPLAKKVTDDKASGFGVAYQAKAGVSYDVTPEVKLYAGARYFGSYGANFGKATKDDAGIKVLYSAVGAEAGVAFNF

SEQ ID NO: 15938 - protein, 196 aa, Wolbachia endosymbiont
GPISDEETSYYVRLQYNGEILPLFTKVDGIAHKSGKDNNSPLKASFIAGGGAFGYKMDDIRVDVEGLYSWLNKDADVVGDTVAESLTAISGLVNVYYDVAIEDMPITPYVGVGVGAAYISTPLATAVSSQNGKFAFAGQARAGVSYDVTPEVKLYAGARYFGSYGANFDKTDKDGKGELKVLYSTVGAEAGVAFNF

SEQ ID NO: 15939 - protein, 202 aa, Wolbachia endosymbiont
GPISDEETSYYVRLQYNGEILPLFTKVDGITYKKDNSDYSPLKASFIAGGGAFGYKMDDIRVDVEGVYSYLNKNDVTDAKFTPDTIADSLTAISGLVNVYYDIAIEDMPITPYVGVGVGAAYISTPLKDAVNDQKSKFGFAGQVKAGVSYDVTPEVKLYAGARYFGSFGAHFDKDAAAGKDKGELKVLYSTVGAEAGVAFNF

SEQ ID NO: 15940 - protein, 200 aa, Wolbachia endosymbiont
FGPISDEETSYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYST

SEQ ID NO: 15941 - protein, 195 aa, Wolbachia endosymbiont
FGPISDEETSYYVRLQYNGEILPLFTKIDGIPNATGKEKDSPLKASFIAGGGAFGYKMDDIRVDVEGLYSWLNKDADVVGGTVADNLTAISGLVNVYYDIAIEDMPITPYVGVGVGAAYVSNPLAKKVTDDKASGFGVAYQAKAGVSYDVTPEVKLYAGARYFGSYGANFGKATKDDAGIKVLLQHCWCRSWSSV

SEQ ID NO: 15942 - protein, 201 aa, Wolbachia endosymbiont
GPISDEETSYYVRLQYNGEVLPLFTKVDNMKIKKGTDDVDPFKASFIGGGAAFGYKMDDIRVDIEGLYSQLNKNVNNDEVLTPDTVAGSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEAGVAFNF

SEQ ID NO: 15943 - protein, 210 aa, Wolbachia endosymbiont
GPISDEETSYYVRLQYNGEFLPLFTKVDGITHKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNGQKSKFGFAGQVKAGVSYDVTPEVKLYAGARYFGSYGANFDGKKTDPKDSTRQVTDAGAYKVLYSTVGAEAGVAFNF

SEQ ID NO: 15944 - protein, 206 aa, Wolbachia endosymbiont
GPISDEETSYYVRLQYNGEVLPLFTKVDGITGLKKNATDTADTTDLYNASFIAGGGAFGYKMDDIRVDVEGIYSWLNKDTSVTGTPAPVGGVANNLTAISGLVNVYYDVAIEDMPITPYIGAGVGAAYVSNPLATKVTGDKDSGFGVAYQAKAGVSYDVTPEIKLYAGVRYFGSYGANFGKATKDDAGIKVLYSTVGAEAGVAFNF

SEQ ID NO: 15945 - protein, 205 aa, Wolbachia endosymbiont
GPISDEETSYYVRLQYNGEFLPLFTKVDGITNATGKEKDSPLKASFIAGGGAFGYKMDDIRVDVEGLYSWLNKDADVVGDTVADNLTAISGLVNVYYDVAIEDMPITPYIGVGVGAAYISTPLKTPINDQKSKFGFAGQVKAGVSYDVTPEIKLYAGARYFGSYGANFDGKKTDPKDSTKQVTDAGAYKVLYSTVGAEAGVAFNF

SEQ ID NO: 15946 - protein, 201 aa, Wolbachia endosymbiont
FGPISDEETSYYVRLQYNGEFLPLFTKVDGITYKKDKSDYSPLKPSFIAGGGAFGYKMDDIRVDVEGVYSYLNKNDVTDAEFKPDTIADSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEAGVAFN

SEQ ID NO: 15947 - protein, 202 aa, Wolbachia endosymbiont
GPISDEETSYYVRLQYNGEILPLFTKVDGITYKKDNSDYSPLKASFIAGGGAFGYKMDDIRVDVEGVYSYLNKNDVTDAKFTPDTIADSLTAISGLVNAYYDIAIEDMPITPYIGVGVGAAYISTPLKDAVNDQKSKFGFAGQVKAGVSYDVTPEVKLYAGARYFGSFGAHFDKDAAAGKDKGELKVLYSTVGAEAGVAFNF

SEQ ID NO: 15948 - protein, 203 aa, Wolbachia endosymbiont
FGPISDEETIYYIRLQYNGEFLPLFTKVDGIEYKKGTESHNPLKASFIAGGGAFGYKMDDIRVDVEGVYSYLNKNDVTGATFTPTDAIADSLTAISGLVNVYYDIAIEDMPITPYIGAGIGAAYLSTPLKTAVNGQNSKFGFAGQVKAGISYDVTPEVKFYAGARYFGSYGANFDTSTGGKGKGGHTVLYSTVGAEAGVAFNF

SEQ ID NO: 15949 - protein, 196 aa, Wolbachia endosymbiont
GPISDEETSYYVRLQYNGEILPLFTKVDGITYKKGNSDYSPLKASFIAGGGAFGYKMDDIRVDVEGVYSYLNKNDVTDAKFTPDAIADSLTAISGLVNVYYDIAIEDMPITPYIGVGVGAAYISTPLATAVSSQNGKFAFAGQARAGVSYDVTPEIKLYAGARYFGSYGANFGKATKDDAGIKVLYSTVGAEAGVA

SEQ ID NO: 15950 - protein, 201 aa, Wolbachia endosymbiont
FGPISDEETSYYVRLQYNGEILPLFTKVDGITYKKGDSDYSPLKASFIAGGGAFGYKMDDIRVDVEGVYSYLNKNDVTDAKFTPDAIADSLTAISGLVNVYYDIAIEDMPITPYIGVGVGAAYISTPLATAVSSQNGKFAFAGQARAGVSYDVTPEVTLYAGARYFGSYGANFDKTDKDGKGELKVLYSTVGAEAGVAFNF

SEQ ID NO: 15951 - protein, 427 aa, Wolbachia endosymbiont
AAFQLAEVSTSGLGRAYAGEAAIADNASVVATNPALMSLFKTNQFSVGGVYVDSRINMNGDVQAAVQNLAMKFTQYGSASERNVVPGAFVPNLYFVAPVNDKFALGAGMNVNFGLKSKYDDSYDAGIFGGKTDLTAINLNLSGAYRVTEGLSLGLGVNAVYAKAQVERNAGIIVDSVKDSQVQNALKGVDPQTVIPGYLTSKDKSVVSLQDRAAWGFGWNAGVMYQFNEANRIGLAYHSKVDIDFTDRTATSLEANVIKAGKKGDLTLKLPDYLELSGFHQLTDKFAVHYSYKYTHWSRLTKLHASFEDGKKAFDKELQYSNNSRVALGASYNLDEKLTLRAGIAWDQAASRHHRSAAIPDTDRTWYSLGATYKFTPNLSVDLGYAYLKGKKVHFKEVQQVGLIITTANYTSQAHANLYGLNLNYSF

SEQ ID NO: 15952 - protein, 200 aa, Wolbachia endosymbiont
GPISDEETSYYVRLQYNGEILPLFTKVDGITYKKGNSDYSPLKASFIAGGGAFGYKMDDIRVDVEGVYSYLNKNDVTDAKFTPDAIADSLTAISGLVNVYYDIAIEDMPITPYIGVGVGAAYISTPLATAVSSQNGKFAFAGQARAGVSYDVTPEVKLYAGARYFGSYGANFDKTDEDGKGELKVLYSTVGAEAGVAFNF

SEQ ID NO: 15953 - protein, 195 aa, Wolbachia endosymbiont
GPISDEETSYYVRLQYNGEILPLFTKIDGITNATGKEKDSPLKASFIAGGGAFGYKMDDIRVDVEGLYSYLNKDADVVGGTVADNLTAISGLVNVYYDIAIEDMPITPYVGVGVGAAYVSNPLAKKVTDDKASGFGVAYQAKAGVSYDGTPEVKHFAGTRYRGSHGASFGKVTKDKGELKVLYSTVGAEAGVAFN

SEQ ID NO: 15954 - protein, 144 aa, Wolbachia endosymbiont
GFDDIDGMRFAYRPLEQTLATDWFGDIKLYWEVSAVVWEYGENDTHSTSYGASLTPVFMKQISTLYDKYPVYIEAGIGASYIGDQKVAGKDIGSNYQFEDRLGVFVEINKKQHVALRYMHFSNGGFNNDNPGLDFLNLSYSYHF

SEQ ID NO: 15955 - protein, 196 aa, Wolbachia endosymbiont
GPISDEETSYYVRLQYNGEILPLFTKVDGATGAKKKTADTDTTTDLYKASFMAVGGAFGYKMDDIRVDVEGLYSQLSKDTLDVAPTPAIADSLTAFSGLVNVYYDIAIEDMPITPYVGVGVGAAYISTPLATAVSSQNGKFAFAGQAGAGVSYDITPEIKLYAGARYFGSFGAHFDKDTAAASKDKGELKVLYSTV

SEQ ID NO: 15956 - protein, 189 aa, Wolbachia endosymbiont
VRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGATYISTPLEPAVNDQKSKFGFAGQVKAGVSYDVTPEVKLYAGARYFGSYGANFDGKKTDPKDSTRQVTDAGAYKVLYSTV

SEQ ID NO: 15957 - protein, 187 aa, Wolbachia endosymbiont
  misc_feature (34)..(34): Xaa can be any naturally occurring amino acid
SYYIRLQYNGEILPLFTKVDGITYKKDNSDYSPXKASFLAGGGAFGYKMDDIRVDVEGVYSYLNKNNVTDARFTPDTIADSVTAISGLVNVYYDIAIEDMPITPYVGVGVGAAYISTPLKDAVNDQRSKFGFAGQVKAGVSYDVTPEVKLYAGARYFGSYGANFDKSVGEKDKGGHTVLYSTVGAEA

SEQ ID NO: 15958 - protein, 1062 aa, Rickettsia raoultii
ITLQAGGSLAANNIDFGVGSTLEFNGPLDGGGNTIPYYFKGAIANGNNAILNVNTKSLTAYHSTIGTVAEINIGAGNLFAIDASAGDVTILNAQDINFGAPDSALALSNLTGVGVKNILLAADLVAPGANGGDVVFNGGVNGLNIGSNVVGTARNIGDGGGDKFNTLLIYNAVTITDDVNLEGIQNVHINNNAAFTSSTAFNAGAIQINDATYTIDANNGNLNVPAGNIQFAHANAQLILQNTSGNDRTITLGANIDPDNDDEGIVTLNSVTAGKKLTIAGGKTLGGAHKLHTIVFKGAGDFGAAGTTFNTTNIVLDTTGRLELGATTANVVLLNDAIQLTQTGGNIDGFLDFNAKNGTVTLNNNVNVAGAVQNTGGTNNGTLIVLGASNLNSVNGIAMLKVGAGNVTIAKGGDVKIGEVQGTGTNTLTLPANFNLTGSINKTGGQALKLNFTNGGSVSGVVGTAANLVGDITTAGATSFASSVNAKGTATLGGTTSFADTFTNTGAVTLAKGSITNFAKNVTATSFVANSATINFSNSLAFNSNITGSGTTLTLGANQVTYTAGTGSFTDTLTLNTTFDGAAKSGGNILIKSGSTLDLSGVSTLALVVTATNFDINNISPDTKYTVISAETVGGLKPTPEENVKITINNDNRFVDFTFDASTLTLFAEDIAADVIDEAFEPGGPLANIPNAANIKKSLELMEDAPNGSDARQAFNNFGLMTPLQEADATTHLMQDVVKPSDTIAAVNNQVVASNISSNITALNARMDKVQAVNKGPVSSGDEDMDAKFGAWISPFVGNATQKMCNNISGYKSDTTGGTIGFDGLVSDDLALGLAYTRADTDIKLKNNKTGDKNKVESNIYSLYGLYNVPYENLFVEAIASYSDNKINSKSRRVIATALETVGYQTANGKYKSESYTGQLMAGYTYMMPENINLTPLAGLRYSTIKDKGYKETGTTYQNLTVKGKNYNTFDGLLGAKVSSNINVNEIVLTPELYAMVDYAFKSKVPAIDARLQGMTAPLPTNSFKQSKTSFDVGVGVTAKHKMMEYGINYDTNIGSKYFAQQ

SEQ ID NO: 15959 - protein, 1060 aa, Rickettsia raoultii
ITLQAGGSLAANNIDFGVGSTLEFNGPLDGGGNTIPYYFKGAIANGNNAILNVNTKSLTAYHSTIGTVAEINIGAGNLFAIDASAGDVTILNAQDINFGAPDSTLALSNLTGVGVKNILLAADLVAPGANAGDVVFDGGVNGLNIGSNVAGTARNIGDGGGNKFNTLLIYNAVTITDDVNLEGIQNVLINNNADFTSSTAFNAGAIQINDATYTIDANNGNLNVPAGNIQFAHADAKLILQNSSGNDRTITLGANIDPDNDYEGIVTLNSVTAGKKLTIAGGKTLGGAHKLQAIVFKGAGDFSAAGTTFNTTNVVLDTTGQLELGATTANVVLLNDAVQLTQTGNIGGFLDFNAKNGTVTLNNNVNVAGAVQNTGGTNSGTLIVLGASNLNSVNGIAMLKVGAGNVTIAKGVDVKIGEIQGTGTNTLTLPANFNLTGSINKTGGQALKLNFTNGGSVNGVVGTAANSVGDITTAGATSFASSVNAKGTATLGGTTSFADTFTNTGAVTLAKGSITNFAKNVTATSFVANSATINFGNSLAFNSNITGSGTTLTLGANQVKYTGTGSFTDMLTLNTTFDGAAKSGGNILIKSGNTLDLSGVSTLALVVTATNFDINNISPDTKYTVISAETAGGLKPTTEENVKITINNDNRFVDFTFDASTLTLFAEDIATDVIDEDFEPGGPLANIPNAANIKKSLELMEDAPNGSDARQAFNNFGLMTPLQEADATTHLMQDVVKPSDTIAAVNNQVVASNISSNITALNARMDKVQAANKGPVSSGDEDMDAKFGVWISPFVGNATQKMCNNISGYKSDTTGGTIGFDGLVSDDLVLGLAYTRADTDIKLKNNKTGDKNKVESNIYSLYGLYNVPYENLFVEAIAFYSDNKIRSKSRRVIATALETVGYQTANGKYKSESYTGQLMAGYTYMMPENINLTPLAGLRYSTIKDKGYKETGTTYQNLTVKGKNYNTFDGLLGAKVSSNINVNEIVLTPELYAMVDYAFKNKVPAIDARLQGMTAPLPTNSFKQSKTSFDVGVGVTAKHKMMEYGINYDTNIGSKYFAQQ

SEQ ID NO: 15960 - protein, 1629 aa, Rickettsia raoultii
STATIVASFAGSAMGAATQQNRTTNGAATTVDGAGFDQTAAPANVAVALNAVITANANNGINLNTPAGSFNGLFLDTAHNLAVTVSADTTLGFITKAANNGNAFDLTLGAGKTLTITGQGITNAQAAVTKNAQNVVAQFNGGAAIANNDLSGVGTIDLGAAASTLVFNLANPTTQKAPLILGNNAVIANGVNGTLNVTNGFIQVSDKSFATVKAINIDDGQGFIFNTDATVGNALNLQAGGATINFNGTDGTGRLVLLSKNGAATDFNVTGSLGGNLKGIIAFNTVAVAGQLIANAGPANAVIGTNNGAGRAAGFVVSVDNGNAATIAGQVYAKDMVIQSANAGGQVNFGHIVDVGTDGTTAFKTAASKVAITQNSNFGTTDFGNLAAQITVPDTMTLTGNFTGDANNPGNTAGVITFAANGTLASASADANVAVTNNITAIEASGIGVVQLSGTHTAELRLGNAGSVFKLADGTVINGTVNQTAVVGGALAAGAITLDSSATMTGDIGNGGGAAALQSITLANDATKTLTLGGANIIGANGGTIDFQANGGTIKLTSTQNNILVDFDLAIATDQTGVVDASSLTNAQTLTISGTIGTIGANNKTLGQFNIGSSKTALNGGNVAINELVIGNNSSVQFAHNTYLITRTTNAAGQGKIIFNPVVNNNTTLAAGTNLGSAANPLAEINFGSKGAHADTILNVGEGVNLYATNITTTDANVGSFVFNAGGTNIVSGTVGGQQGNKFNTVALDNGTTVKFLGNATFNGETTIEANSTLQIGGNYTADFVASADGTGIVEFVNTGPITVTLNKQAAPVNNLKQITVSGPGNVVINEIGNAGNDHGATTGTIAFENSSLGAVLFLPSGIPFNDAGNTMPLTIKSTVGNKTATGFDVPGVIVLGVDSVIADGQVIGDQNNIVSLGLGSDNGIIVNATTLYAGIGTINNNQGTVTLSGGVPNTPGTVYGLGTGIGTVQLKQVTFTTDYNNLGNIIAPNATINDGVTVTTGGIAGTDFDGKITLGSVNGNANVRFADGILSNSTSMIVTTKANNGTVTYLGNAFVGNIGDSDTPVASVRFTGSDKGAGLQGNIYSQVIDFGTYDLDILNSNVILGGGTTAINGAINLLTNTLTFASGTSTWGNNTSIETTLTVANGNIGHIVIAEGAQVNATTTGTTTINVQDNANANFSGTQTYTLIQGGARFNGTLGGPNFAVTGSNRFVNYGLIRAANQDYVITRTNNAENVVTNDIANSLFGGAPGVGQNVTTFVNATNTAAYNNLLLAKNSAAAANFVGAIVTDTSAAVTNAQLDVAKDIQAQLGNRLGALRYLGTPETAEMAGPEVGAIPAAVAAGDEAVDNVAYGIWAKPFYTDAHQSKKGGLAGYKAKTTGVVIGLDTLANDNLMIGAAIGITKTDIKHQDYKKGDKTDVNGFSFSLYGAQQLVENFFAQGSAIFSLNQVKNKSQRYFFDANGNMSKQIAAGNYDNMTFGGNLTVGYDYNAMQGVLVTPMVGLRYLKSSDENYKETGTTVANKQVNSKFSDRTDLIVGAKVVGGTMNITNLAVYPEAHAFVVHKVNGRLSKTQSVLDGQVTPCISQPDRTAKTSYNLGLSASIRPDAKMEYGIGYDAQIASKYTAHQGTL

SEQ ID NO: 15961 - protein, 1630 aa, Rickettsia raoultii
STATIVASFAGSAMGAATQQNRPTNGAATTVDGAGFDQTAAPANVAVALNAVITANANNGINLNTPAGSFNGLFLDTAHNLAVTVSADTTLGFITKAANNGNSFDLTLGAGKTLTITGQGITNAQAAVTKNAQNVVAQFNGGAAIANNDLSGVGTIDLGAAASTLVFNLANPTTQKAPLILGNNAVIANGVNGTLNVTNGFIQVSDKSFATVKAINIDDGQGFIFNTDATVGNALNLQAGGTTINFNGTDGTGRLVLLSKNGAATDFNVTGSLGGNLKGIIAFNTVAVAGQLIANAGPANAVIGTNNGAGRAAGFVVSVDNGNAATIAGQVYAKDMVIQSANAGGQVNFGHIVDVGTDGTTAFKTAASKVAITQNSNFGTTDFGNLAAQITVPDTMTLTGNFTGDANNPGNTAGVITFAANGTLASASADANVAVTNNITAIEASGIGVVQLSGTHTAELRLGNAGSVFKLADGTVINGTVNQTAVVGGAFAAGAITLDGSATMTGDIGNGGGAAALQSITLANDATKTLTLGGANIIGANVGGTIDFQANGGTIKLTSTQNNILVDFDLAITTDQTGVVDASSLTNAQTLTISGTIGTIGANNKTLGQFNIGSSKTALNGGNVAINELVIGNNSSVQFAHNTYLITRTTNAAGQGKIIFNPVVNNNTTLAAGTNLGSAANPLAEINFGSKGAHADTILNVGEGVNLYATNITTTDANVGSFVFNAGGTNIVSGTVGGQQGNKLNTVALDNGTTVKFLGNATFNGETTIEANSTLQIGGNYTADFVASADGTGIVEFVNTGPITVTLNKQAAPVNNLKQITVSGPGNVVINEIGNAVNDHGATTGTIAFENSSLGAVLFLPSGIPFNDAGNTMPLTIKSTVGNKTATGFDVPGVIVLGVDSVIADGQVIGDQNNIVSLGLGSDNGIIVNATTLYAGIGTINNNQGTVTLSGGVPNTPGTVYGLGTGIGTVQLKQVTFTTDYNNLGNIIATNATINDGVTVTTGGIAGTDFDGKITLGSVNGNANVRFADGILSNSTSMIVTTKANNGTVTYLGNAFVGNIGDSDTPVASVRFTGSDKGAGLQGNIYSQVIDFGTYDLDILNSNVILGGGTTAINGAINLLTNTLTFASGTSTWGNNTSIETTLTVANGNIGHIVIAEGAQVNATTTGTTTINVQDNANANFSGTQTYTLIQGGARFNGTLGGPNFAVTGSNRFVNYGLIRAANQDYVITRTNNAENVVTNDIANSLFGGAPGVGQNVTTFVNATNTAAYNNLLLAQNSAAAANFVGAIVTDTSAAVTNAQLDVAKDIQAQLGNRLGALRYLGTPETAEMAGPEVGAIPAAVAAGDEAVDNVAYGIWAKPFYTDAHQSKKGGLAGYKAKTTGVVIGLDTLANDNLMIGAAIGITNSDIKHQDYKKGDKTDVNDFSFSLYGAQQLVENFFAQGSAIFSLNQVKNKSQRYFFDANGNMSKQIAAGKYDNMTFGGNLTVGYDYNAMQGVLVTPMVGLSYLKSSDENYKETGTTVANKQVNSKFSDRTDLIVGAKVAGGTMNITNLAVYPEAHAFVVHKVNGRLSKTQSVLDGQVTPCISQPDRTAKTSYNLGLSASIRPDAKMEYGIGYDAQIASKYTAHQGTL

SEQ ID NO: 15962 - protein, 387 aa, Rickettsia typhi
ALVLSALPLAAVADVSLYGEIKAGVEGRNYQLQLTEKPSNTNAKTGNKVEVTKAKSRIRTRISDFGSFIGFRGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPIQNSKSAYTPAYWTTVNNGNATTTTFVPAVVGKPGSDVYYAGLNYKNGGFAGNYAFKYARHANVGRDAFELFLLGSGSDQAKGTDPLKNHQVHRLTGGYEESGLNLALAAQLDLSENADKTKNRTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 15963 - protein, 162 aa, Rickettsia sibirica
GMYGTNNHGRVENMTGYRGTNKGATIGFDAEIDNNIVGIAYSNVHSVFKFKNSKNNDKELINSHVVSIYGQKELPKNFALQALVSASKNFIKDKTTYSYGDTKIKSNVKHRNHSYNAEALLHYNYLLQSKFVITPNIGLRYGKSRDGVYNETGVNVQEIALT

SEQ ID NO: 15964 - protein, 162 aa, Rickettsia slovaca
GMYGTNNHGRVENMTGYRGTNKGATIGFDAEIDNNIVGIAYSNVHSVFKFKNSKNNDKELINSHVVSIYGQKELPKNFALQALVSASKNFIKDKTTYSYGDTKIKSNVKHRNHSYNAEALLHYNYLLQGKLVITPNIGLRYGKSRDGVYNETGVNVQEIALT

SEQ ID NO: 15965 - protein, 162 aa, Rickettsia rickettsii
GMYGTNNHGRVENMTGYRGTNKGATIGFDAEIDNNIVGIAYSNVHSVFKFKNSKNNDKELINSHVVSIYGQKELPKNFALQALISASKNFIKDKTTYSYGDTKIKSNVKHRNHSYNVEALLHYNYLLQSKFVITPNIGLRYGKSRDGVYNETGVNVQEIALT

SEQ ID NO: 15966 - protein, 162 aa, Rickettsia rhipicephali
GMYGTNNHGRVDNMTGYRGINKGATVGFDAEINNNIIGIAYSNVHSVFKFKNGKNNDKELIGSKVISIYGQKELQQNFTLQLLVSASKNFIKDKINYSYGDTQIKSHVKHHNHSYNAEALLNYNYLVKNSIIITPNIGLKYGKSRDGVYNETGINVQEIALT

SEQ ID NO: 15967 - protein, 218 aa, Rickettsia prowazekii
GMENYNPPQEPWLVILYQDDHIMVVNKPSGLLSVPGRLEEHKDSVMTRIQRDYPQAESVHRLDMATSGVIVVALTKAAERELKRQFRERVPKKQYVTRVWGHPSPAEGLVDLPLICDWPNRPKQKVCYETGKPAQTEYEVVEYAADNTARVVLKPITGRSHQLRVHMLALGHPILGDRFYASPEARAMAPRLLLHAEMLTITHPAYGNSMTFKAPADF

SEQ ID NO: 15968 - protein, 162 aa, Rickettsia parkeri
GMYGTNNHGRVENMNGYRGTNKGATIGFDVEIDNNILGIAYSNVHSVFKFKNSKNNDKELIDSHVISIYGQKELPRNFALQALVSASKNFIKDKTTYSYGDTKIGSNVKHRNHSYNAEALLNYNYLLQNKFVITPNIGLRYGKSRDGVYNETGINVQEIALT

SEQ ID NO: 15969 - protein, 162 aa, Rickettsia montana
GMYGTNNHGRVDNMTGYRGTNKGATIGFDAEIDNNIVGIAYSNVHSVFKFKNSKNNDKELINSHVVSIYGQKELPKNFALQALVSASKNFIKDKTPYSYGDTKIRSNVKHRNHSYNAEALLHYNYLLQSKLIITPNIGLRYGKSRDGVYHETGINVQEIALT

SEQ ID NO: 15970 - protein, 162 aa, Rickettsia massiliae
GMYGTNNHGRVENMTGYRGTNKGATIGFDAEIDNNIVGIAYSNVHSVFKFKNSKNNDKELINSHVVSIYGQKELPKNFALQALVSASKNFIKDKTTYSYGDTKIKSNVKHRNHSYNVEALLHYNYLLQSKFVITPNIGLRYGKSRDGVYNETGVNVQEIALT

SEQ ID NO: 15971 - protein, 162 aa, Rickettsia japonica
GMYGTNNHGRVENMTGYRGTNKGATIGFDAEIDNNIVGIAYSNVHSVFKFKNSKNNDKELINSHVVSIYGQKELPKNFALQALVSASKNFIKDKTTYSYGDTKIRSNVKHRNHSYNAEALLHYNYLLQSKLIITPNIGLRYGKSRDGVYHETGINVQEIALT

SEQ ID NO: 15972 - protein, 306 aa, Rickettsia honei
GIVLTTPIAISSFASTETLSFTPDNINADISLGTLSGKTKERVYLAEEGGRKVSQLDWKFNNAAIIKGAINWDLMPQISIGAAGWTTLGSRGGNMVDRDWMDSSNPGTWTDESRHPDTQLNYANEFDLNIRGWLPNEPNYRLGLMAGYQESRYSFTARGGSYIYSSEEGFRDDIGSFPNGERAIGYKQRFKMPYIGLTGSYRYEDFELGGTFKYSGWVEAFDNDEHYDPGKRITYRSKVKDQNYYSVAVNAGYYVTPNAKVYIEGAWNRVTNKKGDTSLYDHNDNTSDYSKNGAGIENYNFITTAG

SEQ ID NO: 15973 - protein, 162 aa, Rickettsia helvetica
GMYGTNNHGRVDNMTGYRGTNKGATIGFDAEIDNNIVGIAYSNVHSVFKFTNSKNNDKELINSHVVSIYGQKELPKNFALQALVSASKNFIKDKTTYSYGDTKIRSNVKHRNHSYNAEALLNYNYLLQSKLVITPNIGLRYGKSRDGVYHETGINVQEIALT

SEQ ID NO: 15974 - protein, 162 aa, Rickettsia canadensis
GMYGTNNHGRVENMTGYRGTNKGATIGFDAEIDNNIVGIAYSNVHSVFKFKNSKNNDKELINSHVVSIYGQKELPKNFALQALVSASKNFIKDKTTYSYGDTKIRSNVKHRNNSYNAEALLQYNYLLQSKFVITPNIGLRYVKSRDGVYNEIGVNVQEIALT

SEQ ID NO: 15975 - protein, 570 aa, Rickettsia bellii
TLYGSDALGGLVQFRTKNPSDVLVGDDDGHRFGIKSTYTSVDEQFKNTLTWAMREGKLETLVMATYAQGHETQSHGSGTDIEGPKRGATNPADTDLGNILAKAQYQVNEAHRVGLTLEHYVKNYDENKLNYNGYSMGGITYSNAYTEDTNDRTRVSLDHQWLMNSLLVDESKISLSYQESSALNKNYDTTVKYGSRMRERDTEDKSVQVDAQFNKLIEKQGVSHDISYGGSYLNNDFSINNVDHLYRTGTSNPVQAEMPDADVQKWGIFAQDQMYLMDEQLILTAGLRYDSYEATPKTDAGFTTQYQPNKDNAFTGKLGAVYHLKDNLALFGQISQGFKAPTVYDLYYFYSRGAIIEANPDLKAERSISYEVGTRGNNAYGNMELAVFINDYKDFITQTKTGQSGGKDVISKYNIDEVRIYGAELSSTLLLDTVSPLPHGSYARLAVAYAHGEDKATGKEIDTVAPLTSVFGLGYDQVNFGSALNVKMVASKDEWQLDNNLDVAGYTVVDLTAYYVPVKDLTVRAGLFNLFDKKYWHYSDISGKTGTEAFNIDYQSQPGRNWGISLDYQF

SEQ ID NO: 15976 - protein, 162 aa, Rickettsia australis
GMYGTNNHGRVENMNGYRGTNKGATIGFDVEIDNNILGIAYSNVHSVFKFKNSKDNDKELIDSHVISIYGQKELPRNFALQALVSASKNFIKDKTTYSYGDTKIGSNVRHRNHSYNAEALLNYNYLLQNKCVITPNIGLRYGKSRDGVYNETGINVQEIALT

SEQ ID NO: 15977 - protein, 162 aa, Rickettsia akari
GMYGTNNHGRVDNMTGYRGTNKGATIGFDVEIDNNIVGIAYSNVHSVFKFKNSKNNDKELINSHVVSIYGQKELPKNFALQALVSASKNFIKDKTTYSYGDTKIRSNVKHRNHSYNAEALLNYNYLLQNKLVIIPNVGLRYGKSRDGVYNETGINIQEIALT

SEQ ID NO: 15978 - protein, 162 aa, Rickettsia africae
GMYGTNNHGRVENMTGYRGTNKGATIGFDAEIDNNIVGIAYSNVHSVFKFKNSKNNDKELINSHVVSIYGQKELPKNFALQALVSASKNFIKDKTTYSYGDTKIKSNVKHRNHSYNAEALLHYNYLLQSKLVITPNIGLRYGKSRDGVYNETGVNVQEIALT

SEQ ID NO: 15979 - protein, 162 aa, Rickettsia aeschlimannii
GMYGTNNHGRVDNMTGYRGTNKGATIGFDAEIDNNIVGIAYSNVHSVFKFKNSKNNDKELINSHVVSIYGQKELPKNFALQALVSASKNFIKDKTTYSYGDTKIRSNVKHRNHSYNVEALLNYNYLLQSKLLITPNIGLRYGKSRDGVYNETGINVQEIALT

SEQ ID NO: 15980 - protein, 417 aa, Uncultured bacterium
MRHLRINSLVGSLSLLSFSAITQASGFALIEQSASGQGVSYAGAAASTEDASVMWFNPAGLTEVKGHELILGAHVITPKAKFTNDGSYLAVAGNNIQGPDDDGATTGFVPNFYWKGQYKDYHLGLGINVPFGQHISYDDQWVGRYHATETDLKSYNINPAISRKLTDTLSFGIGLNAQYVDLTMEKKANLGSSTGSAGDGNVKIQADSWGYGYNFGFLWQPSQLTQVGLSYRSTVTQNAKGTIDYTPNFRTDGDISSTVNLPAMAVLSVKQRYGQKFELLAGATWTKWSDYGSLVIKDAAGQTLTNTRQDFKDSWRYSLGGIYQATDTLKLRTGLAIDYTPVSNETHRSPRTPDSTRKWVSFGAGYQFNQQWNLDLAYSHLFADRSKVNYTTDDTHYLVGSYESSVDIVSAQVVWKY

SEQ ID NO: 15981 - protein, 994 aa, Rhodopseudomonas palustris
MHFTPNRLALCIALACAAFAPSAFAKDYLIDRASTDTLELKKSDTLIVTASGSIVASDDDGVILPKHTSGATVSVDNAGIIRSTDGRGIDSKGDGEDLSHFVITNHAGGLIQGSNDGLRLQTNPAAGGSLSIINAGTIASTVDGQAIDLETLNNPAFTTTLENQATGVIHAVGNDAIKTGSNATITNYGLIYTDTAPQDKNGLDQKWDGIKIGTSTGVTVYNHGTISADRHGVDLKTDATLYNYEGASVTGRNGSGFGSDGSGTVYNWGTITGAIADGKINGDGDGVDIDNIGHVYNAGTIQGLGAKGVDSGGRPNGSEGIAMGGGSIVNTTSGVIRSVDNGILVDDGAEGAGVAATTISNAGRIEGEGGFGIKLIGEYDDSVINSGTISGGNGLALSMGAGNDSLTVLTGGTFNGLVDGGAGIDSLTLNGTGNFGNSANFETLKVSGGSWTLTSLEDFSQGGVVNSGATLINQGSILGSMLIEKGATYAGGGSVGGLQVNGTLLTNTGLGVAAVAGDLSFGQGSSLVYGVNADGSSAPIHVSGTANLDGATLHVQPSAGEYPWQSHYTVLTAGAVNGTFTQVSSDYAFLTPTLRYNNTSVGLDYTRNDVAFEHYAPSANAAGAARSLASLGQNSNLYNAVLGTTAAGAGNAIEQLSGSNTANLAAATLAGASQVGSSMLGAMQAMGSAGGLLVGLSDSDGPALAATGVPREARNLNDPTAQGRVWAQALGSYGKVDGSHGASTLEQRTGGGVLGVDWALAGDWRVGLLGGYSHTRLDATGLDGTVRSWHAGVYAQHQSGPLAVRLGAAYSSHDGDSKRDVAFAGFKERLEGDYDADSQQAFIELGYAMGSGRLSAEPFANLGYQRYHRDNYREQGGDAALAVDADTQDNVSSTFGVRLAHLGQLDNGMSLTPRATLGWRHTYGSIDTRTRQAFIAGGDAFSVEGSAIDRDSLLVEAGLDLGLSARQSVGIGYSGELGSNSRNHAVVGQWQLKF

SEQ ID NO: 15982 - protein, 484 aa, Rhodopseudomonas palustris
MLSIRATLPLTMLLLSGCVVGPDHQTPEIQLPGKFAEAGKTSNGDISTVAWWNAFNDSRLNGYVSTGLTQNLTVLQAIERINQAQSNITVAGAGSLPSLTSTFRHQTQGSGGSLPSTNDNVTNTTSNAFNVGWLLDLFGQYRRAQESAGASLDAAYATANVQRLTLISAVTSAYIDVRYYQERLAIARQNLGSRRETLSLTKLQLDAGAASRLDVVQSEGLVNSTLAQMPALETNFRRAAHRIATLLGMPADSLVMELQRGARQPVARTIPRTGIPADLIRNRPDIRVAERQLAAAVADIGVAEAQLYPSITLSGSITPSFTKISNGASGTSNGWGFGPSITLPILDGGRLRAGVDIQKSVAREQYLAWKATVLNAVEEVENALTALNRDQQTVSAYRRTVSSYQEALSLATASYRDGASSLLDVLDAQRNVSDAQSQLATAIQQAAQDYVALSVALGGGYAVGQTATSKGGPTIAAAVAAKRM

SEQ ID NO: 15983 - protein, 1084 aa, Rhodopseudomonas palustris
MRSVQKQISLLLILLISSSLNVLAQNKTITGTVRDANDVVIGASVTIKGNKSLGTITDIEGTYSISVPESAQELIFSYVGYETQIVPIKGRTTINITLSESSQMLDEVVAIGYAKVQRKDLTGAISSVGGKELANVPVTTAMQALQGKAAGVNIVTASGAPGASANITIRGGMSLTQGTEPLYIVDGFEMGDALDNIDINDIESIDVLKDASSTAIYGARGSNGIIVITTKSGKKGKTQISYNTYFSFDKLAKKLDMLNNVEEYVKYQYEFAAMRENALTAYSNVYDNAIGIDQDDFYTGAYERIANRYSGTEGINWQEEVFGGSAMTQSHNVNISTGTEKTQVMLSYNYNGQDGLLANHSSNKSSFRAKINSELYKGIRLDVNTMFSNKSTDGGGKYDGMRNVLLQPIHGGTLFTQDELLYTQTYPDYTSMDSAFNTPNPLVQNNASTSNSRSRLFSVNAGIEFDFLKYFTYRVAGSYTWSNSKSTSFADENSTSYIMDPENTGINGSIGNKESYKYQITNTLNYNQTFAQKHKVNVLLGHEVTYSESEKNSMKLRKFPYPNHGLDQIDQAEVYEKDAGHSHSGMVSAFIRANYTFDERYLFTATLRGDGSSKFAPANKWGIFPSVSAAWRISEEAFWKGHQIENIINNMKLRIGYGTTGNNGIGDRLYVTSIQQTSYPINSDAGNSAYLPGETLGNKDLKWETLISTNVGLDLSFFNSRINFTAEWYNNQSKDLLMQCVIPSSTGYKNQYQNVGKMRNRGWEFTLNTVNVRTKDFSWTSDLNLSFNSSHVESLEEGLNEKTFAVGNSRSGMVTYYATVGQGLGDMYGYVYEGVYTTEDFIESKDADGNTVFTLHDGVVRPSEGSVQPGDIKYAADDVDENGNPIFTRKNVKIGNGTPTCIGGFNNSFSYKGFDLSVFMKFALGQDIYNATKQSMSPYAQFQNIPTEFNNYYRVIDPATGKKATTLARLKELNPSESNRLWSLSLNNATSGFYPSSYYVEDGSYLRIAQVTLGYTFPKAWTTKVMISNARIYFTANNLATICGYSGYDPEVKSANDNVVCTPGYDSSMYPRSRSYVIGLNLTF

SEQ ID NO: 15984 - protein, 189 aa, Rhodopseudomonas palustris
MRKLLTLPFALTLAISAAYYSSSAYAESYLTGSVGSATTTGFAEDSTTLNFGAGARFGDFFALEVSYLDTGEFTASETYNDGQLDNSLKFTGLNVSLIGHLPLSDDLELYGKVGQYFWRADINSYAHADNSSASLRLNDADLTYGGGVLMHLSKQLALKAEYQIIDFAADNDGAFGSTDIASVGFIFKL

SEQ ID NO: 15985 - protein, 429 aa, Rhodopseudomonas palustris
MLSSQPQAFAPTRSLSARPYAYACAFALAGVAPMSQAAFFEDSTATFETRNMYFNRDFRDGTSAQQSKREEWAQGLMLNFESGYTDGPVGFGLDALGMLGIKLDSSPDRADTGLLPTHDDGKAADEYSKLGLTGKVKVSETELKIGTLIPELPTLQPNDGRILPQTFEGGLVTSKEINNLTFTGGRLEKAKDRNDTNWEDLALNNKNGRFGGTFSADNLDLAGVDYQFTDRITGSYHFAQLDDIYRQHFLGMIATQPWGPGTFGADLRLAVSDDQGQAKAGNIDNTTVNGMFSYALGGHKVSAAYQHLSGDSAFPYVDGADPYLVNFVQINDFAGADERSWQVRYDYNFAALGVPGLTFMTRYINGDNVSRADGSEGKEWERNTEFKYVVQSGPLKNVAVRLRNATFRSNFARDADEVRLLVSYSVALW

SEQ ID NO: 15986 - protein, 280 aa, Rhodopseudomonas palustris
MRSVKMILAAGAASLICSAAVAADMPIAPPPAYAPPPVEDFGGWYLRGDIGFSNQQVKDLRYGRESAYSQLTSLNQQTSFDAAGIYGVGVGYQFNSWFRADLVGQYRGNSNFKGTDRFTGTANGFPYSGIDNYGASKSEWLVMANGYVDLGTWWCVTPFVGAGVGAARVTMSNFTDTGVNIIPFSTVSYASAPTASKWNLAWALHTGLAYKVNPNLTLELAYSYLNLGDGYTGSLATYDGLTSNNSFKFKDITSHDVKLGVRWNLDSAPIYAPPPLMRKG

SEQ ID NO: 15987 - protein, 1021 aa, Rhodopseudomonas palustris
MSKHLLFILILAVCTNVFAQQTKSISGVVYDSNTGEALIGVSVLEVGTTNGTITDFDGKYTLKVSSNKVSFSYVGFKTEIVNVTNSGTYNVNLVSDNELDEVVVIGYGTQRKSDLTGALASISSKDIKNYAVSNASELLTGKAAGVFVAASSGQPGSDAVIRVRGLGTVNDNNPLYVVDGQFMDNISSLNPSDIERMEVLKDASACAIYGSRGSNGVILITTKGGVKGETTVTLDAYVGVKNSYKALNMMNSDQYYNFIMKAYENDASFQNSMKDKFTNQYQKGYNTNWWNEVTRTAFNQNYNLSIRKGTDNSRSSLSLGYVDDQGAIITTEFKRLSLKANLEYDINKFITVGANVNLAKIRKRDAGAIPSFDFIQKADPFTPVISPLVDPSSENYEYNKYAPTEWSYDPNPVAMLELPNRYNDIFNVFGNVFAQIKLYKGLSYRVQYSFERYHDTFKDFRPVYSSTFSEDNLANQESKYNKETQLNNNSAVTSNYQVEQRLNYNTTIGRHKLDAMVAMTYEKNSSEGINAFKRKALGNDEIYQILDAQTAGDNTSGGKETSSMLSYLGRINYVYDDRYLATVNFRADGSSRFAKRNRWGYFPSVSLGWRVSNEEFFKNLNIENTISNLKLRVGWGQNGNQRIDRDAPLTLIGTNNENQWYFGNGYSQGYVPTYVGNADIKWETSQQTNVGLDMSFFKNSLDVSMDFYVKKTSDMLLNMPIPSFGAFPNSPFFNAGDLKNTGFEIVVNYRNQIGKDFNYNVGLNMSTYKTEVTKLTSEYLSGNTSRTYVGGPIGRFWGYKQIGIFQNQEEIDNYVDKNGTKIQPNAQPGDFKFAKLGESGELNDDDDRTFIGDPNPDLIYGFNLGFSYKNFDVSMAFQGTIGNDIWNVAKGSLASAGRQNALADAYTKAWTKDGDLDAVYPRITNSDSNNNMRGSSFYVENGSYLRLQNMQIGYTLPSHICQKSKLFSSCRFYVSGQNIFTLTGYSGLDPELGINNPLDMGVDTTRYPSSRTFTFGVNLQF

SEQ ID NO: 15988 - protein, 738 aa, Rhodopseudomonas palustris
MSYRSLLTLLLATTALAGPARAQDGSVQLNEISVEAASPGNSAPGLTGSGGLNVSGGDGGTASTSGGGGGPSGITGYTARVATTATKTNTPLIEVPQSVSVVTREQLNDRNVQTFTDAVNYVPGAVSARSGFDPRFDQIFIRGFDVLTNQGIYRDGLRVIGTGFAYPKSEPYGAEALTILRGPASGLYGLGSPGGILDITTKRPVFAPFGEVQFQAGSFDRFQGNFDVGGPIEGSGGTMAYRLTGVRREAGTFIGLGTTDDQLYLAPAFTWKPSADTTFTFLSEFQVTNTPAATFFYNDPGFRVSKFYQGDPRFIGLDQTQYRVGYAFEHFITPDLIFRQNFRHYGLFLSAKYVDINNINEARTIGMRDTGYIREGLVQQTLDNQLEARFATGPVAHTVVGGVDYARYSLSARFGFGLAPDLNLVTRNYGQQLIPTPPLAPASRQSQDQIGVYLQDQAKFGNFILTLNGRHDWVFQNNYATPDSAVSRQDNSAFTGRVGLGYVLAPGLVPYASYATTFTPQVGIDRNGQAFKPATGDQIEAGVKYLIPGTNIQTAFAGFDINQSNILIPDAGNLAFQTAGGAVRSTGFEAEATANLAPGTNLTIAYTHVDIRFVNSVSATGQPIAGNRVSGIPSDTYASFLTYAFPPSSALRGLQIGGGIRFIGSSFADDQNTVRNTAVTLYDALVAYDFAALDPKYKGFRAQINAYNIFDRNYTTCSFGFCNFNQPARVIGSLIYRW

SEQ ID NO: 15989 - protein, 901 aa, Rhodopseudomonas palustris
MMTRTILLASAAAVATFATPALAQSGAATQSPAAEDAPNGSDIVVTGSRIRRQDLAGVGPATVVSAEQIENTGVVNIETVLQRLPANAGFAGNQTSAYWANNGYGTAQVNLRGLGIKRTLVLLNGRRLVAGGTGANSSPDLNMIPVAALARTDVLKDGASAIYGADAMAGVVNLVTRTDYEGLGLSVRQGITEKGDGSDFTADLLWGVRNDRGGFMAAVTYQKTSAVNMATRAPCSLAETTPGMLSCVNSASTIGGRAVLPNGQQINFNQVLGGNGNFFEPYSAAKHNFNSNPFLNAVSPVERVSTAFFADYDITDNIEAFGEFLYTFRKSNQIATPGTLRNLSIAASNPTNPTGQNIVLIQRRLAEPGPRQFFQETDTWQGTFGLRGKLSNDWGWEIAGAFGRNTAVDGSTNIANLERVANSLDTTKCSLAAGATIPCADYLGFGDLTPEVLDYILFTSRDRGGNELATVTADINGDLFKLPAGPVSFAAGVVYRKEKGWRDPDPLTVLGIANTNQQDPISGTSTAKEAYLELSVPVLADTPFFQSLTLDGAVRYSNYDLFGSDWNYKGSVDWVINDSFRLRGTYGTGFRIPNVPELFGGVSEGNLTTTDPCSRYSTSGNATLIANCQASGVPANYVQLGTTILTTVGGNENLKPESSTTWTVGTVISPKGLVPGLSLTADWFDIKIKDAIRAIPGSTKLSICYASQNLSHPFCEDFTRSPLTGEVTFLSAQPINTGREEMNGLDLGLVYNNDIGSVNVSLDVNVTYLNKYVVLPFPGGAPIDFDGFIGGGNGGYPKWRGYGVLTAEKDGVSATWSTQWIGKATDFNAAPGDIGYSTPNVFYHNLQVAFEIDEKTRFQVGVDNLFDRKAPYIQSFTDANTDTMTYDLLGRRFYVGFRTAF

SEQ ID NO: 15990 - protein, 332 aa, Rhodopseudomonas palustris
MRKLLLCLGLASVLFGADNNVKFEITPTLNYNYFEGNLDMDNRYAPGIRLGYHFDDFWLDQLELGLEHYSDVKYTNSTLTTDITRTYLSAIKGIDLGEKFYFYGLAGVGYEDFSKGAFDNKSGGFGHYGAGLKFRLSDSLALRLETRDQISFHDADHSWVSTLGISFGFGAKQEKVVVEQTKEVVNKPQVVTPAPAPVVSQSKCPEEPREGALLDENGCEKTIYLEGHFDFDKVNINPAFEEQIKEIAQILDENVRYDTILEGHTDNIGSRSYNQKLSERRANSVAKELEKFGVDKSRIQTVGYGQDKPRSSNETKEGRADNRRVDAKFILR

SEQ ID NO: 15991 - protein, 974 aa, Rhodopseudomonas palustris
MFLKPRRVAWTMMASATLSLATQTGWAADATPGTPGPSSQPASQSMQAPAVLYGTVRSQKDQKPLANVPILLQNQETKATVQKTSDGQGSFIFSDLPAGDYVIEVGGGNFSLQHKEGVLKPGTVGQLDFAVNPLSTGSSELVGRTYEGHGDHKIPVAAKLAVKNTKTGEIYSLNSDSQGAFDLKNIPSGDYLVQAIKRGYVPYSAQVAVNGKVQSDIRLHINRTAQANINANENKKIKDTTGAITVVDHKTFETWQTTGIGFALSNQPGINYYSRSGANGVTGGMNYFTCRGYSTGGSNTAPSGGSNIEFTVEGVPFNENQDGGMVYDLNLFNIDIASVDIQRGVTTSANLYNYASGCTVNIHLMQPTQDPYSQITYGMGSYGQYYTSFISNTGINDKLGIGAYNDLSIINQQGFQDFTSLQEYQDYANVSKYLENGKVSLMFTGAYKNYDRGASTSLQNFQQFGPSYNGMPNGENASFPSGQYAPDSPYYKEWISQRYMITLQGEDQLNSMVSFKNNAFAYLVPYGVIQVPTGILGSPVAGASGTAFQNISPDYGGICQGTAPTTACANPFNFTYIQGQGFKVGDIAETAIQTFNGNKVHLGMRLSYNNTLYGNEPIGTPNITGNAGGSNMLTTIGGYLEDHYRPDDDWLVSAGFRVMAINEQYSNSLMSGAQTITNGANGGNAVYQPNAGEAYVVPLPHVGVNWYPSKHWKIYANAGQSFSAPSIQFFELSPGAGTINVKPEIVNDLEVGARYSTDKGFVAFDVYNDYINNMFTTSLQTLPSGVTNVLPDSAGLAEMRGFEAEFKRELPAGFSIDGSFSTVDAYFVSAQYNTGTNQVFSNSGDSIPFVPNILGNLDLNYARGNWHFTINERYTGMMNVINTSGGPLCGGSSPVCSNIQENAPGYWATNILVAYDLPKTSWYKKAQLFFNAFNLLNTNYYEPAGLVNGANNANVLMVYPGEPINVFGGITTTF

SEQ ID NO: 15992 - protein, 761 aa, Rhodopseudomonas palustris
MSYFKNNKNRWCVGVATSVVSMCLTGAGISEGRAQSTEPRVLPPVSVDAPQQRARTTRVTPQRAAAPRAARVTPRQTAERPPAPVAPPTMGTTRTIGAPAPAYAGGQVAQGGTLGLLGATSVMNTPFSTVNYTSELIENQQARTAADTLINDASVRTTTGANGFDDTFQIRGFPVAATDVGLNGLYGLASSQRVPAQIIERIELLKGPGALINGIAPGNSIGGGINIVTKRASETDFSRLTPFFMSAASYGLHLETSRRFGANKEWGVRFNGVGRNGEASIDDGNFRSGLGALAIDYRGERFRWTLDAFSQNDDTDNFRPQVSLSSIGNVIPAAPDARSNWYPGTKLRQKDNTIATAAEYDLTDWLTAYAGVGYREGSNYQTFPSSATAVDALGNFTVQNNYYDSYSKTVSGNVGLRSQFDTGFIRHKLNFVYTGYQQEYGYAYIIGNRAASNIYNPSPLPSITLPRTAPQHSADTTLQSAAVVDTMSFLNDTILLTAGVRQQNVKQDSFSITTGALTSGYDASATSPLAGIVVKPWHNVSLYANYAEGLSQGTIVTGTYANTGTVLAPYKSKQQEAGIKVDWGLITTTAAVFQITRPSLITTAANERLYDGEQRNRGVELNAYGLILPNLRGMVSATFVKPELTNPSDQTQRGNDAAGVPDKTFSAGLDWDTPWVQGLSLNGRVIYTGSSYLTTANTVKFPDWTRLDIGARYATTALTGKPVTFRFNIENVTGENYWLTTGTYVTVGAPRTYILSAAFDF

SEQ ID NO: 15993 - protein, 792 aa, Rhodopseudomonas palustris
MKISKNLSGYAAVFVCLAPHLGFAQSASPKTVRPASSGLQDTTDTSTVALPELDVIGSTPLLGSGIDKNKVPADSTVLDSKDIALRGAPNMLRALNQQVAGVNLVDSSGNPQQPALLYHGFTASPLQGTEQGLAVYLNGVRFNQAFGDTVNWDLIPNLAIDTLNLEGSNPAFGLNAIGGALSVKMKNGFTYQGGEIDLYGGSFGRMGANLQYGKRIGNVSTYLAGSVLHQDGWRDQQSTDIQNFYGDVGIRNDRAEVHFNLTMANSVLNGPGTSPVQLLQADPAAQFTAPNQISNRYILATVNGNVDVGRNTSLQSNAYYSYFQQRVMNGNSANDFPCNDGSGLMCNSDTGLPSTTRGGSPIAAYLGNNPYSYSELDAQTTNTNSYGTSAQVTNTDDLFGHQNHFVAGGSYDGATTMFGGSSYIGGITPVSRDFIGPGVLLDEPGQNVPVRVGLTNNFFGLFVTDTFDVTDRLSLTVAGRFNSAQIDINQIGGGDVTGNHVYNRFNPSAGLTYKIMPWLTFYGSYAEANRAPTQAELSCVNPAQSCSLANFFTGDPDLKQVVAHTWESGLRGSTHLTADAKLGYKLGLFHTNVDDDIAFVNSVTLDRGFFQNVGQTRRQGVDFHVDYTTKRLMAYLNYSYVDATYQSTFIEDGGSNPVTDANGNITVNPGNRMPGVPQNTVKVGVTYNVTSKWIVGAVGIGQSGTYLFGDPANTNAKLPAFFVVNLNTSYQITPHVQLFGVIMNVTNQKYYTYGTFSPTSSVYLSQAPNATNPRAYSPAAPIGGYGGLKITF

SEQ ID NO: 15994 - protein, 1038 aa, Rhodopseudomonas palustris
MIREITINFKDKNMKKGNFMFKVLLMLIAGIFLSIDAFAQQITVKGIVKDTTGEPVIGANVVVKGTTTGTITDFDGNFQLSAKQGDIIVVSFIGYQPQELPVAAQMNVILKDDTEILDEVVVIGYGQVKKNDMTGSVMAIKPDELSKGITTNAQDMLSGKIAGVSVISNDGTPGGGAQIRIRGGSSLNASNDPLIVIDGLAIDNEGIKGMANGLSMVNPADIETLTVLKDASATAIYGSRASNGVIIITTKKGKNGQAPSVTYNGSVSFSKTQKRYDVLSGDEYRAYANQLWGDKLPADLGTANTDWQDQIFRTAVSTDHHVSINGGFKNLPYRVSLGYTDDNGIVKTSNFRRFTASVNLAPSFFEDHLKFNINAKFMNGKNRYADSRCRYWRALAIDPTRPVYSNEDPYQFTGGYWQNINSTTGFSNPDWKYTSNPNSPQNPLAALELKNDKGNSNDFVGNVDVDYKFHFLPDLRLHASIGGEYAEGTQTTIVSPYSFGNNYYGWNGDVTQYKYNLSYNIYVQYIKSLGANDFDIMVGGEEQHFHRNGFEEGQGWDSYTQEPHDAKLREQTAYATRNTLVSYFGRLNYSLLNRYLFTFTMRWDGSSRFSKDNRWGTFPSLALGWKIKEENFLKDVNVLSDLKLRLGWGITGQQNIGDDFAYLPLYVVNNEYAQYPFGDTYYSTSRPKAFNENLKWEKTTTWNAGLDFGFLNGRITGGIDGYFRKTMTCVTALRSPMNILQCPDDTEYRFTGKLRYGFSINAKPIVTKDFTWDLSYNITWNHNEITKLTGGDDSDYYVEAGDKISRGNNTKVQAHKVGYAANSFYVSRGNNTKVQAHKVGYAANSFYVYQQVYDENGKPIENMFVDRNGNGTIDSGDKYIYKKPAGDVLMGLTSKMQYKNFDFSFSLRASLNNYVYYDFLSNKANVSTSGLFSNNAYSNTSAEAVALGFSGQGDYYMSDYFIHNASFLRCDNITLGYSFQNLWKTQTYKGVGGRVYATVQNPFIISKYKGLDPEVKSGIDANPYPRAMTFLLGLSLQF

SEQ ID NO: 15995 - protein, 246 aa, Rhodopseudomonas palustris
MKKFLLGTVGLIALGTAPAMAADLAARPYTKAPPIIAAAYDWSGFYVGANGGWGTSRNCWDYLGTTATPAVALGEGCHDASGGTAGGQAGYNWQISNWVFGVEAQGNWADFKGSNVSLLVVPGTTNDSKIDAFGLFTARVGYAWNNALLYVKGGAAVTSDKYTVYGNRTGAITDTASETRWGAAVGGGLEYGFSPAWTFGVEYDHLFMGSRDITFATTSIDHIKQDVDVVTARINYRWGGPIVARY

SEQ ID NO: 15996 - protein, 173 aa, Rhodopseudomonas palustris
MFAEDLAAQSYTKAPPAPVAPIYNWTGLYIGAQVGGAFQGNSGFVTDNPLVTGNRDDSSFLGGGVLGANYQFSPNWVLGIEGEFNGLSNNRYTFTDGFDGIRVKNDWLASVTGRLGYTWGPGMIYPKGGVAFRDNGGIAATTPFLVSRDTSGYTVGAGLEYMFAPAWSAKIEY

SEQ ID NO: 15997 - protein, 1191 aa, Rhodopseudomonas palustris
MGAFGMSLDTKCVCSNGRLAVLLMAATFLSTAATVEQSYAQAPQPSRAGASSRELDIQAQPLGSALIAFSRQSRLQIFVDQALVAGKSAPAVRGALTPSAALDRLLAGSGLSYRFKRGGTVTIVGPVSASMNQMPASDGSLMLDTIDISGGRGTPAEVPYRTPAPVTQITQESIERFRGSSPADIFRGTPGVMSGEARNGGGSIDVNIRGMQGMGRVAVTVDGAENGLTVYQGYQGISNRTYVDPDLLAGVDITKGADVSSRGIAGTVAMRTVGADDVVKAGEKWGVLVKSSFGTNTANPRPGDLGGYTWPRPYVSDPQPYPVPTAQASGLDRPGLFTPTSGSFSTVAAIKEANYDLLWGYAYRKQGNYFAGKNGPGAGVLDTGPQPLCYSSGFCYYPPSPISYAHVYQNTGLTSYRAGEQVLNTQLETESYLAKGAVRSDDGQSLQIGYNGYRSRAGDVIASLFSSVQSQATQQLQEDVTKVDTGTVRYRWKPEDNGLVDLKGNMWMTNLTLLTPPRTSIATNVKPEDFGLPYNYLPGNQTTMGGGDLSNRSRLSLERFGSLDVEYGASYLQEATRPTPFTNELNAGIPSREGARQEVAGFGKVAYKPVDWLTLNGGLRYSHYWSQDRSTITNASQVNPQPSRDTGGYSPSAGIVVEPIKDAQFYVNYSSALRMPTLFESVAGYSLIPNAGLLPERSNNWEAGVNLFREGVFAPADKAMMKFGYFNWNVSNYVARMSKSFVDPTYGYTYSALQVVNIDRARFEGLEWSGRYQSGGFTAEVAANYYLNVEYCPTAANCANSTLSGDYSANQVPPKYSANITLSQKLLDDDLTVGGRASYVGPRSIGYGAVQYGAAAIIAPIIWQPYWLVDVFAEYKLTKDITLRATVENLTDQYYVDPLSLVQQPGPGRTFRLGMSGKFGGSETVTPGSLTRLFAPSAAVANWSGFHAGVNTAYNSAKFGGAMTALDGSADGHAANEAPNQQVGALSFGLHAGYDYQFASRFIVGIEADVAKTDIGASQVTFASEGVACNCANNLARMRQLEAVQQSEIKWLSTVRGRLGYAVNDRLMLFASGGVAFMRQDESRTQYRAVNSGNFSWPTTTVAAFTEDSSRTRVGYVIGGGGEFAVGGAWSIKAEYLLARFTGEDFTFADARAGVLPGNFVTPATYATSSGRKLSSNVDIPMVRVGFNYRF

SEQ ID NO: 15998 - protein, 378 aa, Rhodopseudomonas palustris
MTTAATTTFSLDTVDSNQAALNGRFETSSIKHDLFLATNGFLWNRYTPFRRGAITVGSASLSNPSIFSEPNFPDFKDRYRSVYTFQQSVTLGDTIALNERWSILAAVSNSWIETSNYNNAGGVTGGYSASGWSPLGSIMFKPGENVTTYVTYANSLQQGDSAPAGTVNQGEALAPFRSNQYELGAKFDFGRFNLNAALYRIERPYAYTGSDNVFSMKRTQINRGVELMASGAINDEWTVFGGMTFIDPRLHNMGSPQTEGRRILGLSQFVMNCLVEYHVPSVQGLTFTANVNYGTNRPTDYANTSFVPDYAVLNLGMRYAQLIAGKPVTFRFDVFNVTDLHYWANETPAAQNGYNATGSATGILGAPRTIRASLQVEL

SEQ ID NO: 15999 - protein, 240 aa, Rhodopseudomonas palustris
MKTMKNTLLGAAAVIALSAPAFAADLPPRPYTKAAPAYTAPEVVYNWTGFYVGGHVGGAWAGDNNITGNSGRFFGGVQGGADYQFATNWVIGIEAQYSWMSSNNTGVIFPGGSTATEDTRGLGSVTGRLGYAWGPTLVYAKGGYAWRDSDLSVASLGGVPSGYTTSGSRNDGYTVGAGLEYMFAPSWSAKVEYQYYKFGDTTFTGGPADVVGTSFRNDEHTVKAGINYRFGWGGPAVAKY

SEQ ID NO: 16000 - protein, 348 aa, Rhodopseudomonas palustris
MEFFKKTALAALVMGFSGAALALPNITILATGGTIAGGGDSATKSNYTVGKVGVENLVNAVPQLKDIANVKGEQVVNIGSQDMNDNVWLTLAKKINTDCDKTDGFVITHGTDTMEETAYFLDLTVKCDKPVVMVGAMRPSTSMSADGPFNLYNAVVTAADKASANRGVLVVMNDTVLDGRDVTKTNTTDVATFKSVNYGPLGYIHNGKIDYQRTPARKHTSDTPFDVSKLNELPKVGIVYNYANASDLPAKALVDAGYDGIVSAGVGNGNLYKSVFDTLATAAKTGTAVVRSSRVPTGATTQDAEVDDAKYGFVASGTLNPQKARVLLQLALTQTKDPQQIQQIFNQY

SEQ ID NO: 16001 - protein, 1116 aa, Rhodopseudomonas palustris
MLGLRKICVMVALIALLALGAVCAYSQAVNATLLGTITDSSGGVIPNAKVTVTEVNTGVARSGQTNESGNYTFPDLAPGQYAVAVELQGFKKENRKDIALAVNTSTRIDIQLTPGNVTETVEVSGAPPLLQTDRADTGAQLEVVQTASLPLGTNRNYQSLLNLVPGTTRASFQHSQFFNAASSLQTEVNGQMRMGNSYQIEGIDNNERTGLLQIMVPPLEAIQAVDVSTSNYEASLGRASGANTNVILKSGTNEFHGAGYEFLRNSGLNARNFFDASVGHLAYNYFGGNVGGPIKKNKIFFFGDFLRTTDHEANTNLGTMPPSSWRTGNLSSGLTLATPVVVYDPATGNPDGTNRLPFAGNIIPTNRISPIAQKIMNLVPGPNQASSESAPSNNYFALLPYTKDTNSFDVKVDDATSDKGRLSARFSYGRPVTYQAPIFGLAGGWAQSAFQGTSIQKTYSMGVNYNRIFSPTLITELRVGVAHYHNDAHQTDYGSTASTAVGIPGVNVDAWTSGLASININGGFSTPFVGYTASLPWSRAEANISVVNSWTKTIGNHTIKWGGDYRRLRDDLLQTQTVNPRGLFQFDTAQTSLNPGPGGTQPKTGLVNNMASFLLDVPSGGGRDIAAYFPALRANQFFAFVQDKWQVSSKMTLDLGLRWEYYPPATPRFPGGFSNYNPTNNTLELAGIGSIPMNLGMDKNWKYFAPRLGISYRLNNATVIRTGFGVSYTPFPDNTYAYNFPVKQNNQYSTGASSFAPGVTPNGQFFSMASGFPAPQLAVIPSTGIITNPSLSQSDFVIPKHFKNPNVQSWNVSVQRSLPLHFTLDVAYVGNHGVRTAATYNLNVPNSPDQMGKGVNGRPLYQQFQRTADTTVYFVGYSSMYNGLQVKLNRRFTNGLAITTAYTMARGMSFQTGDDGNVWNYIYPRRSYARTDFDRHQTFVQSFVYDLPFGVGKKFLNHGLAAKTIGGWQVNTILTLMTGLPMTFGANGNSLNTPGASQTADQVAEVTKLYGINTPSKGGSPWFSQASFVQPTGVRFGSSGRNTLSGPGFFNLDLSIFKIFNFTERVKMELRGESFSVTNTPQFDRPNTDVSNSNYGYITGTIGGGRGMQLGAKISF

SEQ ID NO: 16002 - protein, 743 aa, Rhodopseudomonas palustris
MSFRLGYLAAFVALSSGAQESATSEIEKITVTGTNQNRYVIESTKSLTGFPVDFLDLPRVVNIIPEQVILDQKITDLSEALRNSPGISLGDGFGGTNDDFLIRGFRRNTVYRNGFRRETNFKTNLSNLEYMQVVRGPASITYGQVEPGGLVDVVTKKPLVESRISGEARFGSYDDGFFLLDISQPISEKAGVRVVASTQDSESFRDFTDISRDTISISGGIDITDATSLDLSYEYRDESRPLDRGTITVPTADGREVINELLDIPLSRRFGEAFEVFESEFNFAEATLSHELNADWALKVSGAIESSSANDLQARPLAAAIFDADGAITEDGFIIFDNPADIATILGLATTTEIFDDPTDQVFLIRRTDGSQEQDVDVFYANALVTGQVELGNTNHRLAFGADYRDGETTRYFVSTDFTNGVSEAIGGDGALFNVSNPIYGNLDDSLSIEGATLLTSIEKNSGLFINDYMEITDNLNILVGVRYDSFEVDGESAENIEESQLSPQLAANYNLTGTASVFVSYSTAFEPNTTVNILTGENVAFSPEESEQYEIGFKAEFFDGDLQASAAIYDIQKSNVLSTDDNDLPILIEGQSSQGGEISISGQPTDGMNIIAGYAYVDAEIGTGINSSNRPRNVAESTFNLWASYEVQGGKFEGLGLGSGLFYVGDRYGNDSNTYKLDGYTVVDLSAWYTVNIPGLGASDRLRFQLALKNIFDEEYYSASGGDLRISIGTPRTAFASISFDF

SEQ ID NO: 16003 - protein, 1031 aa, Rhodopseudomonas palustris
MSKHSKQLRRAGLTVALGLCLAGAAHAQSVTGNIYGSGEPGSTVTVQNLGTGLSRTVTVDKNGRYRAADLPNGNYKVTLQKNGEVVATRDSVQVIIASGTDVSFGAGGNVQNLDRVEVTAAAVPRVDVTQIDTRTVFTAEQINKIAVGRDIASIALLAPSVVSNSAYTANGNTVPSFGGAASSENAYYINGYPVTNPLTSIGFTTLPFDALAQQQTLTGGYGAEFGRATGGVVNVVTKRGSNEFHAGAYTYWSPESLRSDPKDLYFPNTGFYGDDNADPTKRTDGKLYQTRKKSQSWTQSSGIYASGPIVQDKLFFYANVELTKRQGEGVASTSQAAATTTNAWQEYEYEYPRWAAKIDWNITDNHLLELTGVSDVTKYYSDGYTYDYATGTPGNVQNAGTYNEDKARLYVGKYTGYLTDDLTISALYGTQKVDHSQSPWGYNPACPRTSSSATTRAPGIPAANYAGCWTAATVNVPGAYDETKGFRFDVNYRLGNHDLRAGLDNMEAESFTGSEYGGGFVWVYSRTNNPNAAIDASHGVGSPAAAGGLGNQGYYVRQQYYTQIAQVKTKQSAQYIEDRWQVTDNLLLQLGLRNETFKNYTSAGEVYVKQDNQWAPRLGAVWDVHGDSTLKLFANAGRYHLALPNNVAVRAASGSLYTMEYFTYTGVAADGTPTGLVNVPVDQSKGYTCPGKPNAISSNLECGDAPDPRTVAAVNLKSHYQDEYIIGMEQVLNSNLTWGAKFTYRDLKSAIDDTCTPALGGGCFIFNPGESNTFWQEQADGSFEQVTYSAAELNLPKLKRRYYALDLFLEGSIGEKFNGKINYTFSRNYGNTEGQLASDLDTGTGGQTDVSATQDWDLPQLMVGANGRLPNHRAHQIKAFGAYQISEEWRVGGSLLIDSGRPRSCTSFYPTADQGLYNGAYYHFCGLAGSGTAPGSAGYIPPSSDYAFSARGSKGDTPWNYTLNLSLAYTPLWADKKLTLQADVLNVLNRQEPTFYYSNYATDRVTPDQRYNQPLGYTAPRQVRLSARYDF

SEQ ID NO: 16004 - protein, 405 aa, Rhodopseudomonas palustris
MKRIKHVKITLTSTAVLAAAPAFAQSSVTLYGIVDAGIGYLSSSTPKGATGGKSSITMNSGMWSGSRFGLKGSEDLGDGTRAIFVLEEGFSSATGAQSVSGLAFNRQAFVGVENKSYGTFTGGRQYTSYYQLLSPYSPTKWLTGAYGAHPGDIDSLDTSYRVSNELKYTSPVFNGLTLGGSYALSGTPGSLYSGSTWSVAAQYTNGPIGIATGFMRVNNATTNGGPWGSNSTLSNNGSQPAVSAINTGYQTARAQQRFAVTAGYNINPQWDITASYSNVQYVPGTGSAFRDTAIFNTGGAVVHWRPLTALDLAAGYSYTRATKANRISSPASYSQFNLVQYYSLSKRTGLYAAEAYQRAGGQTLLASATSTSIVNATASIGDGQNSTPSSSRSQVGIGVGMITRF

SEQ ID NO: 16005 - protein, 687 aa, Rhodopseudomonas palustris
MTDDRATTSLRRMLLVTVSPVICVFAAGTAFAQSPARDYTQATAATGETGTVLLGEVVVAGSGGSEESIEDGNTVAVVDYTEIETFRPQTVQDLFRRESAVSVGGTIASNQKVYVHGIEETNLAVTIDGSRQNNKLFHHNATNVIDPRLLKAARVDAGVAAADAGPGALAGAIAYETVDVEDLLRDGRNWGGYVEGGFQTNGDTFSTLGAGYARSNGFEVLGFLNRVDGDDYEDGDGRTVTGTGAGLVSGLGKVAYEGLSGDRFEFSYERVTDDGVRPYRANIGSIIGGRPVPDTRIYDLDRQNVVFSYENTQATGWFDPKVTLAYSTTNLETEEDILLGGVPSGNKARYEAKAESFNATFANEFHLEMGSVNAGVDVYRETADFYDATYSTGEKADNIGAFAQARLDPTDQLSLSFGGRIDHQVFTGTNGGDQRNTGASGNASVKYALTDHFALKAGVSSVFGGIVLAETFIQNPAWIYTDIDPVRGDNGFAGFEFRYAGFMLDGQLFRTDIENGRTPEYRGGPSLTHDFTSTGFDLAAGYDWGTGNVRGGFTSVTTEMDGSGVDSYVGNYFTVPMGEIFTLALVQRVDEYGLTFGADAEFALEEEAPAKNGADPAGVQPLESYAVVNAFVEYVPPQLSNVTLRAKVDNIFDETYSDRATYGQEFSTVVPLRSPGRSFGVSARIEF

SEQ ID NO: 16006 - protein, 746 aa, Rhodopseudomonas palustris
MSSRALPAVPFLLLSSCLLTNAVHAAGQGDGSVIELGEQTVVATAQEETKQAPGVSIITAEDIAKRPPSNDLSQIIRTMPGVNLTGNSSSGQRGNNRQIDIRGMGPENTLILVDGKPVSSRNSVRYGWRGERDSRGDTNWVPADQVERIEVIRGPAAARYGNGAAGGVVNIITKQAGAETHGNLSVYSNFPQHKAEGASERMSFGLNGPLTENLSYRVYGNIAKTDSDDWDINAGHESNRTGKQAGTLPAGREGVRNKDIDGLLSWRLTPEQTLEFEAGFSRQGNIYTGDTQNTNSNNYVKQMLGHETNRMYRETYSVTHRGEWDFGSSLAYLQYEKTRNSRINEGLAGGTEGIFDPNNAGFYTATLRDLTAHGEVNLPLHLGYEQTLTLGSEWTEQKLDDPSSNTQNTEEGGSIPGLAGKNRSSSSSARIFSLFAEDNIELMPGTMLTPGLRWDHHDIVGDNWSPSLNLSHALTERVTLKAGIARAYKAPNLYQLNPDYLLYSRGQGCYGQSTSCYLRGNDGLKAETSVNKELGIEYSHDGLVAGLTYFRNDYKNKIESGLSPVDHASGGKGDYANAAIYQWENVPKAVVEGLEGTLTLPLADGLKWSNNFTYMLQSKNKETGDVLSVTPRYTLNSMLDWQATDDLSLQATVTWYGKQKPKKYDYHGDRVTGSANDQLSPYAIAGLGGTYRLSKNLSLGAGVDNLFDKRLFRAGNAQGVVGIDGAGAATYNEPGRTFYTSLTASF

SEQ ID NO: 16007 - protein, 490 aa, Saccharophagus degradans
MSRRSLPGALPVALALTTLAGSPALAQPTGRPVYEGAGGDLRIAVAQPESTSQASGGYVRSIEPSLGPFGDPLGLRPLLKERGIEYSLTYIAETLGNPVGGIRQGAIVEDRLNLRLNLDLQRLAGWDGATVHANAYFIHGTGLSRYDVGNLLAASVIEALPASRLYVLWLDQQLFDGQLGIRIGQQAADTEFFVSQTATLFVNSTFGWPAITALDLPSGGPAYPLATPAIRAKYVPGNGFSLQAGLYDGDPAGANRPGDDPEGQRLDRTGTNFRTRDPALVVAEATYAFNTQEGSKELPGDITLGGWQHFGRFESLRFDQTGLPLADPNSTGIGRRLRGNAGIYAVYDQTLYRESGKDDEGLGFFLRAAWSPTRSSLVSAYLDTGLAYKGLLPGRDNDTVGLSLAQARLSDDARRSDIDTIVLTGTPMPRRRAETVIEATYQAVVVPGFTVQPDAQLILHPGGGIANPRDPEGRRVRNAAVLGLRATVQY

SEQ ID NO: 16008 - protein, 813 aa, Saccharophagus degradans
MRAKKSILSLAVSLAMTTGLAVSAQVNAAQEQANQTQAEQEQQNNKNDSFEKIVVTSQKRTQSLNEVPVAVSVLNSDQINSAFANNMEGLQSLVPSVSFRKGTTTRNSALTVRGIGTISFSIAAEPSVATVVDGVVLGRSGQAFADLYDVDRIEVLRGPQGTLFGKNASAGVVNITTKDPSYDTTGSIETSFYQDNEYRFKGVVSGGLSDDLAASLTVFKGKFDGYIDNVYNNEKVNGYDREGARAVFKYEPTDDLNVKFIAEYYNADDDCCADLEALPSGRNPDSKAAPNSNGIVDGVADIDLDQRKVDHDYESRTIDKHSAFSVQVDKTIGDHTYTSITAQRSWDNTEFREGDFTSIAGDSNQPVFGVPFQLHDIGEQQWDQFSQEFRVTSNLSGAFNYVAGLFYWNMDSQRNFTRDASCQNNAGQLDSAMAFYAQNNLSGADLDAALADLDGYAQGLGVSCNANDIVSATAYMSTEFNNWAAFADGTYELSDDLTMLFGLRYTDDEVSYTHRRVSNDVYGRRGVGVRPATLNTDEQGKAEETNVSGRLGMQYDLGDGQMVYGTYSQGYKGPGFNIYYNFNPDNDGREIAPEESDAFELGYKYASSDFVFNFAVFKTEIEGFQANNFDCSDGTCITRLTNAGDVSTQGAEVDFMWAATDALTLTGGIAYIKAEIDEFNCPPEVAAGSCTDRSGLDVPFSPDLKYSLSADYFIETEHGFNVHVNGSYIYTDEQYSDLPNNVGEFNPAALLPDYGILNASVGLSFKDDAFRVSLIAKNLTDESYATTYSGDNFRYQIPRDAERYFGVSFKARF

SEQ ID NO: 16009 - protein, 724 aa, Saccharophagus degradans
MSTPYRPAMRHAWRLLPLGMAVASPLMAADPLTLDAVNVTGFSEQEGASDYKAGRASIYGFDQASLLDTPASVSVFSEALIKDRQAKLLSDVLRNDASVGDGYAPVGYYENFVVRGFSLNAANSYRINGRSIAGEQNVALENKQQVELLKGLSGLQSGVSEPGGVINYQTKRAQDVRSVTVSTNEHGERYLATDVGGWFGSEQQFGLRANLAHEDIRSYVEHADGQRDFASLAFDWNISERALLQLDIEYQSKEQRSVPGYQLLGGTVLPHDASPRKLLGYQNWSNPVGIDSLNMNGRFEYRFNDSWKGSLSASRSRVVIDDYSAFAWGCYGSASCAAEAVPNHFSAEGGYDIYDFRSPDDTRRNDEVEAAMSGTFNTGSLGHELTFGTSAYRRIVDTRGTFNEFVGSGTINESPESVAPSPLTLPHTERRLDSRQYGLFMTDRISFNEHWQTVLGGRQVRLDEQAFTEDGSDARHTERYVFLPQAALIYKPVDNVSLYTSYCKGLSLGGTAAWFTTNASEILAPTVSRQLEAGIKYDWQRMSLTAAVFQARQAYQYSRPNDDGTFTYVQQGEQKNTGFELGASGWVTDRLQISASAAAIRARVEDSGTEAYDDHQALNVPRYRGTLQADYSLPVSGLALLGGMQYSASKYADREGSVQVNDYTLFNIGSRYSTRISGYDTVLRLTVDNLFDKRYWRDAGEYLGDDYLFMGAPRTARLSATVNF

SEQ ID NO: 16010 - protein, 381 aa, Saccharophagus degradans
MAHTIKALAISIGAALALTSLPSHAEITLLKQDPQAGDPLSRLNFTVGGSIRPQFNMMTGDGDKGSYKRNGFDGGTRFRFAADYYLFDDISWISYYELGVNIPALFDWDNHYAEGANNTTRRMLYTGLKSDTWGTLTYGQQNSIYYDVVGVKTDIWDYDMIGQAPGNGINGDYDGSYRSRNMLKYKKTVGDVDLYGSYLFEDSEYLPGNGLRYKRKGGGSVGADYHIMKDLTWGTAWNYTRAEMRDPSSADSKTYDQNIVGTALSWTPDNWTFSFGGGWYQNFLTTKKTDVHNYFAGDAWGIEYFAGYKFPINQYAVKSIQPYFMGDRLEYVNGRNYQRIDNGLGISFQLDYGFRVDYEHVFTSSTDNLGDMNLVRLRYDF

SEQ ID NO: 16011 - protein, 213 aa, Saccharophagus degradans
MAKNYYDITLALAGICQSARLVQQLAHQGHCDADALHVSLNSIIDMNPSSTLAVFGGSEANLRVGLETLLGVLNASSRQGLNAELTRYTLSLMVLERKLSSAKGALDTLGNRINGLQRQLEHFDLQSETLMSAMAAIYVDVISPLGPRIQVTGSPAVLQSPQVQAKVRATLLAGIRAAVLWHQVGGGRLQLMFSRNRLTTQAKQILAHLTPEL

SEQ ID NO: 16012 - protein, 695 aa, Saccharophagus degradans
  misc_feature (12)..(12): Xaa can be any naturally occurring amino acid
  misc_feature (17)..(17): Xaa can be any naturally occurring amino acid
  misc_feature (695)..(695): Xaa can be any naturally occurring amino acid
MKKTFFYSTVAXAVALXISPAIAQETAVLDEVSVVSSGSMYKMGEVPVHQAKSAVAISREDLDKQDVKKADEIGRYQAGFANQVFGNDTNTNWFRVRGEEVSQAVDGLPTFSYGFFTPYVETFGLEAVEVTKGADSMTFGAANSGGLINYVTKRAHRDQIGRGEFKTNFGSNNLYGFGADYTGKITDDENVRYRVVASLNHTDGEWKDTDNKTVYIAPSLEWDISDRTRLSILTSYQKDSGTPSSNFYPQEGTLRALPDGSYYSRNVNFGDPVNNHEENKQYSIGYELSHDFGNGLRANSSYRYSHVENNHRGGYIYPSAYAADWSAVAPSANGYNVSGQTVFNQGKAISHSTDNRISWDFKNDWLKNTVVVGTDYRHNKVDAQYSLYALGYTANLRDYRATWNQTGTPVGTDTHIKSRQLGFYLQNQARIADKYLLGFGIRHDRARQNEYTSDQTVKNNHTSYSGSIMYEGAYGLNPYFSYSESFRLPVGLSGNQSLYDPNITRQYELGVKYLPTWLDGVITLAGFRAKDTGALVNNGTGATISSADPIYRKGFELQTDVNLTENWNATLAYTYTKAESEAATGEKTRQSLIPTNTLAARTAYSFTDSVLNGLTVGAGVRYLGHSVTSKGSLYSHVRLPSATVVDLMARYNINQNWLAQLNVDNVGNRKYVAACDYYCYYGAERKVNATVSYKX

SEQ ID NO: 16013 - protein, 749 aa, Saccharophagus degradans
MIGICISTPLWAQTQDTTQAGSDTAATQQKETTATDNKATTGDTLVVTAQQQVRQALGASTITAEDIRKRPPANDLSEIIRTMPGVNLSGNSASGQRGNNRQIDIRGMGPENTLIMIDGIPVSSRNAVRYGWRGERDTRGDTNWVPANMVEKIEVLRGPAAARYGNGAAGGVVNIITKQPDKELHGSWNAYMNLPQHSEEGATRRTDFSLLGPLSDTVSFRLYGGYNKTDADDWDINQGHESARTGNQAGTLPAGREGVRNKDINGLLRWEFAQGQSLEFEAGYSRQGNIYAGDTQNTNSNAIVRSLYGAETNVMYRDNFSLTHRGFWDNGVSTTSYVQYENTRNSRINEGLAGGTEGIFSNNYFSTIELDNYLAHSEVNLPFELGVNQVLTVGAEWNDQKMNDPTSNTQTTTEGGSVSGLTGTGRNTRTSAQIASVFVEDNIELTDTTMLTPALRFDHHSTAGSNWSPGLNLSQELGDYFTMKMGIARAYKAPNLYQTNPNYLLYSRGQGCYGGGGSCYLMGNDDLSAETSVNKEIGFEFHDDGIIAGITYFRNDYRNKIEPGLVSLGTANGGTGTYANSDIFKWENVPKALVEGLEGNLTVPFTDTVQWSSNLTYMLESKNKSTGDYLSITPEFTLNSSVNWQATDDLSLLSTVTWYGRQKPKKYDYQGLPVTGTARNEVSPYAIFGLSASYTVTKNVSVTTGIENLFDKRQFREGNAQNVANIAGAGAATYNEPGRTYFVSLNTQF

SEQ ID NO: 16014 - protein, 747 aa, Saccharophagus degradans
MKIKLIVSLIGAGIALSGAATAAQNGAEEGKGKVVFSPLNVSAAQSSSGSSEKEALEKPGAFSSRGENKNLESVDSILRSMPGTYTQIDPGQGSVSVNIRGMSGFGRVNTMVDGITQNYYGSSPSDAAHGGLPTSQFGALIDPNFIVGVDVARGNATGSAGVNALAGSANFRTIGVDDVVFSDNPFGVRTKFSVGNNGIGRSGMIAVGGKTDAFGEGGSLGAMAAISGSSITSNYKNASGFDSEEFNVDKTYRQNPKSQLFKVDIKPDAFNSIELSARTYQNKITRRHIDSNDFYIKYHYAPFSELIDFNLTASTSRGEQKFMSDNMAGFSDSTAKNISDALDVNNTSRFSLQEVDFAFSYGGKLIRNEYKKRASGLVTDEGQAESSPVGIAGKQNIASLYSGLQLNYGIWQGNFDLNYSAYDISGYKPACDERVACFPQGASNINLKEHGFNPAVMLSAQVTPWLQPFVSYNKSMRGPNIQEVFFANSGGQSMNPFLKGETAETYQAGFNANAHDLLFKQDSFQLKAVYFESKIKNYISSQSYMVCSNRQKCNRAQTSQEEWDNADVNVAMTMYSNSYEPVRSRGVEVEAMYDAGFAYTKLSLSKEHTSQPTNQASNVFGAGDISELPELYFTLDTGVRLLDEKLTLGGLVKYTGKAVRLSPDSNVDENEQLLKEPAPHIPTVIDLYSTYQFNRNLLLKFSVQNLMDKDYSDALNKMNAMPSQSRDFSPTNTARGRTYIFGGEVRF

SEQ ID NO: 16015 - protein, 720 aa, Saccharophagus degradans
MKTETKVIKGRQGIARNRHTPLCLGLLLALSPLAAAVADARKDGETELPDMVISGESTSATQPPGVTTLGKVPLKPRELPQSASVIDHERLEQQNLFSLDEAMQQATGVTVQPFQLLTTAYYVRGFKVDSFELDGVPALLGNTASSPQDMAIYERVEILRGSNGLLHGTGNPAATVNLVRKRPQREFAASTTLSAGRWDRYRAEVDVGGPLSASGNVRGRAVAAYEDRDYFYDVADQGTRLLYGVTEFDLSPDTLLTVGAQYQHIDSITNMAGVPMAKDGSNLGLSRDTYLDVDWDRFKWDTYRAFGSLEQQLGGGWKGKVSAEYQEADSRLRYAGSFGAIDPQTGDGGQLTGAAYKFKSIQRSLDANLNGPVRLFGLTHELLGGVTYAQGETRQDTARFLNLPNTPVNVYRWDPHGVPRPQIGQYTSPGTTTTTQKGLYALGRIKLAEPLTLVVGGRESWWDQDTPATRFKPGRQFTPYGGLIWDFARDWSWYVSYAEVYQPQADRQTWNSEPLSPVEGKTYETGIKGELADGRLNLSLAAFRIDLENNPQEDPDHPGPPNNPFYISGGKVRSQGFELEGTGYLTPYWSLSAGYTYTSTEYLKDSQNDSGTRYSTFTPRHLLRLWSNYDLPWQDRRWSVGGGLQAQSDYSVDYRGVSMRQGGYALVNMRLGYKIDEHWTAAVNVNNLFDRTYYQSLSNPNWNNRYGEPRSFNVSLRGAF

SEQ ID NO: 16016 - protein, 703 aa, Saccharophagus degradans
MKISFHLALLPTLIIASFPVAAADTQDNGEHYTATLPTVSVVGQSDTSVLKGYINYDEAAVTRNGQLIKETPQTIDTLNIQKNKNYGTNDLSSILEGNAGIDAAYDMRGESIFLRGFQADASDIYRDGVRESGQVRRSTANIERVEILKGPSSVLYGRTNGGGVINMVSKYANFKQSRNIGTVYGSWANRSLNMDINEVLNKNVAIRLTGEVGRANSFRSGIDSKNVMVSPSITVKLDNGLKWTGQYTYDNVERTPDRSPTKSVYDRFGLPYRMGFAHRNDFVKDKLQVWRSDLEYAFNDKWRAQWQLAHRTAAQDFDHFYAGSENGNLIKRNYAWQQTDNKTLSSNLTLNGDYTIGRFENHLTVGMDYSREHRNPTLGFSSAFSASINPYDRASWPASGRLQPILTQNRHKADSYGIFVQNIFSATPDLKFVLGGRYDKYTFNSENKLTGSSRQYSGHSFSPNIGAVWNINPVHTLYASYNKGFAPYGGRGGYLSIDTLSSAVFNADPEYTRQYETGVKSSWLDDRLSTTLSAYQIERFNIRYRPDPKNNPYIYAVSGKHRSRGVELSAIGQIIPKKLYLRGSLGVMQAKVVEDKENPDRVGIHLNNTSNVTGNLFFRYTPTENLYGEIGVTGTGKRYGYDSRNKEVTTLPGFARVDAMLGWNHKNVNVTFAAANLFNQKYWRSDSMPGNPRGYTARVNYRF

SEQ ID NO: 16017 - protein, 420 aa, Saccharophagus degradans
MEFVHRFKPCNLAITTLFGLLTSSSLWAADTTQQSEDEWKFTLKNAYINRDFDNDALKDTGSWSQAASLFYKSKMHDTPLIIADKPITIGADASVQYAVRLSSDKHVADTVLPFNKETQSQASDYLKYGATLKLGYDKTLLSVGELWLDLPVTAVDASRQLLASYWGTNLKSQLSDQLYAEIGRVEKVSPRNEEDFKKFSFTANGITKESDGLNYIDLRYQFTPSLKGEYYFGNLEDLYNKHYVGLEHNWKQPNFALTSKFKYFNAKDDGNTFDIDAQNIGVLETLKVKNHTFGLGYQQIIGESAYPLPDGFLPETYFINWNATGFFKEDERSYHVMYGYDFKDYVPGLNAMVKYVYGHDFKAANGEKNHETESNVILNYAFQQPLLKGFALQYIRIDYNVKHGNDFGEDRLFVNYTKKF

SEQ ID NO: 16018 - protein, 379 aa, Saccharophagus degradans
MNTCITRTVSLLLMSLGICPAMQAQAEGFPTLNRLASGFGYYGVDQGFDDKLKIYGTVDAFASYHDSQHHSGFQMAGGGAWTNKLGLYARKALAPDTVLELDVEEGFNLNGKALEGTWDNIGTLRLATLALRSRSLGRLEFGKTYGVGTPTYADPFLAAYGSPYTFLSIPAAGKGAYYLDLRPKHTLAYTSPNMNGFSLATALSFGFDDVASQGRTVRGGGAKLQYRNSRVMLLGSYNLYYSDPWDDGGSSRQTANHYTSLSAFYDFGPLATSLTWQRQDVDQAGTPSTTVYTFGLMAPVGKLDVLRLAVVQRTVSAREKDALGAVLGYDHFFNPRWAAYARLGVIANQGASSVTYAGTPIDQVGDDPSNISLGMYYHF

SEQ ID NO: 16019 - protein, 355 aa, Saccharophagus degradans
MKRFLMALNLVLLNNVAIAQSSVTIYGSLDEGITYVSNEHGGHAAVVSPVAVPDFFGFRGVEDLGGGMKALFRLETGFRSNNGTNLVAGDMFSRVAMVGLSSPWGGVTLGRQFDLTNETLMPNANGVLQYAYYLMHPGNLDNIGVTEVNNSIKYSTPDFGGLSFAVEYGMADSTTQPGRVLSVDGIYNRGPFRVAAVYSSWHDRSVDLATTLGYSSFLGQTLGGGKLFTAKSTDITGIAGRYQVSQYVAIHGMVTHISFDAPLGSAHMATAEAGADLSVSPFNTVTIGGYVSSLTGTHYQEIGLGDLYSLSKSTIVYAQTIYQHANGLGHPAMPLLAPSDDSSQLIFRIGVHHFF

SEQ ID NO: 16020 - protein, 744 aa, Saccharophagus degradans
MSHPDLLSRQNHNVSPSTLGLTLACILGSFPCQVLAGNVLGVPKVTGIEVIEVSGIQHRRPMAIVTPGEALITMEQLEEMQASSFAEVIDDMAGAHIDGGTRSGGERINIWGFGETEDLNVYVDNAPVGFEQYRYGSFFIDPDLLKQVEVIKGAHDVRSGNGGFGGAIYAVTKSASDFLKHDQSFGSRVKASYASNNETKGYTATSYATFSPELSALLHITGKEADDTELATGEAYAYSGFEQQNYLGKLDFEQGDHQLALSFTRYLDEGRKPWANRRGAMPTISDYNIKKYGSYEQALYATTSDNTYRENTWSANYRYSPSNPLIDTQVAISHSSNDRHWIRPDIAWEKMFVSVGSFGHESWLEYKRDFVDINNLSRFGNHELITGLQYRSLDRNSLVFNKSYQKKAEKNFGLYTPYYQPSGRQDTYAAYIQDRISLTDELTIKPSLRYDYIYSVGRENLASDYNDLAAGHDYSATDHSGWSPRFGLEYRLSTNHQLSFDYAYSLMAPVVDEIYAVQYAKASITATSPEVELERLHAYKLGLTSSFSDLFAAQDRLATQVTLFANHGENDIAQRRGENSDKSLPLQSNYTNLDGYKMHGVDIEAQYRVARFFSDLAASWQAGTHNGSLRDSQGDDEYLANIAPLDIKLRLGYYLTDELSLAWQGAWYDAQDKVPSEDLFNSELPSDNYFLQHATLAYEPQGSLSGLTLRLMLKNITNVQVTPFLSDGIPAAGRDVRLSAAYSF

SEQ ID NO: 16021 - protein, 1062 aa, Saccharophagus degradans
MFKPLKSVSVLLLLFAMPAAISYAASENGATSVSVTQQNGTCKGVVKDKAGEAVIGASVVVKGTTNGVITDLDGNFVLSNVPDGATIQISYVGYTPQEVKFTGKPLDITLQEDTQTLDEVVVTALGIKRQKRSLGYSTTTVGGKDFTEARTTNIGNALSGKIAGVSVSGNATGPGGSSRVVIRGNASLTGNNQPLYVIDGVPFDNTNIGSAGQWGGKDMGDGLSSINPDDIADIQVLKGAAASALYGYRGGNGAILITTKSGQKGKPVSVEFNNNLAFDVIYDYRDFQNVYGQGTQGNRPLSADVAKATETSSWGEVMDGKKAVNFLGNEYAYSPVDNWKNFYRTGINNTTTLAVSGASDKISYRFGVSNMAVKGILPNSSISQQGINMNTTYDISSKVHLMVNANYVFDKNKGRSNLSDGNSNTNAALLYHANSFDIRWMERENPDCDWGTGADGKELLGGTNGYFNNPYWLQYRVTNETNRNRLTGGMTLKYDIFDWLYIQGAVTRDGYNLEYSEVKPIGSASPEDPRGYIKEYTQNFSEMNLNYLIGFNKTFGDWSVGATFGGNRQRNITKKYGLDDKASSFFVPDFYSSSNTAKHVYKKEYTEYRVNSIYGTADLGYKNQVFLNLTGRNDWFSTLDPDNNHYFYPSIGMSWVFSDTFKTPDWFTFGKVRASYAAASNGTKAYQNLLTYKVDNYQSNGQPVVTINNSTVPNKGLKPVQISEWEIGLNLSFLDNRLSLDAAYYVKTTKDDIVQVTTSGASGFESAIQNVGEIRNNGVEVMVNAVPVHTKDFNWNSTFNIAYNSSDVKYLGIDGTGEKIKRLTLDGANSRVGSVSVQNILGHPYGELVGYEYKRTSDGQVIFENGLPVHSDEVQVLGNGVYKVTGGWRNEFTYKNITLSFLIDFKAGAKMFSGTNLSLYSNGLHKNTLQGRGADGKGTMVGNGVMSDGKGGYVKNTVAVSAQDYWQAITSQNIAEEFVYNASFIKLRELSVGYTLPQAWLNKQTLIKGVTLSLVGRNLWTILKHTDNIDPESAYNNGNAQGLELNGYPATRNVGFNVNVKF

SEQ ID NO: 16022 - protein, 332 aa, Saccharophagus degradans
MRNHRISLQDIATLAGVTKMTVSRYIRSPKKVAKETGERIAKIMEEINYIPNRAPGMLLNAQSYTLGILIPSFQNQLFADILAGIESVTSEHNYQTLIANYNYDRDSEEESVINLLSYNIDGIILSEKYHTIRTVKFLRSATIPVVELMDVQGERLDMEVGFDNRQAAFDMVCTMLEKRVRHKILYLGSKDDTRDEQRYQGYCDAMMLHNLSPLRMNPRAISSIHLGMQLMRDALSANPDLDGVFCTNDDIAMGALLLCRERNLAVPEQISIAGFHGLEIGRQMIPSLASVITPRFDIGRMAAQMLLSKIKNNDHNHNTVDLGYQIYHGNTL

SEQ ID NO: 16023 - protein, 1053 aa, Saccharophagus degradans
MRNKLNVQKKMILRHYWLKDIMPLSKKSILMATLLSLGLVTTADVYAAKDNQTHIGEVVASTQGVMQTAKKLTGKVVDAKGESIIGATIKVKGTTQGAISDIDGNFNLPVDVSNPTIEISFVGYQTKTMKATAGAPLVITLEEDTQLLDEVVVVGYGTQKRMTMSSAVATVQGDKIKAPVANVSNQLGGQIPGIITRQTSGEPGKDAATVLLRGNKPLVLVDGIERPWEKVNQADIESISVLKDAAAVAPYGLKGANGVILINTKRGKEGKVTLTYDGSVGFQTPMNTPDFLNAYDALTLYNEALRMDGRDKEVYGDDLLQKYKDGTDDRYKNTDWMDEYMKTTTTTRHNVSLSGGNKFINAFASFGYMYQGSMMGKDTGYDRFNLRSNVDFHPIDITKVSVDINLAYDTKKSHYYDGKKMMEDLYRLCAPTVPNMVGGKPAMQGGGSSMYMGVHDGADKTYNNNFQNITVSLDQQLPFLKGLSAKALFSYDRQIYDAKEWQYPFTAYAYNDAGEIEEQQGGEAKPSLNITNKQWTYYTIQAHLNYERRFGKHEVGVLGVFERRWGNTVETKAGRKNYDFMIPELNMGSPVAEFISNSGTTTRFGQQGYVMRLNYNYAQKYMLELAGRYDQTYQYAPDRRSAFFPSVSLGWRLSEESFIKDNFSFINNLKLRASYGKSGNPVGDAFSYLSQYKIENGAVFGKNPTQLQSLVEGAEPNIFLTWETVWKANIGLDINFWNDLLIAEFDVYRDKRTDKILSPNAIVSSEYGIGLAKENAGEDERYGFDAALSSHYTFNCGLKMSNSVSFGFTRDKQIEIREAPGTKNNPRKRKTGQPSGRTWGYKAAGLFKDQADIDNWAYQKGVLPGDIKYVDINGDGKIDSEDQVIIGFNETPEVMWGYNLRLEYKNFDFSMFIQGAGGSDYYLGSNGDRNVRYPFKDAIHPRREHLDSWTEANPNPNAKYPRLSASIRNQNYETSSYWMVNTAYVKLKSLQIGYTFKPQLLKKAKMQSLRLYADFYNLWTIYSKMPDDFDVENQAFNSYPQQIISSFGVSVTF

SEQ ID NO: 16024 - protein, 601 aa, Saccharophagus degradans
MTISKFASSTLPRHGMLLLSISGLCAPAANAQTSEQRTDAEATTLDTLKVQGQRQRRLESPEAVGSRLGLTQRETPASLQVIDHTDIATQGARTTSEVFDMVAGAMVGNVPGNPAVVTMRGFSGNTISVLHDGVRLGASTIVTRNLDTVGLERVEVLRGPASVLYGEGALGGATGANSDLLRWRVDLPLGNHWSLQNDLSWYQADRDFFYSDNWIYTPATGQLSRTAERIQHDQRFWNERLALSFDGRLGRHRNRFTAGMEHNDTKFHTPRQTGVTTPVSPLDPVLGVFPDGSAANFPGAGNNVIFDSRLRTLAVFAENALNLTARWSLLAGARVEKIQLSRDIRDVNTGNVASFRPDYRPFSWRVGTVFDLTPEVQLYGHYATAVSPVSTLLTMRPAAGVFDLSKGKSLEAGIKANAWGKRIEWTAAAYRIERDNILTRDPANPSISVQGGAQSSQGVELSAQAQLTRGLRLDLAAAYGTARYDRLLEAGGADRSGKRPPNVPDGSATLAASYRFLRVPLSLGASSRNVGGFSTDNANTIHVAGHTTFDAWLGYDWQRVSAVLRVRNLSDALYGTYSGYPSTHIYLGAPRSIELTLRTRF

SEQ ID NO: 16025 - protein, 136 aa, Saccharophagus degradans
MSIKQMPGRVLISLLLSVTGLLSGCASHNENASLLAKKQAQNISQNLPIKSAGYTLVLAQSSGTTVKMTIISEAGTQTTQTPDAFLTSYQRQMCADPTVKLMITEGINYSITINDTRTGNQYQRKLDRTTCGIVKA

SEQ ID NO: 16026 - protein, 1029 aa, Saccharophagus degradans
MRNNFLLIVLIMALIPLTSYSQDNKKKQFTVAGVVIDKTGEPLPGTTIYVKNAPGVGTSADMDGKFSIKIDANQILVIQAIGMKSIEKLVTKDEMTLKVTLEEDDTKLDEVVVTGMTSQKKISVVGAISTIDVAQLSTPGTSLNNMIGGRLAGVITMQSSGEPGKNISNFWIRGISTFGASSGALVLIDGIEGRLEDIDPDDVKSFSILKDASATAVYGTRGANGVVLVTTKRGETGKLTITGRATLKVSHIKRLPEYLGAYDYALLANEARAMSGEDDLYSRLELDLIKYNLDKDLYPDVNWIDEIMKRTSIQQNYYINAQGGGDIARYYLSLGYQDEGAAYRQEDNLFKKPLSYKKITYRANIDMNLTKTTKVYFGLDGYISNYTSPGGQNTNTVWSAVRQLTPLMFPKTYSDGTFPSYGKHDLASPYVMLNNTGYTQDETQRNMLTLKLEQEFGGFLKGMTASVQAMSENINYFNEGRYIWPDLYRATGRSSQGVLIKTLRTAKENMKYTQNNNRYRKYYMEAKANWDRTFGLHSLGALALYYMEDVHNTQWDYDAMGINAIPQRRQNLSGRISYGYNNCYFIDANFGYTGSAQFEKGKRFGFFPSIAVGWVPTSYNWVNEAIPWLSFLKFRGSYGQVGNDQISGDRFPYLTLINDNAASYWGYRERGITETVKGADNLQWEVAKKLNFGIDAKFFHDKLSVTVDFFRDTRDHIFQDRVTLPKFVGMVTVPKSNVGKMHSYGSDGNFEFFHQINKDMSFTVRGNYTFSQNIIDYYEENKLPYDYLSVTGKPFNILRGYIAEGLFSSKEEINTSADQSGFGRIRPGDIKYRDVNGDGIINDDDKVPLSYSNQLPRVMYGFGADFHWKDLTLSFLFKGSAKVDYYRSGLGNDAGWIPFYNGELGNVIKLANNPKNRWTPAWYSGTTATENPHAEFPRLSYGGNTNNSQLSSFWKRNGSFLRFQELSLKYNLKTPWIKKTGLSSVDLEFVANNLFTIDKVKYFDPEQASANGAAYPIPATYTFQVYLKF

SEQ ID NO: 16027 - protein, 916 aa, Saccharophagus degradans
MIRQHGKLTFLSFLLVVSCGNTFAQKIPVIPLDLDSLITVGYATGSLKTLSGSVEKITEKQMNKDQVTNPLEAIRGRVPGLTIQRGTNGPAALDAVRLRGTTSLTSGNDPLIIVDGVFGDLSMLTSIYPTDIESFTILKDASETAQYGSRGASGVIEVTTKKGMQGRTQVAYNGSFGISTVYKNLKMLSGDEFRSVASERGISILDKGNNTNFQKEIQQTGLQQNHHVAFYGGSSTSSYRVSLGFMDRQGVILNEDMKNFTSNMNMNQKMFDGFFDCELGMFGSILKNHNLVDYQKTFYSAATFNPTYPNHKDPVTNSWDGITTASQITNPLAWMQVDDDDATSHISTHARFTFNLMKELKLVLFGAYTYNIVENSQYLPTSVWANGQAYKGTKKMESLLGNMMLTYKKGWKKHFFDVLALAELQKETYTGYYTTVSNFSTDKFGYNNLQAGAVRLWEGTNSYYEQPRLASFMGRFNYTYADRYVLTLNARTDASSKFGANHKWGFFPSISAAWVVSEEKFMKRLPVVDNLKFRIGYGLAGNQSGIDSYTTLNLVKPNGVVPVGNSAVVSLGDLRNTNPDLKWEVKHTFNTGFDVALFGNRLLLSANYYNSRTTDMLYLYNVSVPPFTYNTLLANIGSMRNWGTEIAIGITPLKTKDMELNINANVTFQRNKLLSLSGMYNGEMISAPEYKSLASLDGAGFHGGYNHIVYQMVGQPLGVFYLPHSTGLVSDGNGGYTYGIADLNGGGVNLEDGEDRYVAGQAVPKTILGSNISFRYKHFDLSVQINGAFGHKIYNGTSLTYMNMNIFPDYNVMKSAPKQNIKDQTATDYWLEKGNYVNFDYVTLGWNVPIEKVQKLKKYVRSLRLAFTVNNLATISGYSGLSPMINSSTVNSTLGVDDKRNYPLARTYTLGLSINF

SEQ ID NO: 16028 - protein, 206 aa, Saccharophagus degradans
MKKSVLALALCSLTALSSQAFAQQVQEGPWLVRVRAVHLDPANKSDPVGGTGAANRLTIDSKTIPELDISYFFTPNWAAELVLTYPQKQRVSLDGKEIGTFKHLPPTLTMQYHFTPEKTISPYVGAGINYTRISSVKLLNGAAQLESSSVGLALQAGVDFKIDKKWSLNLDVKKVQIRSDVRTAAGQLSAVKIDPWLIGVGVGYRF

SEQ ID NO: 16029 - protein, 955 aa, Saccharophagus degradans
MLQKTSIARAIQFSLASLTIAAATTSTTTFAAEAEANIERVQITGSRILREGAIAPSPVTSISGKELLATGAMNLGEALNELPALANTYSLANSGNYIGTAGLSLLDLRGMGANRTLVLVDGKRHVSSSAGSASVDTNTIPTAWVESVEIITGGASAVYGADAVTGVVNFRLKKDITGLDVSVTAGKAEDSPYKNHKFSFSYGSDYADGRGNAAIAVEFSGQNSINATERDQTRTPYMEVKNSANKDSKDENGNTIHDGIPDRITVANTGWYDSSIAGNFYVEDGDNVNWYIFNPDGSVRPQNLGTTYGEWGRCTNCEILNLVEYSDLQPEFKRYNVNVKTNYDITDQVSAYADAKYVNSQGDSVGQPSFFEYGSALNIKKDNAYIDSSLRALMNNNGLDSIDIHRFNKDAGRRIENNERETVRIVSGVEGFMNDDWSFEAYGLHGETKLTQTNYNNLIRKNFAQSIDAVLVDGQAVCRDVAARAAGCVPTSIFGYGAVNDAAKAWFNTSSVSESTIKQTVFNASIANSSLIDLPAGFVGFAAGVEYRKEQSDSVPDEFAATGATFLNALQEEHGQFNVKEVFAEVTVPLLVDQFLIQDLVFDFAIRYADYSSIGSATSWKAGLDWTVNDEVRARSTYSIALRAPNIGELFGPQNQTYFRVNDPCGAEYAQSAIRVANCAALGIPADFDPTATASSIEGLNGGNPDLKPEESTSFTAGLVYEPDFINGFVVTVDYWSIDIDDAISAVSAQDVLDRCVDASNGIDNQFCKLIQRDTATKELKLITSISQNVAAQTAQGVDFELGYDFDAFGGAFKTKLIGTYLKSRKTFSFQNNPDDFEQNAGTVGEAQWQHNFTVAYSRDNWNGTWKTRYLSAVDLNSAQDLVTNPDPSDIMSYGSYVVTDISAGYTFDSNVAVTVGIDNLFDRDLPGVTNGTGAGTASYDNIGRFFYTQVAYSF

SEQ ID NO: 16030 - protein, 409 aa, Saccharophagus degradans
MYKQAVILLLMLFTASVSAALPARYMQTIENAAVWAQIGDKMVTVGNIRAGQIIAVEPTAASYYAFNFGFGKGFIDKGHLEPVQGRQKVEDGLGDLNKPLSNQNLVTWKDTPVYNAPSAGSAPFGVLADNLRYPILHKLKDRLNQTWYQIRIGDRLAYISALDAQPDNGLSVLTYHHILRDEENTRFRHTSTTTSVRAFNNQMAWLRDRGYATLSMVQLEGYVKNKINLPARAVVITFDDGLKSVSRYAYPVLKQYGMKATAFIVTSRIKRHPQKWNPKSLQFMSVSELNEIRDVFDFQSHTHFLHRVDGYRRPILLSRSEHNILFDFARSRRALAQFNPHVWYLSYPFGGFNDNAVKAANDAGFHLAVTTMKGKVKPGDNPLLLKRLYILRTDSLETMSRLVSNQPQG

SEQ ID NO: 16031 - protein, 1135 aa, Saccharophagus degradans
MKNKHAQLKLFTLFSLLLLFCTFESMAQEKLITINVKNVSLKEIFNIIENQTPYRFSYRSVVLDADRNISISAENISVTTVLNQALKDRNLEYSIVSPKTIVISDKQTGNVKSSETKKISGIIKDVNGEPIIGANVKIKGQSIGTITDIDGRFVLDASTDATLQISYIGYASLEMNTGNKKELNIVLKEDTETLEEVVVVGYGVQKKANLTGAVSSVKMDEILGDRPVTSVSNVLMGAMPGLQVTGTSGQPGAEMSFNIRGVNSINEGAPLVLVDNVEMDINMLDPNDIESISVLKDAASSAIYGARAAFGVILVTTKKGMKDTRFSINYSNNFSFSKPSNLPHKATPLQTVQAYKDMGTVSYQTGQNVDTWLELLKEYDTNSGNYPDGYAVVDGLRYSLQETDLLNDMMETGFQQTHNISVGGGNKSISYRMSAGMVDQNGILVTDKDSYKRYNISSYIRSDIHSWITPELDIKYANSHSELPYTSASYGIWGAAVAFPSYFPLGNMELDGEILPINTPHNFINLSAPKENDRNDLRIFGKLTITPFKDLKIIGEYTFNRKTREITTFDKKFNYAHGANFRKEQSVSNSKYEIENRATNYNAFNVYANYNKTLGKHDIGIMAGFNQESNAYKMMKASRTDMINEDLPSLSQATGDYKNSDEFEEYHVRGVFYRINYSYAGKYLLETNGRYDGSSKFPKENRFGFFPSVSIGWRVSEEQFMEWSKVFLSNLKLRGSYGNIGNQSIEPYAFIPGMDSPLANWVVNGQATTTLAPPALVSNSFTWEKVSTLDFGFDLGLFNNRLNVVFDWYQRDTKGMLAPGMELPGVLGAKAPLQNSADLRAKGWEISLDWNDRIGNVQYYLGFNLYDSRTKITKYDNEVGLLGKDSDGNLIYRKGMELGEIWGYTTDRLYTTEDFDSQGKLKNNIPKMEGYNPNPGDILYVDFDGNGIINNGKNTSNEPGDTHIIGNDTRRYQYGIRGGAAWKGISLSFILQGVGKRDLWLMNELFYPHYDAYSTLFDSQLNYWTPEHTNSYFPRLYEKAEGNTKANQKTQTRFLQNGAYLSIRNISLSYTFPIKLIKPLGITNLSVFFSGENLFTFDHLPKGIDAERVVTDNLGQRGFTYPYMRQFSFGINLSL

SEQ ID NO: 16032 - protein, 775 aa, Saccharophagus degradans
MISRLLTVSIVTALLGACVTPPSPMIKRNTLLHKHPATTDIPTTQLPDAVGTATVPLPDTTETPTALLSDAGGPLPVIRRGNGKVINQTVAATPPPSMGVAGKGSATFNFEGESLQAVVKAILGDMLGQNYFIASGVQGTVTLSTPKPVSSAQALSLLEMVLGWNNARMIYNNGRYSIVQADQALAGTVAPSTAPPAVARGFEVRVVPLKYISASEMKKVLDPYARPNAIVSIDTTRNLITLAGTRVELENYLRTVQIFDVDWLSGMSVGVFPIQSGKADKVAADLEKVFGESGKTPSAGMFRFMPLESANAVLVITPQASYLDQIQKWLDSVDSVGGALSLFSYALKYIKANDLANRLTEVFGVGARREDSNVSLAPGAQLGVLGSGGSGDSLPSAGGGGSLSAVPSNGGTDNTSSANGGLGGSTLQLSPRTQGNGSVTLHVQGDTVGVSAVEEINTLLVRATPQAWRSIRDVIEKLDVMPMQVHIEAQVAEVSLTNQLSYGVNWFFQNSVNAAADAADNGASNGTGIGLGAGLPSAAGRSGWKSIAGKVTSNGLAWTFLGKNAAAIINALDQVTQVRLLQTPSVFVRNNAEATLNVGARIPINSTSINTGLGSNSTYSSVQYIDTGVILKVRPRVTKDGMVFLDIVQEVSTPGSLPAACSSASSTLVNSAACNVQINTRRIKTEAAVQSGDTIMLAGLIDSNSGKGSNGVPFLSKVPIVGGLFGTKAQNNNRREIIVLLTPEIVRNPQEARNLTDEYSQKFNAMEPLPGLNTK

SEQ ID NO: 16033 - protein, 239 aa, Saccharophagus degradans
MSTISAHAETDQQTSEYGTLPTIKVKAGSGQENEKSYIAGKTDTAVPLGLSVREVPQSVSVITHQRLQDQQLSTLVEVAENVTGVSVNRYETNRGGIYSRGFVVDNYIIDGIPTTYSLPWSSGEIFSSMALYDHIDVVRGATGLTFGAGNPSAAINMVRKRATSTEPTANVEVSAGSWDNYRVMGDIANSLNQSGTVRGRAVAQYEQGDSYTDLLSKEKLSLLLSAEADLSEIPFYRVG

SEQ ID NO: 16034 - protein, 780 aa, Saccharophagus degradans
MVLTNLSLFGQTTFTLNGTIRDAASNETLNGVNVIINELQTETVTNTYGFYSISIPEGNYTITLSYLGYNTINKYISITNKTTLNFSLTESSETLDTVVIKEDVERTNIRSPQMSVNSLSIKTIKQIPVVLGEPDIIKSILLLPGVTNAGEGASGFNVRGGAADQNLILLDEATIYNSSHLFGLFSIFNPDAIKDIKLYKGGIPSKYGGRVSSVLDIYQKDGNSKKFSAEGGLGILSSRLLVEGPIQKEKSSFLLAGRSSYAHLFLKLTDNENLAYFYDLNTKLSYKLDDKNTLLLSGYFGRDVFNLNDSFKNVYGNSILNLRWNHVFSDNVFTNLSVIYSDYYYGLELDLAEFKYNSGIRNGNIKYGFNHYINNDLKLNYGIQNTLYEFNPGKIEPSTTDSGINAFTLTKKYALESGIYLSAEHNLTEKLTAEYGLRYSAFFRLGQDRLFTYENNLPVIYNQEQGVYESADPVGEENFNRDDIIKSFGNLEPRVSLSYLLNDQSSIKLSYNRIAQYIHILSNTSSPTPLDVYTPSGKFVKPQIVDQVAAGYFKNFNENEYSLEFEAFYKYINNRIDYIDGTDLIANDAIEQVILNGKARAYGLEVLFRKNLGKFQGWLSYTLSKSEQKTPGRSEIEPGISNGNWYLTNYDKTHDISITTSYKLNDKWTFSGNFLLQTGQPTTFPTSQYQYEGQTIPVYGERNTDRLPLFNRLDIAAEFTPNPNSDKRWQSYWSFGIYNLYNRKNAASISFRENRTTGVNEAVRFSIFGIVPSISYNFKF

SEQ ID NO: 16035 - protein, 726 aa, Saccharophagus degradans
MTFSKSATCLAITASLFNVTASAEQQANNDTSNTGNTGNTGNLETITVTSDFRQQNLQNTPASLSVLTDIEINQRNARHLEELVAVSPNVNFASGSQRARYYQIRGIGERSQFQEPINPSVGMIIDDIDFTGIGSIANLFDVKQAEIFRGPQGTRFGANAIAGMINITTNEPTEDFEGAVQLGVGNYNSYDMGVALSGPASDTVNYRLAVNQHNSDGFTENIHLQRDDTNNRDELSVRGKLAIEASNDLTIDLAGFYFDFDNGYDVFSLDNTRETYSDQPGFDQQETAAFSAKFTYTGFESATLLAIVSHSDTDLGYGYDEDWAFGEYEWRSDDPVYTPDPCITPSGCLADFDGYSSTDHYYRDKTVLTTELRAVSNQGQEIFNGSTAWVAGVYFKQDDEDLLRQYTYASGDFTSINESTSVALYGQLDTQIAEKWSLMSGLRIENRSADYNNSDLFDDRIDDTMVGGKLVLSYQQNEDSMWYGSINRGYKAGGHNTDGTLPEDLRTFDPEYLLNYEIGYKVSLLENSAYVRTSVFYMDREDMQVKSSKTIIREDGSSEFISYLGNAATGSNYGVEIEGAWYINDLINVYGSLGLLDTEFNDFVNADGVSLSGREQAHAPNYQFNVGINVQPTDHWLINLSVDGKDSFYFSDSHDEQSESVALLNASVAYIQDNWQIKIWGRNLANEDYANRGFYFGNDPRDGYTAKQYTQLSEPLVFGATLDYQF

SEQ ID NO: 16036 - protein, 966 aa, Saccharophagus degradans
MCVLTLVALVATPAQAQSTAVNGSIEGTIRDASGGLLPGVTVTIHNTDTGTRRVVVTETNGLYRATLLPLGAYEVTAELAGFKKLQQTGIAITAGSSAVINMAMEVGGVSEVVSVQADAAVVDLGKIDVGRNLNEREIHNLPLVSRNPYNSRCAARRQRLRELGVRRAAVQRQRVAAAHQLPDGRQHQHPRRTAPACACMSEVAIGEVKVTTSGYAPEFGQTMGLVYNAITPSGTNKMRADASFRFRRTPFSAYPFYSTITPRNAENKPADVVNTWTASAGGPIVRDKLHYYAGFERTYRDMTGVFNLTPELVAQVGQPPQPNTVPAYQTVRFFLGKIDYQLAPSHRLTTRVNWFENNNPFNGGAGNITTIERGFDYTDGMTSTAAQLVSNWGSNRLNELRAQYAERHFNRQSHAGGPTGISVTITNAISFGHPTSDGEDFVQGITQILDNFTLIKGRHSFKQGFDFQYVHDTRAVPLTSVYTFPTVAAYLAAKSGAAPRGYTTFAQVIGDPNFAMGSKLFSAFWQDDWRVAENVKVLYGFRYDAYFYPEADPSAPFSYSQQFKDDTNNFGPRLGVAWTVGARKDQVIRASTGIMYDQPLLAVYENAIQQNGLPARTTYSVNGSGLGAPDFPNTLTDLPAGAVFPAQTIFAPDPNLKLAYNVQNSAQFERGFGRSYHGSVGVVYNRGYNLPVINDINLINPIGTLADGRGIYNTTVNAQTRMDPRFNHINVVQSPGESTYQALLLTFGRRSANGVQYDLNYTLGKGIDTAPLQGAILSVQGDQPRSDPQNLGRDKGPNALDTRHVFNGSIVAMSHFNRGPAVLRAILSDNQVGVILQFNSGLPFTLTGNRDLNGDGNNADRPLNIGRNSYYLPSRYNLDARLSRFIPLGGSRRVEILGEFKNIFNIVQTSAIRNGVNVDAAGNILVPLVFGTTASSLTELPSSSSDFLPTGGYEQRKFQLGFKFAF

SEQ ID NO: 16037 - protein, 3477 aa, Saccharophagus degradans
MSHPKKPSLAKAGFKKALRATLPAIALFAGGAGGAGGAFASIRNASQSPVSSRRAISSVGPLSTAVHPLPSTLGNTITPLPQKPARSAFAVFGAGGSVGKQSANKNVASTAVKFLLEQQLLNQKVDGNATVKIASTSGDNDASRRRFAHTLGTATPFSALVCGEPGYDTFVFSGANSANTFCSVSGPGGLTNGTNLAQCQALHDACNAPGHGAANNAPTVSNAPTDVTVTEDTASNLDLSSLVFADSDGDSLTVTLAVSAGTMAASTAGGVTVGGSGTGTLTLAGTAANINTYLDTTSNIQYTSAANANGDNAATLTITPNDGTENGTAANINIDITAVNDDPSATGVPTDITVTEESASNFELSAISFSDVDSSGNVTATITASSGTFAASSGGSVTIGGSGTGTLTLTGTIANINTYLDTASNIQYTGASNVSGNDAATAGLTVNDGDGSGNVSVGTINIDITDVNDEPTLTATASNPTFTEGGAAASLFSGSSASTIESGQTLTGFTLTVTNVTDGSNERLNADGTTIVLTHGTSGTTASNSLSYSVMVIGTTATVSFSGGTVSTAATQTLIDALSYQNNSNSPSTSNRVVTLTSLTDSGSNAGANDNTASLAIASTVTVTETNDEPTLTATGSNPTFTEGGAAASLFSGASASTVESGQTLTGFALTVTNVSDGSSEILNADGTAITLTNANSGTTATNSLSYSVSVSGSTATVTFSGGTLSTAATQTLIDALSYQNNTADPNTSNRVITLTSLTDSGSNTGANDNVAALAVASTVTVTAVNDEPTLTATGSNPTFTEGGAAASLFSGAAASTIEAGQTLTGFTLTVTNVSDGSNERLNADGTTIVLTHGTSGTTASNSLSYSVVVIGTTATVSFSGGTVSTAATQTLVDALSYQNNSNDPDTTNRVVTLTSLTDSGLNTGANDNTASLALASTVTVTALNDEPTLTATGSNPTFTEGGAAASLFSGSAASTVESGQTLTGFTLTVTNLADGSSEILNADGTAIALTDTNSGTTATNSLSYSVSVSGTTATVTFSGGTVSSAATQTLIDALSYQNNSATPDVANRVITLTSVTDSGSNTGANDNVAALALASTVAVESIDDDGDLTAGSGVSEPVNLGYSADTVGEAVNVFDFTLSDGGASDSFDLNISEVVIHVAGTSSDTERAAIVWRLNGDDAANVTGTYSAVADTITFTGLSLVVSNGDSETYTVNAYYSDNTIVTHGNTIELSLDGDTDLTVDSGTQMGATSAVDNDTGLIIIDDIAPVTTSVNVPANATYAASSNLDFTVNFNDTVFVTTGSGTPRLELTVGATTRYANYLSGSGSSALLFRHVTQIGDEDTDGINVNGSLQLNAGTVTDSAGNTVDVTLNSVGSLAAVLVDGIAPTLAEVTAVTTPANDSTPSVTFSTTEAGTLAISGSCGSASEGAVASGNNTISLTQTDNSTALAAGTYSDCTATVTDAAGNTSSALTLTSFTIDLTAPTVAEVTAVTTPVNDSTPDVTISTTEAGTLAVGGSCGSASEGAITSGNTTITLTQADNSTAFTAGTYSDCTITVTDASGNANTPVTLTSFTVDLTAPTVAEVTAVTTPGNDTTPNVTISTDEAGTLAVGGSCGSASEGAITSGNSTIALTQADNSSPLTAGTYADCTITVTDASGNVNTALTLTSFEIDLTAPTLVEVAAVTTPTNDSTPSVTFSTTEAGTLAIGGSCGSASEGAVTSGNNTISLTQTDNSTVLADATYSNCTATVTDAAGNTSSALALTSFVVDTTAATVAEVTAVVTPANDTTPDVTISTTEAGTLVMGGSCGSASAGSMSSGNTTLTLTQADNTSPLAAGTYSDCTVAVTDSSGNTSNTITLTAFTIDVAAPTLAEVTAVATPGNNAMPTVTFSSTEAGTLSVGGSCGSGDEGAITSGNNTITLTQPDNSSALMSNSYSDCTLTVVDASSNTSNVLTISTFVVDVSAPTLDTNSSLSVSEGEADAVISATNLAATDNLSTAANVTYTVAAAPANGTLRLSGSALANSGTFTQDDIANNRLTYDHDGGETTSDSFTFSLADGLSNVNNNSSANFSFAISVAAQNDAPQTTDDAETTDEDNAVMVDVLANDADSDDAINAASVTIVSAPSNGSTSINTATGVITYTPAANFNGGDSFTYTVQDATGATSAAATVSITINSVNDAPVAASDVISTDINTAVSINVIANDTDVDTADAPDANTLVVVNNASNGSAVVSAGQIVYTPTNGFVGNDSFTYTVDDSNGATSNTATVTVTVIDPNVVPVASNDTATTDEDTAVEVNVLANDSDGDGSLVASSVAVATAPSNGSTSVNVATGAITYTPSVNFNGSDSFTYTVEDNLGAASAAATVTITVASVNDAPVAVDDTVSLLEDASLMINVLGNDSDVDGSLAASSVAVISGPASGFVAVDPANGSVTYTPLDDYAGNDSFTYQVNDNDGAASNIATVTLTIDPVNDAPLANNDSADVVIGVDKIINVLVNDDDIDGTLEPASIVVTQQPVQGTLVNNNDGTLTYSANQTVDVTSGDSFSYTIEDNSGAVSNAANVQIQFVPAAAPAVSGTPDADVEEDGSYSFTPDVTVGDSNFNLTYSVTNAPSWLSVNPVTGALTGEPGANDVGVFNNIKLNVTDGVNTVALPAFNLTVVARVDSDSDTITDYQEGKDGTDPMDGSDYLDVTPPQITAPSNIILDAVALFTNVTTSQLLGLAADADTAEIDAAMAALVSDNVDGQGCCDLYPKGAIVDSYKLAPGENNIVWQATDNKNNVAEVTQKVYIRPLVSLSKDTTNVEGGVAKIGIVLNGKAPFYPLQIPYIIDVSSTATSADHDLVAGIATFNSGATSVQLMVNITADGIAENDEQLIVRLDDRTTNAQDLTNGFEADIYDINAGARTVHTLTIVERNIAPQVALVAKQNGVATLLVSPNGGPVTVSSTVVDANVGDTHTYSWATRRGNLVDTDGDTSNGLFVFSPSGLANGAYKLSLTVTDSGGAVDTETINVVVVPAPPVLSAAVDTDNDGIDDETEGTADTDGDGISDYLDNIDAPNVLPETVNETDSFLIECDPGVRCRLGQFALAGRSGGARLDKQDIAQQEDLIEDTDFALQSDLFDFEVADLPSEGQSVSVVIPQQMAIPANGVYRKFNNGVWSTFVEDANNSLHSAAGELGYCPPPGDASWQAGLIQGSYCVQLTIEDGGPNDADGIVNGSVEDPGGIAVQNSQSVSTRGSGGGSLAPVLVVLLGGLAWANRKKRTASTRNKSKNNTHKKIAASVATAVALSLPSEKTQALDWQNIVQNSFGEVSISRASGSHNKSDFVTGMAADGLVVTPTKYDTASTAFHFMLGYNYNEHLAATVGYLDLGKIAVDFDVPSGNSSALPTALKNNYPHTGSGLTLGARYTAQVMQPLMGYAELGAFVWQGEVVSVEGIADTELEGSIDPYFALGASLPLNKDAQIGIKYQYHTLDGQGVSLTGVMVKINF

SEQ ID NO: 16038 - protein, 423 aa, Saccharophagus degradans
MKTLNAFVPHSARRLDMPSFASLNTFCLSSLSLKRTLLSFSLLASAHAGASGIFLQEAVIANAGTVGAGDGVYTQSAAAMWANPATMPWMGETLTTVNATAFDLQMDYHDQSGVGHGQAASLMPSVGLFHVRQLNEDVHFGIALGTVGGSSLDYGSEWQGAALMTDIALAAVQINPALGFRVTDQLSWGIGAQISWASLEMGMANARRLEQSSDWAYGFNAGVMYQFDEQWDLGVSFRSKVNHEFSTELSGGQRALPVGTELVVPAIVDVSSSYAVNPKLKLLASIQLHRWSEWDTTVFDFGRLDSNPLGLNSIDRQWEDVWKFAVATDYQLNADWRLKAGFSYETSPQDDPSKQWVDLPVGQQYRYSVGATTQWDSYVLDVYYEYADLGEVDIATRKIANQDVGINGTFEGRIHFVGLSVSF

SEQ ID NO: 16039 - protein, 767 aa, Saccharophagus degradans
MYKRNFLLCTIAGSLIFSHLSSAYANTPPREIPKVYVKEGEEAFNNVIIRDRYYPVIAGGSQSVATITEAIITSEIVGLSATRGGRINATEIDTKTLIKGLEITNGIINLEDSIVHVKGNHESYGIVFGKVFDFHVNEGEEVVNKAFLTNTKLLVRDGIGILGPYSNAEIRLKNSEILSDILLKNSDETEIDPVTLTLTADHSILEGRAKTLQKNTTVFTLSNNSKWYLKISQNEADNSNSLFNYVLLDINKRAHSSVSVLNLNDSAIVFNAPTVLTEGHYQTLSVGREQTAEYSDPQSNRDLNEKTVYTATGDARIYFNTAWSNGLPKDQQKTDRLLVHGDVSGSTTIHFSNLSKSEPSNIENTIPLNMRGLSLVQVSGKANENAFKLANGYATIGGLPYKYTLNAYGPTSSHGKASLEQSLVGEEQNFWDFRLQSATLDREAKIKALVPQVASYLVMPNALFSAGFTDVNNQNALLNDMQTALFAPESHKKSGIFLSSYGNKITLSSNRNPLQYGYGADVQHTALQAGIALAGLEKQNITTSLGLLGTYGKLAFTPKDIEGAEKSTIDKWSFTVYGNIQHNNGIYLDTLFSYGTLKGNITTAFIGNTTQLNKTKTLSASATVSQKLGTGVEGLVFEPQAQFVYQRLMFEKLSDIDGFEVNMGKPHQWLLRFGGCLIQTVMPVERNHAVSFYGKVNFIKAFSDNGTIKIGDTFHRDSMGSSLEGGFGVNAQLSQNIALHAGVNYQHKLQKAGISAINFSGGIHYGF

SEQ ID NO: 16040 - protein, 248 aa, Saccharophagus degradans
MTKLKLLALGVLIATSAGVAHAEGKFSLGAGVGVVEHPYKDYDTDVYPVPVINYEGDNFWFRGLGGGYYLWNDATDKLSITAYWSPLYFKAKDSGDHQMRHLDDRKSTMMAGLSYAHFTQYGYLRTTLAGDTLDNSNGIVWDMAWLYRYTNGGLTVTPGIGVQWNSENQNEYYYGVSRKESARSGLRGYNSNDSWSPYLELSASYNFLGDWSVYGTARYTRLSDEVTDSPIVDKSWTGLISTGITYKF

SEQ ID NO: 16041 - protein, 1071 aa, Saccharophagus degradans
MKYLYFGLMLLLCAVANSQTTISGTVTTASDGTTVPFVNVIAVNTDAATITDENGMFSLDVPATANELRFSAIGFITQTASINGRTTINIILQESTTDLDEVVITALGLERETKELGYVVQTIEAEEVSAVKAPNFLDNLAGKLAGVTVSQGATGVGSSSKITIRGEASFSNNNPLFIVDGTPINNNTVFNESNEAAAGFQEIDFGNGAMEVNPDDIASVSVLKGPSAAALYGTRASNGVIIIETKNGSQSKGLGISINTSVFVDTPFKLPEFQNQYGQGNSGQFEFVDGLGGGVNDLISYSWGPRLDQGSLIAQFDSPVTLPDGTIVRGGDTSLYNGIAITPTAFSSHPDNLKDFYETGVTTINNVAIGSGFDKGNYRISFTDLRSESIIPGVNLDRQTVATKLNFKPTDKTTFNASISYVNSGSDNRPSNGYGSENVNYALVAWGPRSLDINSLRQYWQPGLEGVQHYSFNYTYFDNPFFTMYENRNSFNRDRVFGNISIKQQITENLSLSLRSGMDYSSETRQLRRAFSANRFKNGGYAEHDVFYREINTDFLLNYNNIFGDFSLDVSLGGNRLDQKASTKQSQTVNLAQPGIFNLNNAASPIDVFQFESNKRINSFYGIAKLGYRDFLFLDLTGRNDWSSALATPFSVDGTSFFYPSASASFILSEVTELPKAFSYAQLRASVAQVGNDTQPYQTSGAFISQTAYNGQPAFSNQNFIPNANLRPEQTTSYEVGADIRFLKDRIRLDATYYNALTKDQIISLPIAISSGYNQQVVNGGEVRTQGVELIADLTPILTANFKWNTTFNFSSNTSRVESLPQSDGRLTLAYSRIYDSANQTVWFQVEEGGKIGDIYGTGYQKTEDGQFILTPSGSYIADNNLKKIGNYTPDFMLGWNNCFSYKNWSLSFLFDWRQGGELVSRTRALGTVGGQLAETANRPEAGIVPQGVVNTGTAENPQYVQNTTAVSAETYYRQFYDRNHEENNVYDASYLKLRQFSVGYTFNLKDGFLGLSNGMDIDLALVGRNLFAFSEIPHFDPEQLAVQGSGFISGVEDMSYATTRSIGLKAGFNF

SEQ ID NO: 16042 - protein, 729 aa, Saccharophagus degradans
MRFNLLPLAAAVTLALNPLALMAEEQTSSKTETQDQNIEKITVMGKYTVSRNIDTATGLGLTLRETPQSVSIMTADRIEDQALNTVVDVVNNTVGLSSSKTDNVRNGFSARGFTVQNYQIDGVPLSWSLGGDAGETVSDVSIYERVEVVRGATGLLTGAGDPSASINLVRKHADSSDLKGYVDVATGSWDKKQVTADVSNGLNEDGSVRGRLVAKYVNSDSYQNLYQDRKTILYGVVDSDITANTLLRVGASYNHNDPKGAMWGALPAVFSDGSATDWDTSATTAADWSRWETKNINYFANLNHYFSNGWQLVANYNRMEYETTTKMIYMSGLLDKDTGAGLSGQRYHSHGESNSNNFDVQLKGDYDLFGQTHEFVTGALYSKQKSYADTYEPIRDDMTGWDSQVVDNFYEWQQNQFAEPEWSTNANRQLNMDTEQKGFYAATRLTITDDFKLIAGGRISSWNREGVSYGTDTNFGDDGVFVPYVGALYDINEEHRIYASYTGIFNPQNKQDASGDYLDPLEGKAYEIGLKSAYLDDRLHTSLALFKIEQDNFGKQDPDFVPTEEQIANGQTTAYYAIQGTESKGFELEVVGEFIDGWNISAGYSQFKAEDAEGNKLDTTSPRKQFKLFTTYQFVDLLPELTIGGGVNWQSDSYSTGGNVTITQDAYSLVNLMARYDLAENMDLQVNVENLLDEKYYAYMSTSSYLPEAYSVYHYGAPRNFTVSFNYRF

SEQ ID NO: 16043 - protein, 649 aa, Saccharophagus degradans
MTNKTYLAVLIAATFSANSIATENDGEKVTVWGTQISNSSESLLASDIEMKQGDHLSDLLRDQPGVDVGGTHSLNQGVNIRGVSELDLDITLDGASQNNNVFHHAGNLLINADIIKAVDIRVGNNSVLNSGLGGGVAFETKDARDLLRGDDKFGTRIFSGMASNDYSHTSAAAFSELSENVDALVYYSVISRDNPKDGDGNEVLGRDGKTQNVLAKVGWDANDQNRFELSYDYLKDAGDYTIKSNMGMNGSNWHEKYIRPIEYTRDTVALNHELALANTDVHSTLYYNEMSYTSKRKGAPINEGRTEVYGLKVLSETNLEVASMLHTVRYGLEGKTEESKELLGGKPLPNSKETAKSFALYVEDEIQLTQDWSVTPGARYNRYKVDMLASDKTFKDTIFGLSSKYILSKNWSIQASGTELFKGPALSGSFLTSSSSYNPDLKPETGVNYEASIAYQNMDLAGLDTLGFSLTVFNTQINDYIDDTMTGKASPTKPYRNLGDVDIVGFESAMILQRDQFNGRLTYAHSDSEFKNVALNSGLEKGQSLEDEVGDSISLNLGYTFPSVGVDVNWTSLVALDLKGKVNSDSDKKGYNVHGINMRWIPTTNEDVTVTASVDNIFDAQYASHASHDFGYIDYEPGRNVQLSLAYQF

SEQ ID NO: 16044 - protein, 768 aa, Saccharophagus degradans
MNKFITLILCLCCVFTSAWAEGDDHTSLNPSDANIVGHILDKKTGEHLSFINVYLHGTTIGTTTDATGHYYMKNLPEGKYTLVMKSIGYKTEEKTVTLKKGKTLEINFNAEEDAVSLDGVVVSANRNETTRRLAPSLVNVLDSKVFETTHATSLADGLNFQPGVRVENNCQNCGFQQVRINGLEGPYTQILVDSRPIFSALTGVYGLEQIPANMIERVEVMRGGGSALFGSSAIAGTINIITKEPMRNSAQIAHSLTMIGGSRPDNNTTVNASLVTDDHKAGIYLFGQGRHRASYDHDGDGYSELGKLEAKTLGFRSYLKTSNYSKLTFEYHNISEFRRGGNLLDLPPHETDITEQTDHQINGGGLKFDLFSRDYHHRLNVYTSAQHTKRQSYYGAGKDPNAYGNTTDMTFIGGAQYSYEWDKCLFMPATFTGGAEYSYDDLQDEMLGYHRTIAQTVHIGSAFAQNEWKNDRWSFLIGGRLDKHNMMDHVIFSPRANVRFNPTKDINLRMSYSSGFRAPQAFDEDLHITAVGGDVAIIQISPDLKEENSQSVSASVDFYHRFGPVQVNFLVEGFYTDLRNVFILEEIGRDEDNNLLMERRNGKGARVMGINLEGKMAYSWMQIQAGATLQRSRYKEAEQWSENPNITPQKKMFRSPDVYGYFTSTFTPVKRFSASLTGTYTGSMLVQHLAGYIPEDREEKTRDFFDLNLKLSYDFPIFKSATLQVNAGIQNIFDSYQDDFDKGAHRDAGYIYGPGIPRSYFVGCKISY

SEQ ID NO: 16045 - protein, 709 aa, Saccharophagus degradans
MKIINSYLAASIAAALSSVPAFAFAAEDTQDTKDIEIIEVSGDFHRRTLNETTSSVSIIDKDAMQQRHSQHLQDTLNSLANVNFSGGTSTARFIQIRGIGERSQFVDPVTPSVGLIIDGIDYSGLGSAASLFDIDHVEVFRGPQSGRFGVNAMAGLLLLDSTAPSSDFNGQFQLSAGNYSEAMGGLAMGGNLGLLGNARFSVSQFQQDGYIENTYLERDDTEQRDELTARFKLDTELSKDWLLQTVLHYNDVDNGYDAFSLDNTRETLSDEPGFDRLESQALRLQLSYLGFDNSRLEMSVNYLDADTGYAYDEDWTYEGIAPGWEYSAFDAYFRDRDDKTAEVRWVSDEPESLFGIDSEWVLGLYYYDKSVQLTRDYFNWDLGQPSIFNSDYDSNHVAIYGELTQHWSDRVSTITGLRVERYDNDYLDSRGITAEPEDTMVGGNFSVRYQASDDSYLYATLARGYKAGGVNGEALGKAEDQGLEELENYLLDRSTFAPETLWSTEFGVKGSSADGRLTSRVSAFYHWRDDVQLKGWVNRDQSFVGYIENAAEGTGYGLEAEIRNQFTDWLAVFASASWLKTEIEGFVTEDGTDMTGREQAQAPNYQLNIGFEGWLGENFQWVIQADAKDEFYFSDSHNQKADSMAVLHLALNYHYQDWHFSLWGRNLTDEDYETRGFYFGNDPRKEYVPETYVQYGEPRRFGITVRKSF

SEQ ID NO: 16046 - protein, 144 aa, Saccharophagus degradans
MDYLVRDNLRVKAGLGLLHTEISRFTSAAADYQGHRFGRSPDYTLSLAADWDITPEWRLSGQLRHTDGYYSDDNEDRDTWVDSYTVANARLTWQPRENLQAFAYVNNLFDDRSVTYLRGQPLDRRLRGHLVEPREVGIGLKVTF

SEQ ID NO: 16047 - protein, 1054 aa, Saccharophagus degradans
MNKLNHLCLLLVLLLFPFISISAQEMNISGVVIDNDGLTMPGVSVSVKGTTTGTITDIDGKYNLNVQKGATLLFSFIGYTTKEVKVGNENILNITLNASTIGLDEVVVVGYGTQSRRTITSAITKVSGDALKNVPVNTIGEGLKGKIAGARLYSNNNTPGADATIRIRGGSSINKSNDPLILVDGVERAFSGINPNDIESIEVLKDAASTAIYGSRASNGVILITTKKGSANQAPRITFEANLALQQAETLYNFMNAEDYINTVRPAVALGPKSHYNFMDGYSASSGNTESSIYSTRYLKEGESIPTGYKSMPDPLDPTKTLIFQDNNFQDEIYKNALWQNYYVGIDGGSESVRYSASAGYTDDGGVALATGYSRLSMRNNLDVKINSKLSFAMGFDYSKTNSSEYPNQMNVISRGLATPPTQKKYNEDGTPTKGYNATSPNPLWYQYYNDQSKEEKRMSAFGRLTYHIIEGLKADVQMSTYNHHWRSDSFEKANEFSGLRTTTAQFGELNRNKLEAYGTYNKTIKDHSFSVMAGYSYQKDKNQSMEATVTGASSDKVPTLTAGPNKKDAKSDFTEDVTIGYFGRLSYDFQKKYLFSATFREDASSRFATGNQWGFFPGASVGWVMSDESFMQNIKPIDNLKWRISYGQTGNNAIGLYDAYGKYSTNAKYDGVAGIIPSTMPNLGLTWEVSTQLDAGFDLSMFNNRLNISADYFDKRTDNLLFSKELPNTSGFDNVQTNIGKVKFYGFDIEISSTNIETKDFIWTSKFTWSYVKNKVLKLPDNGRDKNRIGGITLADGTAFGGTAEGEPLYRYYGYVVDHIIETQEQADNAMYDSSAKGYRPSDGKNIAGRKEIGDYEWKNREGSQTKDGKDYIDSQDQFLLGYTVPHSTGGLNNNFTYKNFTLNIFVDWALGHSINNNSEMRYFMNTFANNYTLIDEVKQCWKQPGDNTKYARFTANDPDDGNANFSRTSNVFNYKGDYLCIREISLQYNVPTNKLTKLGIQNLAITLAGNNLHYFTAVKGVSPEVGASTTYNKDYYNYPPIRKYSVGVKVTF

SEQ ID NO: 16048 - protein, 860 aa, Saccharophagus degradans
MKSPTPALPTLNKITFYLLGAPLLVAIPILAYAEVDDVSQPTTSTLEHIVVHAQKTPQNLQDVPVAVTALSGKDLVETVSRDVFDLQNYVPAFGAFQNQSVTNSGFSIRGIGTSSQNFGFESSVGLYVDGVYRSRQNALINDVVDIESIEVLRGPQGTLFGKNTAAGAMTLTTTPPSHNDRDGFAEAIVGNDALVRLSAGSSFSLVEDILALRLSGFTSHSDGFITDKESGKTLNNRNRSAIKAQLLYTPSDSVSVKVIADYGELDERCCGALTYQNNIQANQVEGKFGTDALLLQPPFDATVYGREDFYRFNTSLSQTPISQMEDKGLSVQVDFDINKAWHLVSISAYRAFDSLDSVDTDFSNADLLNATNDAQQQSFSQELRLHYRSGVLEGLIGAYYYSQNLDLTFDTTTQADFSVFFNAVAGDLLPLANAIDELSALTSGLIAPSASPAPPNTAFIHNADQEQDSFAVFTQFDWRFSDMLTLTSGLRFTQEKKTIKGQFDEQGPGIDGLEQDPTKWPNINIALLGLQEIGAALAQGDFPSQSSLNAIAPFQQTGWGYFFFGSAAVMPRPDLNESIEDDQLTGTVKLAYHPQDNTLAYASFATGYKAGGTNTDRILPGLSPLFNAEKSRSTEVGIKHDFEDVGLRVNAAAHYTKIQDFQATTFTGTGFNLQNAGDIAVRGIELEATWLITSNTELHANASRTLANFDEFKQGTCWVAYTWHTGIDDPGRVNPGDPFCARDGDRVGFEPQNSLSLMLNHHFALGNYPLTASIDYQYTGDVFLDDANDPYKYSGAFSQFNARLRVKITQWDSEIIAWSRNLFDEQYVARSGFDVPVQTGKIMAYPGAPRSFGVTFRKTF

SEQ ID NO: 16049 - protein, 557 aa, Saccharophagus degradans
MTSFNDSRPINYTAYLKARWSHKIGSITSNLLAGADMKGEGNLGKGTYYEDMSVAPTWREYRYDELPFMHNLAAYAEEEITLPFRHSQLLLKGGLRSDMTFIPGTVYGTVSSLSPRFSAKYSFGEKEHGFFRGATLRAGWGKAVKLPSFEMLYPRETYVDRLAFAPGAMADGTTYYAYHTHPVLPVYNPELQWQYSLMREAGMDIRLKGVRISLSFFYNTLSQPYTSTRIYTPFDYKLTDQSALNDCLIPSADRVYSIDRTTGVVTVSDKNGILPSQTLAYKEIHDFQSAVMNVNGSSSSRMGLEWVLDFDRIKAINTSIRIDGKYYRYKGIDEVMVPSTSSLTDTDGQPYKYIGYYVGGNGNYNGFMTQRLNTNLTLVTHVPKIRMIFSLRFEGTLLNTRQNLSEYSGGTRSYVLDSQSDYLPSSTQTDIYNGASYVATYPLYYVSREDMETRIPFMEKFLWAAEHDKELYNELSKLVVKSTTGYMFRKQGYSPYFSANLNVSKEIGKYLTVSFFANNFFYSMQKIKNWQTGNEGSLFASSLVTPFNYGISFKLKL

SEQ ID NO: 16050 - protein, 823 aa, Saccharophagus degradans
MATAKMFQIKSVFKMTPLAAAMVPALLATAMQASAQDDAKLEEVLVTATRRAETDIQSTPIAVTQVSAEQIQRAVPRDLLDVATFAPNVVAGKQPGFNSANFAIRGVGQNGIILYYENQVAVIVDDFVIPHIQTANIEMLDIASVEILRGPQGTLFGKNTTGGAINVKTNRPELNQSSLELRGQVAEYGRYEGQGILNLAIGDNLAFRAAGVYMKSDGWYSNSAAYGPVADFGVGFPLAGTSGQGDGADVGGDDVFSGRFKLRWQPTDALDINLAYEMVRDDSDAPPSYNNTPPNTGYLWNTLGFTRDAGDPLDNAAITNRNDVLLNMEAGHQIDVDGYYLNVDWDLNSDYTVSAFAGYRETDSQLPSTYTGEVGPVSLFDANRQDIRETTQLELRVASDLDGAFNWVGGVFYQQDDTIFTVAQVLGFVDMTIPSALAFGDPFYFNNNPQVLSNGQDASAEAVYLDGTFDVTEKLTLGAGIRYTHEKKKWKGRNQVFTQALTGGFDPALTWQVLGEPIAAADFNKYPVGVVEDEESWSEPTWRLNLGYQATDDLYTYATYSRGFKSGGYNDQTGTSGNPIEPLQARPTDPEIADSFELGLRSEFLDNRLRLNLTGFYVTYDDSQQQLLARITADRDGDGIDESEFQETRYFNAAEIEVTGVEVEAAWLLTDNFTVMGSLGTLDAEFKSFEADTNFDGNIDIDLTGSPVARAPESTLNLDFLYNLPLAGGHLDLALNVNYEDEAVYAYTSVPGSDNGLTDERTLVNASATYTAQDGRWWVRLYGKNLTDKRYRVGDLPVANLWMMSFYGEPETIGIEGGMRLNW

SEQ ID NO: 16051 - protein, 407 aa, Saccharophagus degradans
MGANFNLKTLTVAIATLSIASVASAAGLDRSGQDITAFLQNGVYAEAVYTYIDGDVTGKDSSGKEIDDIAESYDFFRYGVKADINDTFSVGVLYDEPFGAAADYSGKNDFVDQNPLSPRNGEGTNVEVRTESITGIVGAKLGENKNFQVYGGPVAQRVKANVKLRGTAYSIANGYSTNISADQDYGWLAGVAYSKPEIALQAALTYRSEIEHNTQAAEIYPFAQRVGLSPNRIDNIEITTPESVNFDFQTGINPTMLATAKVRWVPWSDFAITPSLYNETSQKLAGQPGIPPEGLDLVSYDKDQWQVELGLAKRLTPVLAVTGTVGWDSGAGNPVTSLGPIEGYYSAGLGAKYNLTDNWAISAGGKYLWFGDAQGQIPSKTVVSNFEDNDGFALGVKLSYQAKQNFN

SEQ ID NO: 16052 - protein, 804 aa, Saccharophagus degradans
MVYQRNDNARVTYPRRRSLALAAYWITASGAAWAQGSTPNPTPAGGAQDVVVTVQDVVVTTGTRESARKMRDAAAPVEVIGGDALRRTGQGNLRDALVQLSPSIARQAMRGDAGNLTSALTLHGLSPDYVLVLVNGKRRHSTANVSLNRGPQQGSTGVDVDLIPVAAIDHVEILRDGASAQYGSDAIAGVINVILKSDYKGGELSNTTGQTYQGDGLAQNNAANIGLRLGDAGYLDLSAEYNRQNHTVRTGADPRTGQNDNLILGSPASTRESVAFNAGYLLEGGAKLYGFGTYAHRNGSSYQNYRLPSVLPTLYPNGFTPQETLNENDFSLTAGVKGDRLLGWAWDISSTYGRDNIGIGMVNSANTSLFAATGSTPTGFRLSTFTSTQWTNNLDLTRAFHLPLLPAPLNVSVGVEHRHESYTVGEGDPASTYGAGSQALPGLSPLSALSKSREVLGTYIDLATRPAPNWQVDLAGRFEHYNDVGSTANGKVSTRYDITPRIAVRGSVGTGFRAPSLAQQYFTNLNISPLSAYGQLAPNSQAARNLGATPLKPEKSTNFDIGLVLNPLPNLNVTIDAYQINIRDRIVQGGTYSGQSAIDALTQAGITLPAGLPSVTANYFTNGVNTRTRGVDILATYHSNFARWGSVDWDLGINFNTTSVTSVGRDTNGNTLLNAQQVGYITSSTPKNKIIVGGTWHRDKWALSLHETRYGPTSGEESYWSGPNAYSTTRFAHFTNAARYVTDVELRYAMTRKFEIAVGANNLFNVYPSKLPAENQFLGTQYDIVSSPIGINGGFYYLRARYLL

SEQ ID NO: 16053 - protein, 270 aa, Saccharophagus degradans
MKKFVVFKTLCLSVVLGNSLVAAEGSTEVQKQLEKPKEYKAVKGEKNAWYLGISYQVGQASQSVKNPPKSSEFNYPKFPVGKTDYLAVMQGLGLTVGYKQFFGEKRWFGARYYGFMDYGHAVFGANALTSDNGGVCELHQPCATKVGTMGNLSDMFTYGVGIDTLYNVINKEDASFGFFFGAQIAGNSWGNTTGAFLETKSPYKHTSYSLDPAIFQFLFNLGIRTHIGRHQEFDFGVKIPTINVYYFNHGNLSFTYRRQYSLYVGYRYNF

SEQ ID NO: 16054 - protein, 190 aa, Saccharophagus degradans
MNNLKIYSAILISSLILLVPTAFADTNNISNSWYAGLDLGKGSYKNAGDEHALSVEQDHWAFGTHVGYQFNRYLSTEVAYQYFDEGQASYPLGNIKGNFQQLAVKGIIGTYLNDFYPFLNAGVAAWSGKSRGLREGNATGFSPVYGAGIRYYINSRFSTKLEYQRTESMGNDDIGHTDHQLVSMGVSWAF

SEQ ID NO: 16055 - protein, 383 aa, Saccharophagus degradans
MSSNQASQHSRPKLRFVLGAVTVASAASWCAAAHAQSSVTLYGIADVGIEHINNTNTGGAQTREASGNLSGSRWGLKGVEDLGGGMKAIFQLENGFNINDGTTAQSTKGLGSNAATTSRIFGRQAWVGLAYRGQQLTFGRQNALFYEQAVAFDPMGASSRYSVLSVDYAAAARIDNSVKYTGVSGPLTAQAMYSTRYDTGYGAEVPGAQLTGRFFSGALTFSQGPLAASVSYEQRNSNTVATNTGTERRATAAASYAIGPVKGFAGYRYLRASNAFLPANPIRVANGAEASAANLYWAGAQYAVSPAFVVTATAYYQDVHSTSADPWLAVLCADYLLSKRTDIYATAGFARNKGGSALGVNGYGTVAPDHNQTGVVIGMRQKF

SEQ ID NO: 16056 - protein, 373 aa, Saccharophagus degradans
MPKTVKVRFTPMKTCHISRKTALIIAMGLSASQAYAAEADALSTQVEALNQRIAQLEQNTAPSQFKNSQVSLYGSIRPTLSYLDEGDEQTWDVRDALSRIGIKASTEFADGWQAIAQGEWNVDIANSGNFGKARQAYAAIASPYGQVGIGKQRPAQYTLVAEYVDIFNHGNSPYAYDHESPFFVDNFVTYQLVSNGLTFMAGVQVDGNQGDSNADMINLGLGYDTGALHLGLGYVTQDTLIDGKVGGDNQTLGGVAAYTFNNGLYVAVSYQDKQYNFDQSLTNADRSGSTLDTALAYPLNDEYKIKLGYFQFKDGIKGNGSADYDGFNTTLEWNPLSNVRVHLEYLDKSLENGNDDQAVTIGFRYDFNLTWQG

SEQ ID NO: 16057 - protein, 807 aa, Saccharophagus degradans
MSLRKHRLVIATHAVLSALCGSAFVLAAPAAFAQEAGPKELDKITVTAQSREQELQDVPIALQVVTDKLIDDVAAQDLGDLDSFVPGLVVDSLQPTQPGFELRGISTDDFGIGTDPAVGVYVDGVYAGRGGGVLLPFTDVERIEVLKGPQGTLFGRNTAAGAISIITRKPDTAATEVKAKLRIGNYGKQYVDGMLNLPVSEDSAFRFNALVNHADGWIQDAETGRDLNPENNWATRAAFKTRFGERTSALISWDHESLDQLGQATTGIVALPPAPGLPPLPVNERAYLDPRKIGTVSDAEGNEESRRFDGVTLIVDHGTDWGGFTSTTSWRDYDSVNRVEEDGTNRRYLYVDSTNTESNRSFYQEFKFNGSTDKLDWVAGASYFDERARQTSEVNAMTDSVDTIVHNLGMAPTASGYLFGEVDAALAGMGIPIRLLGHRWNETFRNTLDTKAYAVFGDVIWHVNDKLNLTVGLRYTRDEKKFSWLNNHRSAPELDAALDQLQAIGFFNAVGIPRDFFVFDVAFIDPPAMMNKGILRRTSNSWSDLSPRFVVDYHLSDDTMVFASLAKGYKAGGFNSLQIGSSFENEDVWNLETGIKTSFPQHRIQLNASLFYYVYDNRQAVRLDSSTDIPRFVIDTSDLEAYGLDFDMRWQATDNFGLDFNASFIDSTYKNYVTSDGIDASGDPTGLPYWSAAGGLYYRIPMEANGDINVSLRHSYRGKVRCSEESRAQNRCGVSPALDLGEAQNRTDLRIAWTSPQDRWGLAVYGNNLFDNQYINSLGTYGKNVLGTVGARVTEPRTYGVEFMAKY

SEQ ID NO: 16058 - protein, 141 aa, Saccharophagus degradans
MTITLTGKSRNVSSSTLRRSAVGGMTALALFDLLKPNYALATQVEFTDPEIVAEYITYPSPNGHGEVRGYLVKPAKMSGKTPAVVVVHENRGLNPYIEDVARRVAKAGYIALAPDGLSSVGGYPGNDDKGRELQQQVDPTN

SEQ ID NO: 16059 - protein, 395 aa, Saccharophagus degradans
MNRFLSCRRLACWATGLLMVLPAVSASAAPTGIPAATHASLSSLPLSAAFLPAYQQWFDGLAWAAHIDTETVSNLVGGIAPGTVAILVGHAGFSYHTARAGLWTGGKFTLNVLGIESGNPEDRVGDVQGVSNLYARSQFRLYRLTFRQHLGPATLRLGLMSANDYFDVTGQAAQLINSSFGITPTLSGNIPGMATYPYSGLGVMTAVHGGAWEAKAGWYQGDPIHPFSDPFGQGDMALAELDYRNTKQERTYVLKLGAWHYQQRAIYNAVLGPRTSGLYAVAEYAEPLPRGRRLGLFLQAGSTPQSVNLIPYYLGAGFRVKGLLPGRGADVFSMGMTRAWLRNAPYPAETACEITYAAQVVPHIFLQPDLQWVVHPGGLYPNALVAGLSLHVQLF

SEQ ID NO: 16060 - protein, 787 aa, Saccharophagus degradans
MVLQPRGRPRAFARPNQLYAVLLLSGTSLIPDSIVLADTDNDPIPVQSAQAGEEPRLGAVTVNARRREESAQDVPTPISVLDAQTLENQRIYRVQDLQQLVPSVNVSYVHARQSSISIRGLGNNPASDGLEPAVGTYLDNVYLGRPGMAVFDLLDVEQIDVLRGPQGTLFGKNTTAGVVNISTRKPTFHPERSVEISGGEDGYFQTKGSVSGPLSDTLAGRLSAYRTRDDGYVKNIHDGDDLNGGARQGFRSQLLWRPSETFNLRWIGEYNEEDSDNGILTLYSTGPTIDGVNRYEQRAAAAGARLVKARERKVDLDSDQQVTVFQGGTSLEANWTLPNDFTLTSISAYRWWDFTPRNDDGLNVSAQINAGVEVRDKQYSQEFRLASPLGGAFDYVLGAYWFKQDLDNKSFNYYGPLADIWNGTVTGALANVTSIGDGHIETDSYALFAQGNWHLTPRLDLTIGIRGTYEEKDSWVRRDAPRGGDAVSGAAASQRNNRAGAYDSGDLSQYTFSPSGLLSLSYRFNDRWLGYASLSHGEKSGGVNLTVGSAPSAGADSLLVGTERVNNAELGFKSTLLDGTLLFNANVFWTQVHGYQANAYDHATRTSYLTNAGDVRSRGLEVETTWRPLRGLTINANGSYNDVRYTKYEDAPCPPEVGFRSGAPASCDLTGHRVVGASRWIANLNGHYQWTLNNGLQPYLNASYAFRYRAVGTIDDSEHGQIPSYAVVNLSSGLRGDFGDGQWDVSLWLKNAFDKTYYTSLWNSANGGYAGVLGTPRTLGLTARYDF

SEQ ID NO: 16061 - protein, 372 aa, Saccharophagus degradans
MKKTWLAATVIAATASSAFGGEIERRGDPSMILFEKGKNYLEFSAATVDPSVSGVARPGVPTAPTGNIQNRYQSFAGGYKHELNDRVALAFVIDEPVGASVNYRTPPAALGGAFFGGSSAEVSSVAFTALAKYKATDRFSIYGGLRYVGLSGNITVISPATLGSAVPAPNSPYTLGVNKDFQVGYLLGAAYEIPDIALRVALTYESKTEHDFKDNTGAGFKVEIPQAFTLHAQSGIAKDTLLFGSVKWREWSKFAVQPGDFFSVATGVPVNVPIASGPSDIWTYELGIGRRFNENWSGAVLLGYEKDEGDVVGNLSGKDGYFSYGLAATYETEAWEITAGIKYFDVGDANSNVTAFSGSDAIAIGTKVAFRF

SEQ ID NO: 16062 - protein, 885 aa, Saccharophagus degradans
MTNKKFDYKKAVLGIHLALMALPAISFSNYAHADKLSQTASLSIPAQPLDSALLQFAQQANMEIFIDSQEINGLNSQKIQGNMSIQKGLNQLIGANPILYQIDGNRISIQRINKAADDNSVIVLDKITVTAAPHQQGDWVYSTPSSVSVISKKQIEDKPPKHIADLLELTTGVYSSVSQQDPSLSVNIRGIQDYGRVNMNIDGMRQNFQKSGHGQRNGTMYIDSELLSGVEIQKGNSSGMGSGGTLGGVATFNTVSASDFLSKDKTFGGKIHASTGTNNTHFIGSTALALGNEQADLLFAASERRLGDYKPGVHGDIGDIRINNETGHYDQLVHDLKHSRITDSNYQMTSYLAKAGWNFGDSQRLQLNYLETKVATPNAGTLTNLSGTWPYKLGWKSSGFSDVTTKNYALDYSQYSESPWSVELKGKVYFVDTNDDTQTYSTSKVFNNGYQMNTRVKTLGLQLENHSEIEFNYNHVLKAHYGLEAFQDKASSDSTKVSANGVTPDGKRSLSSLFATLTYEHDDWLTLEGGLRYDYYQLKGQTSMRYRVFPYTKDNPCKASSLRNCKSVEVNRVWDVDDAQGEFSPNIKLAIRPNVEWLELYSSYGRSWRPPAITETLTSGSAHSSSTQFPNPYLKPERSNSWEVGANVNYPNLVLEEDRLLAKVAYFDTRVDNYINLAINRTKPGMVSPSIGNAAYSNNLVATRFRGFEYQVNYDAGFAYADLTFTHMIGKNEFCARRAWLGGVQTFTKENRPGNWYAEDDVQQNDHVNCDGAAVFSSAANLPGDRGSFTLGGRAFNRKLDGGMIIRFTPGFQDHSAQSNQPYLADWPKYTLVDLYASYALTDDLIIRGNVENLTNRAYVVSYGESLSNTLGRGRTISGGIEYRF

SEQ ID NO: 16063 - protein, 712 aa, Saccharophagus degradans
MPNDARPTPARPAAALTQLPELRTMLSRSPAVLSALVLGPCAIAQAQSPQEAQLPPIVITAERETDQVRKALTAEQAVTPGAVTLVDGEALRQRNVTSLADMLRYVPGLWAASGSTGDSSFLSSRGSNLDATNYDGNGIKLLQDGLPVTAADGNNHNRDVDPLSARYAIVARGANALTYGASTLGGAIDFITPTARDGAPNELLLNGGSHGQRQARITLGTVAGAFDALVTAEGKRSDGYRDHHRQERSGLYANAGWQLGDAVRTRFYATAIDNDQQLPGALTRDEWRANPRQAQAAALAGDYQYNVKTWRLANKTTWDIDANSSLTAGLSYEEQQLYHPIVYAPPFFSLLIDTEQRNLGGTLRYQRRIGEHDLLVGLNAGLTTVKGGNYGYEPGGAATLSTQVDNRADSLELFVMDRWQFAADWTAVYGAQAVSSRREIRNTTVSSGALRNPEDGYHSINPRVGLIHQLAPTVQLFANLSRLYEAPTLYELEDDVRGDQSTLEAMKGTVLEVGTRGTHDAGRSQWHWDVAVYYARLRDEILSRAPVPGVSLSTNVDGTVHAGVEALLGASLAIDDAGAHRVEPLLNLTVNHFRFKGDADYGNNRLPAAPTYAVRGELLYRHASGFFAGPTFDLVGRRYADFANTYTVDRYTLWGLRAGLTRDHWELYAEARNLADRNYVSLFSVQDRAESNAAILTPGEPRSVYVGARFKF

SEQ ID NO: 16064 - protein, 904 aa, Saccharophagus degradans
MSIGKQLAGWLLFTTALTFPAAALAQDTGAQDTGEEPDTPPADTQEGAQDDPRQDPVEDEAPEVSIPGGGNVITVTGRRGPRDITRSSTQVVSVLSSEDIARTGDGDIASAISRVTGLSDNGDGRVFVRGLGDRYSLALLNGLPLPSPNPLSRVVPLDIFPTDIIASSLVQKTYSANFPGEFGGGVINLTTQAVPDEGFVKINFGVSGDSITTFEDSIQYYGTRLDKFGFTTDRRDPPPELQRFLNGDTQLSDLTLAEQQRIAVQLNEPNLNVVQRIGKTRPNFSGGITMGGAVDIEDARLGAIATFNLSNSYRTRSIISQTPDDLDLNLRTDFRDFVTDNRILANGLVGFGLEVGKHRFRWTNVYIRDVLKQAVISEGENIQDGDTERQQKTGWFERQLIDSQLIAELEFGELEFDLRGGYAQTDRESPYEYEFQYVRTNNPGDPTGEIFVNPLNRIRGDLATIAFSDLTEKLWYGGVDVTYPVIPDILSVTVGGAYSDTSRTSSFREFLFDSDSDFPAGVGALRPDLLLGNAIIEFFDVGLFETSQVFPVFAADLETKAGYIKGNLTPLEGLTIDIGVRYEDATQSVAPVQVFANQQNLDAVTQIANDYFLPAGTITYDFGNGFQVRASASKTIARPQFRELIFQPYTDPESNRTFVGNPALQDSELINAELRAEYYFGSGSRAAIAGFWKKIDNPIEPFSAFTDNDQITQFANAPEATLFGGEVELQWNYDLIDFGGWFESKRAVVVANYTYTQSELKVDAADETFIFSPGVGSVPRPASGFFFDGRPLTGQSDHIGNLQLGMEDLDKLQQATFIMSYASERVTSRGAGGLPDIVEDPGFRLDFVVRQGITVAGVPLELKAEARNITGRDNFDFISSGANRIEVNTYEVGRSFSFSISAEF

SEQ ID NO: 16065 - protein, 376 aa, Saccharophagus degradans
MNTRITSLLLMIQGACLAAQAQAEGFPTLARIAPGFGYYGLDYGFDDTLKVYGTVDAFASYHDSQHHSGFRLAGGGAWTNKLGLYARKALDPDTVVELDVEEGFNLNGEALEGTWDTVGTLRLATVALRSRTLGKLEFGKTYGMATPTYADPFLATYGSPYTYLALPAAGKGAFYLDLRPKHTLAYTSPTFSGFSLGTALSFGFDDAASAGRTVRGGGARLQYRNSRVMLLASYNRYYSDPWDDGGASRQTANDFKSLSAFYDFGPLATSLTWQRQDVDQAGTPSTTLYTFGMMAPVGELDVLRLAVMQRQVSARDKDAWGVMIGYDHFINPRWALYGRLGMIANQRASSVTYAGTPVDQAGDNPSNVSLGMYYHF

SEQ ID NO: 16066 - protein, 808 aa, Saccharophagus degradans
MCVAVAGSCVSTFAWGQGAAVQVDLPAQRLDRALTALAQQSGVQIQFSDALAGQRTAPAVQGRMAVSDALGRLLAGSGLRARSTGAGAFTIEAQATSVPPKPAAGESAAPAVAELEATVVSTDRTRSDLVRPTRQVTQITHDELSDLQAGSGTLATALSKMVPGMADSSHTITDYGQTLRGRSTLVLLDGMPLNTNRDSARNLASLDPNNIERIEVLRGSSAIYGSGATGGIVSITTRPAGGEPRAETTFSMTSPLSHPGAAGLGGSVQQYVAGSKGPVDYEFNVGTQHVGGAYDASGHRIAPEPSQGDLFDSNIYSIGGKLGLRIDPDQRVVFSASHYDAKQNTDYASDPSVAKLPAGSAVARAIDGLQLADQNRIKNTLLNLQYENKDVFGSQVGAQFYYRDYFSRFAPFDARAVSTRGNNVDQVMQDTKVFGSRLTVTTPLDKDARTKLLWGADFNQERSDMPDDIFSPTAYDASGGLVYRKIGTVTYLPPLTTRSVGGFGQLQHKFNDRWSAEAGVRYEHASASFDSFVPLSQSRLAQKYTVPGGETGFGAWLFNAGVTYAPVRGQEVYASFSQGFQLPDVGLQLRNATAGFNINSSSLEPVKTNNYEIGWRGNLGSGARGTLALFYTTSELGDVQSFNNGLILTRTAERIAGVEAGVDYATDDEKWGAGGTLTYLQGRERPQGAANYQNMTGYRIPPLKLTGYLEYRPTARWSNRLQATFYAARDYRLNGRTSFGRIDATSYTTIDLISTYQITKKDKVRVGIENLLNRYYLPLYSQLMRNSNNTSRLPAAGTVLTVSYTHRW

SEQ ID NO: 16067 - protein, 805 aa, Saccharophagus degradans
MKNFIKKGSFFFSLSWTIFQYPYASFAAEQTDAASNNNGDAIIVTGTRETGKKARESISPIDIISAKQLTQTGMPSLRNALTQLLPSLSVPNGGYDSGALTDSISLRGLNANETLVLVDGKRRHTTANLYADSGPQQGTTPVDIDMIPMAAIDHIEVLRDGASAQYGSDAVAGVVNIILKKQDHGFHAQTVTGVTAAKDGFQQGVYLDGGTKLGSRGYLHVSGDFLRQNHSYRSAADLRTGKKDNKLLGQPEQTRESFAIKGGYEIADNIEAYGLATYAHRYSEAFENYRLASSLAGYPGYSAIYPNGYSPIETMNENDWEIMGGLKGTIKGWNWDVSSVYGRDYNTIGLKNSSNRQIEADTGRTPTTFKGVQRFNNQQWSNSIDFSKAFHIDGWPHEINVAGGGTHRYESYTIGVGSADSLYGGGSEALPGISAASAGKFSRNVFGGYFDVATHLVKQLQIDVAGRYEHYSDVGSAKTGKVALRYDPFKWLGFRGTISNAFHAPTLAQENYSAVAVSPTSADGIISPNSVGALANGSKKLKPEHSTNITAGVTFEPIKRLHITADLYQIKLRGQILPGGNVYGNQALNALAMNGFSLPMDAGSWTAASISTHWFANVANTRTRGIDITATYPTYLGDIGHIDWSVSANINRTILTHQGKDADGNDLLTKQSIAYITTAYPRSKIIWGGQFTSGDKKWIVGLHEIRWGHTTSQLSYYGGTANSDILSNYDFVAFHNRVKYTTNLDITYRVNAKLSLTAGANNLFNTYPSRVPLAHRYLGTEKYVMDTSQLGINGGFYYFKVDVNL

SEQ ID NO: 16068 - protein, 421 aa, Saccharophagus degradans
MRKLLSLTLLALAGSTAFAGGYRVSIQGQKQLAMGHTGVAVVNSAEVAFFNPAGMAYLDKKFNLSVGGNALFANTKFQNSQYGWEAETKNLGTPFSVYATYRLNDWFTAGLAVYTPYGSSVEWDQDWEGAHLVNNIDLKAIFVQPSISVRVGEHFSVGGGPIFASGSVNFNRNVAINPLLSVDGSGTDVTLDAKGITAWGYTAGFMFNPTDKFRIGMNYRSEIIMEARDGDANFNDVPGFASTTPTLQNTTFNADLPLPAELTVGMSYQVTDKWMLAFDYNRAMWGVYEALTVDFLNADGSIRNTSNNPRNYKNSSTYRVGTQYKANDKFTFRAGWYFDESPVQDGYFAPETPRNDSMGYTGGLTYQVNSKLGVDFSFLYLHFDEIDNSYDYYQENGNTLPFGGTYKSSVFSPGIGITYGF

SEQ ID NO: 16069 - protein, 641 aa, Rhodoferax ferrireducens
MNALLSEAVVTTASKRRQRIKDVPMTVAWIPAEELEGTGAFTLCEAIQYFPGLECRRGSMRKAAVSARGLGSNYLSNRLLLLKDGRPLTDPWTGQFYADETTPLSNLKQVEVIRGPGSSLYGSNAFSGVINLIERQPSDLIKEGNNIGFDGRVLAGQDSTFRVNATAAGRGGPVEALASYYGFGSDGPQLFNNAQTGLVDTNQDSQVHQISGKVKVGAFALDADFTDAEIGRPGGTQISTVGNCGRCHYTPSDTENVQNLNAAAQVDTQVTDNLRIFGQAFTLYKRRVVDQMNMITGKLEPALGKRRRYGAEARALLTTGNLNVTFGGDVKDDLVNNQNVLAGLTLDDTTQTIIGGFVDAEYRPMSRLVLGAGVRYDSYLIPEEVWSERTNQLSPRASIVFHALPELTLRTNYGRAFRAPTLAELAINQQMYAATLLGNSALRAETLDTYEAAVDYWAFDRRMRLTATGFYNRAKNFINQNLVFGSTSQFQNIGDAQVVGFEAEVAAQLPAANSSFDVAYQYLDAQALPYGDGPSSQLDYAPHHRLYARARTNIGKVGFAEVYALYVGQRFDPGFLVESTGEVNRVKLPDYVTASARVGVNINEGISVSLLGTNLFDSQYEESHGFPAPPRGVYSELKVRY

SEQ ID NO: 16070 - protein, 1055 aa, Rhodoferax ferrireducens
MNSTKGCVRARLLTSTLLAGLASLAAPLAITAVATAVPTLASAQDYSSGTLIGTVTDTNGAPVAGAAVQVKSLSQGFERNVVTGSDGQFRIALIPSGGYSVAISKAGFVPASDGNVKVGIGAASNYGFTIAAEGVEVSEIIVTGKANPQLDFAGTTTGLSIDVETLSKQVPIARSVTALTLLAPSAVPGDTVGTFVNQGQSQAAVGGASIGENVFFVNGLNITNFVNGIGATLVPFEFYKSVEIKTGGYPAEFGRGTGAVINAVTKSGSNDFTFALHGNYEPNSLRDKSPNTTITQNSLTSRTDRSLIVEAGGPIIKDRLFFYGLASFQNLETSTATTGGTYVQDRTADPFYAFKLDGYITDKHHLELTYFDTSRKRKRDQFTFNPATDVISPTRASAESLYQGGENYVARYTGTFTDWLTVSAAYGRSEVDNAAVGNLSGIARVQDTRVTPTVDRSLQRTAAGTFPSIAEREFYRADADLYFKLLGSHHIRFGYDQENTLLTQFTRRNGGRNYTYRRAGAAGALGGAVAAGQEYIEGRKFQTGGGFAGKNKAYYIQDAWDLNDRLTLSLGVRKDQFQVADPNGQVFSSFDNEIGLRGGFTYDVFGDRNDKLYGSFGRTYLPVASNTAFRAASPATDISEFWLPAGGGTTFGALDAQTGLPTAGLGRLVSGGSLVACPATVGSAAPVGAFSCQVRNNGVSPNPDAVAAKNLKSTYQDEYILGYEHRFNDLWRGGVSLIYRNLGRISEDALLDVGIQNWCAANGYAKTNAARTGCADVWSGEHQYLIINPGSDVKMVLSDPLPGETQIRTITVSAQQLQFPKAKREYLGLEFSFERTFDGKWGLQGSYTISESKGNFEGASRSDNGQTDAGITVDFDHLAFIPGTYGLLPNHRGHQLKLFGSYAVTDDLLLGTNLSVISPRKYGCIGNAPENFDPNDGFLEQDYETANASYGAAARFCGGKVANRGSVFEGEWVTRFDLSARYAVPSRFIPSLPYMDKSEGGLVLRADVFNVFNLKSGIEKDEFGEKTGGLVNPDFQKVTAYQPPRYVRFGFDWSF

SEQ ID NO: 16071 - protein, 358 aa, Rhodoferax ferrireducens
MKKTLIALAVATLPAAAFADVTIYGQIKAGVENVDAGGVNKTNVDDMGSRIGFKGSEDLGNGLKAIWQVESGFDIDGTNRQGYGTFASRESFVGLDTGYGKVRLGNISTFSDSNMSVVNPWESSSNALQLNAFTRDDVRVKNAVRFDTANYNGFQGAFLYGTKEDKTASFAGAPSDSSRELYNLGLSYENSGFFGKYQYIHQTPVTIAGVRSQSNDSHRLEAGYNANNLLVAFGYRNDRGDSSITPLSFLQNNAVPNGDGSKYKSQEYALTAAYTLGAFTPKITYAQAKDYDKDGVSVDNTGYKQFLVGVDYQMSKRTTVGLQYGEVKADKAIFNNGSDASSTGNKLRGVGLNMVHSF

SEQ ID NO: 16072 - protein, 624 aa, Rhodoferax ferrireducens
MKFKQLSLITATLLLSNTAFAEEATLAPIDVISTNKTEQSINDTTSDITVITSEEIEEKGYQTVAQAISSVAGIQVDNLGGLGQPTSFFVRGQDSGKVLVLLDGMRLNDPSTTNGTALLDSLTTNNIQQIEIVKGGVSSIWGSNASAGVINIITKEPKEGIHGMLGLSYGSYNTRGADADLSYKSDKLTAQMLAGYLKTDGFSALAPRDAEADGYENKNANLKFGYAFNQNNKVNFSYNRIRTKTDYDDMYSIEQANDDYSHATADQTNYAVDYRFKRNNYSATLTASKGEFERDYYTSGSFGYSHNTYRATLREYALINAYNYTNGKAVLGLEYKDIEGYNHYISSFPSLPTESTYTDKGVFLSNLYNINENTLLETNLRYDSYDEFDNKTTYKIGLKHHHDFLKGFTTSANYYTSYDAPSAYQLATPTPGSLLKPSYTKGFDISAAYKKLISVSYFNNRVEDNIDYVYDPLTYIGGYQNVEGTSKFEGLEVQGAYTLPTFNLHLSGNYTHLFKFEKEDGTDLPRRAKDTLNATLEYFTENNMHFGINAQYIGDRLDTDGSYPIASDVETGNYTLWNLNFNMELMKDLELYLNARNIFDKEYQSVYGYATEGRSLYAKVKYSF

SEQ ID NO: 16073 - protein, 681 aa, Rhodoferax ferrireducens
MKTSTLVAALAAAPFAPEALAQSADAALTLGKVDVHQHGEGQLSAHQVLTSVDVLGADQIEDRNVSHSWELLGQMPGIQLTETRQGAESGKVSFRAFNGEGYLNAIKTLIDGIPSNVNSGNQRYIDMLFPLEISYIEVVRGTNDPRYGLHNIGGNVNFGTRQGGNYTDARLAYGSYNTRDAQLAVGREANGVAQNYFVGTQASDGYRDHDTSRKYSLGGKWFLGTLDDGLRVGLTARAYHHEADEPGFMTVEEMRTHRRGSDLRNGNDGDDRDMRQIAAHLDMKLSERLTFGTRLYYNRYEDDRRVTFSDLPTGNLPRQRRVWDERQNGLLSTVTWQASPALTVEGGLNYEQQDNSYIRERYAYAEPTDFSRAPARVQNNDRHSFDNWGAYVQAIYQPVEAWKIVPAYRVDRFSGRTHLMNGLSARLQDYGSIGQPKLSVIHSLGENTHVYANWGRTFQVLTGSTAPAYLAPGQARMRPSTNTGMELGLKFQPFAGSQARLAVWQQDAENEVSNMPATGTTVTLGKTRRRGVDAQLSLQLGDDWTVWASHAYQEAKITRDDRDASMSLRGREVAATPRHISNLGVDYHASDALRLGLQARAQGDYYLEERNVAGKFGGFAVLDLSAAYQITPRWSVDLQLKNVTGRQYAYAWYDSFFWDSARPMFSPAPGRSVFVGLNMKL

SEQ ID NO: 16074 - protein, 700 aa, Rhodoferax ferrireducens
MLAPCRLSPLTLGLSLLFSAGLVNAATTTLPETSITADNEREEDNPRVKDVTTATRTSTPVRYVPQAIDSVKTSNVLDYGSSNLGKALEGIPNVSAGGDTRFDSLRIRGFDASNDFYLDGIRDDSQYTRDLHNIERVEVLKGPAAVLYGRGSQGGIVNRVSKAPEHGRRSTIEAQGGSQDLRSLYADLSADPSENISLRLNMGNEDSNSFRKGIDGNRQLFAPSMSWQLNPDLNWLVQYEYSRYNRTPDRGIPGVNGRPADVSRSTTYGDTQRDYIDDKAQSLRSRLNYQLSDNWQLRHTLGLFKLDSDFDNTYQTGYDPRTNLVSRQRWQQDLSTRNLFNNLEAEGDVSTWGLEHKVLVGLEFGNQRRDPLLYTAKAVSAGGTAVPSLDLNNPNRALQHNGPMVVSSNNHTVVDSRGVYLQDQIRLNDQWQILAGVRFDQFEVETTNKLRNISEKQKDNSFSPRLGVVYSPWREHSFYASWSKTYSPVGGGLIGITPGAAGNTNETDPEQSRQKEIGVKSDWFDERLSTTLAIYELELYNRRTRDPLDPNITLMTGLQRSRGIELTATGNVVGNWYVRGGIGLQDATIVKDNNGQEGNRINDVAKRNASLFVTWKPELGWYAETGLTLVGDRYADNQNTVVLPGYGRWDALAGYRTHDWDVRAALSNITDKTYYSSATSAAQIQVGDPRSLVVTGSYSF

SEQ ID NO: 16075 - protein, 367 aa, Rhodoferax ferrireducens
MKLARTAAALLAASPLLASAQSSSSSVTLYGVIDSGVEYVSNVGANGDGLVRMPNNTATVPSRWGIRGTEDLGGGLKGLFVLESGFSPDTGNANQGGRLFGRQALVGLSNPYGQLSFGRQYTMLFWAILDSDILGPNVYGSGSLDSYLPNTRADNAVAYKANFNGFVVGATYSFGRDAVNAGPSPAGTNCAGENPADKKACREWSAMVGYDNKTWGVIAAYDSQRGGPGAFGGLTSSNLTDDRLSLGGYMLLKNTKLGAGWIRRDNEGSPTPVSDLYYAGVSHDITPAVNLAGQVYFLNYHGSDNQALLYALRATYSFSKRTSVYATAGFINNGGQLAMSVSGGSPGSAPRPGENQWGSMLGIKHIF

SEQ ID NO: 16076 - protein, 867 aa, Rhodoferax ferrireducens
MRSSVFLCAVFGLALSPVALAVANELEKTTEQSAADAPVERVAVTGSRLKGVDMEGANPLQSFTQDDITKRGYESVSEFLRDLPQASSAGTFSETGSVGGADGAPAGASGVSLRGLGSSSTLVLVNGRRVAVDSFSNGSDSFVNINSIPLSAIERIDVLTDGASSIYGSDAIAGVINFILRKDFVGHELSAQYGDDTSAHDASRKNLTYAGGFATENSNTTVVVDYATRNAIFNSDRPVNVTFESSTRMTIDGEDYAESWCGDDTQKSGTRCNYDYVIQRAIQPDFENIGTTFNHIYRLDNGLEFFAEGMYQKNTGSAYEAPAGYTVDVAGDSANIPQYVHDIDMLDGSVSDVITVRTRFPERRVQEYDTQSYRVLAGLRGELADWSWETAASYGKSTNEINNVAGYMNATKLDAAVAADEFNPFNLGRDSSAAQIAALRDPGIRKGESEVLSLDFNISGDLFALPAGAVSSVFGGELRKEQIFDRPSINAVNNEIIGLGASDAEADRTQYAVYGEFNFPITDTLDVIAALRYDHYSDFGGDVNPKISMRYRPLEDLVLRASWSTGFRAPSLSQLGAGTSLSSQYINCGSAEPYNALCGTAGAEFGELEFDQETIGNKDLSAEKSAAINVGVSWNLTEALQLTVDYWRYEHDDIVDIDANTTLDACIKDSTKIVTSVAELGDEFGCVVDGQGDISFLRTGYFNVGNQNTDGVDYKLDYRLDTETAGEFKFYVAGTETLSFERQVTPSTPVEDLLGRLSGASEIARPESVLDLGTDWQLNDWSASLSGHYISSLGDGDFKFDNETVDSWLTFSASLGYELNEHHSFLVSVRNLTDEEPPYASSPTNGYASSVHDWLGRRWNVRYTFKF

SEQ ID NO: 16077 - protein, 416 aa, Rhodoferax ferrireducens
MSQDHTRKESFFEDGESMKKRVAFAMTAVGLAAATAAHAQSSVTLYGIVDNAIAYQNNAAPSTGATTGGHSKVSMGTGIWAGSRFGLKGSEDLGGGTKAIFQLEAGFNANNGASQWAGGIFTRQAWVGMTNPVYGTLTAGRQYTAYYTLLSPYSPTTWLTGAYGAHPGDIDSLDTSYRANNSLVYMSPKFYGFTVGGSYSFGGVPGSVNRGSTWSAAIQYLNGPAGIAVGYQRVNNSTLGGGAWGDNSTVTSGGQPAVSAINNGYSTAQSQQRLGVTAGYQFTPAWDVSVSYTNVQYIPGVGSSFRNTAIFNTAGAVLHWKAAPQWDFAAGYSYTAATQSNGITSSAKYHQVTLSQYYSLSKRTGLYALEAYQHASGNTLSKLGIVQAATTQIGDGVAAGAGQNQIAVGVGMIHRF

SEQ ID NO: 16078 - protein, 351 aa, Rhodoferax ferrireducens
MKKSLIALAVLAASGAAMAQSSVTLFGIVDTNVAYVNKDAAGDSRYGLGTSGASTSRLGLRGTEDLGGGLKAGFWLEGEIFGDDGNASGFNFKRRSTVSLSGNFGEVRLGRDLVPTSQKLTSYDLFSATGIGPFMGFRNWAAGQGADDNGIRANNLISYYTPNFGGFNAGFGYAFDEKQTIGTADSVGRYIGGYVAYDNGPLSASLGLAQQKTAVGGLATDRDEITLGASYNFGVAKLSGLLQQTKFKRDIGGDIKTNSYMLGASAPVGGVGEVKLQYALYDQKAIDSKAHQITLGYVHNLSKRTALYGNLAFLKNKDASTLGLQAKGVYAGGVQAGESQTGVQVGIRHAF

SEQ ID NO: 16079 - protein, 748 aa, Rhodoferax ferrireducens
MVHALPSALLHLSLLCASPPPASPPAAVEGGEDDAAETAARPYRTEVVSDDAGDGLDAQRALSKANLGFVTAIDLRAEGPLPSDDLATVVSRAPGVTVRSIGGLGQFSAISIRGSTSLQVPVFLDGAPLTGSLSGLVDLSTAPLDALARVEVYRGHVPVRYGAAAIGGAVDLVGEVHRGPPRLWAAAGFGSFLARELRVGYAQALPGGWSVATRVGYAGARGDFPYFDDGNTPQLEADDGQARRANNHYDRGLGQLRFDHRRGPTTAAIQGLAWWKLQGIPGTAQAPASETNLRMASGRLIAKLRHAEGLGPGGYFEWVGSVAVEDRVLRDLDGEVGLSANDQRALGVDGWLSPRMRVALWRSAWLNLSAELRHERIDVDERYGADAQPGEGPVLSSGDAARSRTGLGLGLELDQWLLRRRWAVSPGLRLDAADSRFAVPEGEGEVDDEGRDERIFGVSPRLATKVKLLEGVELRASVGRYLRQPTLSELFGDRGYVVGNEGLRPEQGTKVDGGLLLDLRRPADTDAATGKRVAVFAQVVGFATWSVDRIAWIRSGPVVRAINLASTRVRGLETGLSVRARVGPGPAATRLELDAAYTFLDSRNDTPEAEQNGKPLPGRPRHSLLLRPGLAHRFAPKRRRPSLEPRVGYELEWIAGTTLDLSGRVELPPRLLHGLSASLRLADRVELGLSVRNLSDQRRVVIDPSEGPPTPYPAALSDFIGYPIPGRSVWGTLRVDFALRPSAPRGPA

SEQ ID NO: 16080 - protein, 970 aa, Rhodoferax ferrireducens
MYTFSSHASAGTGARARRLVRLRHSAMAISIGVLLAAPAYAQQAPLTNAGGSAVDLDTVEVRGVRASLIKSQVIKRDASQIVDSVSAEDIGALPDRSVTETLQRVSGVTIDRFMARSDPDHFSAEGSGVMIRGLTQVRGELNGRDVFSAASGRGLSFEDVPAELMAGVDVYKNPSAEIIEGGLGGTVNLRTRMPFDNPGRIVGGNVDYNYGDMSKKYKPSASFLFSDRWNTGIGEMGFMIDIAHSELATRSDGIQVEPYVRRTDDAVLAGSGRSEVYVPGGVNWRQLDFERTRDGIAAAFQWKPSDATEIYAQFLRSRYEMNWQERAAFFNDSNNSITPAPGTTFDYDERGAFLRGAPVSSSWRGALTGDGVRFNTDNRYSEQRTTTTDLSVGFSHFFNDNLQIKGDMQLVQSENEQLDFTVFSATYLPGLTYDVSGKYPSVQIANPAFTQDPSNYFWAAAMDHLGKNRGRQLSTRVDLEYTFDDSSWLRFARFGMRATDRNQVNKNSGYNWGVISDNWAAIPGTSNGLANMSDFMTDQSSLFTFSNFFRGGVNVPTTLVVPNSSLVNNYGSASQMIQQIVALRGSGWAPDTYQPQDTNRQFERTQAAYAALYFGNDEAWGIPVDGNVGVRVVQTKTQAEGFGQFQNLAGLNVSPELQARYTGQYFDNNSQGSYTNVLPSLNLRLRFSDSLQWRFAASKAMARPDYTQLQPYVLLNVETNDAGQATDFVGTAGNPNLKPMVANQFDTALEWYFDTSDMLYTTLFYKKVKDYFSTQTRSEIYDNRPWLVTRPYNMDEGTIRGAEFGYTQFFDSLPGWLNGFGVNANFTFVDSKGGANTATDPYTNTTVTGVELPLEGLSRRSYNLAGIYEKGPLSLRLAYNWRSRYLLTTSDAATRLPTWADDYGQLDGSFFYRFNDHLQLGLQANNLTNTVTKVLMGPTSYEGGEVDPRLYTRSSFVNDRRYSLVLRMNW

SEQ ID NO: 16081 - protein, 759 aa, Rhodoferax ferrireducens
MKISSAFVSVVMFLVLCGAGLKAQERSLKGKVSAAGLALQGVNVMIQGTELKTTTDSSGIYLISGVPAGLIRVQATAVGYRKVVRSLTMVEGTGQEMDFDLSNFQNDLNEVVVTGTLKEVKRMESPVPVEVYTPAFFRKNPTPSIFDALQNVNGVRPQLNCNICNTGDIHINGLEGPYTMVMIDGMPIVSSLSTVYGLSGIPNSLVEQIEIVKGPASSLYGSEAVGGLINIITKKPQNAPLLSADIFGTTYQELNTDLGLKTKVGTATALTGLNYFKYGHIVDNNHDHFTDVTLQDRISVFQKWNFQRKDNRIFTIAGRYLYEDRWGGETNWNKSYRGGDEVYGESIYTKRWEIIGNYQLPVKEKFLFSFSYNDHDQDSRYGNTSYIASQRVAFGQLTWDKKAGRHDLLLGAALRHTYYDDNTAATALNNPAKNIWLPGVFIQDEITLAPKHKFLAGFRYDYNSLHGNILTPRFAYKWSISENDILRLNAGTGFRVVNIFTEDHAALTGAREVVIRNELKPEKTYNVNLNYLKKIYTGDGTFIGVESSAFYTYFNNRIIGDYDVDPNQIVYDNLDGHAVSKGLSTNIDLTFRNGLKFILGATYQDVASYEGGIKMQQILTEKFSGNWAVSYKIKKLNLGIDYTGNVYSPMRLPLLGPLDPRKEYSSTWSIQNIQFTYGGFKNIELYGGVKNLLNWTPNKGNPFIIAGANDPFDKQVEYNENGSVKSTAGNPFALTFDPNYVYGPNQNVRGFFGLRYTIK

SEQ ID NO: 16082 - protein, 806 aa, Rhodoferax ferrireducens
MKHQLLISFFLAPFVSFTQSGNITGKVIDDQQRAVPYANVLLLKAADSTFVKGAVSEENGEILFAEISSGTYLIKASFVGFKESYSSPFELKDQIRIPDLILQENSEALDAVTVNYRKPTVDRRVDRIVFNVENTAISSGTTFDILQRTPGVIVNQGQLLVKNRPAQVYINDRKVYLTNEELQQLLEGFAGVNVKSVEVITTPPARYDAEGGAILNIITSKNLSIGYKGSLNASNTVAIKPKYNVGTSQYYKTDWLNAFASYNFNSRFDVKTDEGFVQFYNPNGSEKATWEDLFQRETRTISHSLNTILDFTLSETEMLSFTANILHTPKANSDISGRTETYNPQGQLDSLYTTQSRLENQRDNLLFNLNYEKQLGENGATLSANANYIDYTDNQMQSVATRYVSAQGNLLNANAFNTIPTQKSQIYTGQLDYSGNLGKWSFEAGAKYSGINSESRQEFFNTAGNVSDADAILNDNFDYTEGIYASYFSFAKDWEKWSFKTGLRGEYTDANGNSRTLGVVNTQEYLELFPTAYLMYAAADNHSFALDYSRRIDRPRFQSLNPYRYFLNENNFQEGNPNIQPAIANKVKLSYSFKNKLSFELYWDRIDNAMSRLPFQDNENLTLRSVNTNLNYEQQYSLDVIYSEFVNNWMWMSVYASFFNLENEFVALEDNNSLVQKEINGLYIETLNYLIINPTLNVAISNNFTSNFLVGSYEYDRPQYRLNVDIQKRFLDGRLIVNLSSEDIFNTNNIPLTSHYLNQNNTFFAMPESQKIRVGVRYNFGNFKLSDNSRNTSVEEETRLKELGTN

SEQ ID NO: 16083 - protein, 223 aa, Chlamydophila felis
MYPTDPRQLNTERQIYLDKQFFVDVFSIPACVRNTNGDLSATNEKFSKEFIGSLDIKEWFYSLPVQVATSFLREELDAMSLPSSMNKIQSVAIGDKLWLVQFIPLIYGEVVNVLWLFFCKNSNVIVDYCRGLRTNITNDRMLEFKNKSTEIQWKVFILYSFGFCHESIASLLSITNGSSRNAISEVYKFFGIHSKHDLLMIFHTSRMHSLFFDELFFILKCAE

SEQ ID NO: 16084 - protein, 699 aa, Chlamydophila felis
MKHKFTALLLPSALLAAQPQTAIGQTTLPAVEVNSDSTPVGSPSYADTITDTRELDKQRPAYTLPQVLEGQTGLIAEGVFGGIDHPRLSIRGSGLQRGTQPAGRGIEIREQGLPLGYADGSFDFVESIDPLSFDVVRVLRSGRAVVTGSATLGGVIDFIRYPAQLGIHQNQLRYETGSFGLHSIQGQATKQIGSTQATVNITDYQKNGFRLHNRQEALRSQLSLEAKIKESAWRWRAGVADSSSELQLPGPQTFTQILNGSNAAQPGNVRGNWRRITQRTRLNAGLEGPTATGYLNVNMAYQLADVQFIRRDQQDESNEDIALQAHFKPNNSPWFLETIYQHNERSLQQYLNGGGTMPTFTGTRGLKWADNTLKADRFAFTAGQERDLGNSFSALMAVGLNHHTRRIEDNFQTSALRPAAELDTDYTQLSGFAEIRYALSKTNTVFLGFNSVGEPPTYDMLLLNSAGTGAGAALVNGADPRRPTLKPLDAQRQQTFEAGWRHLSNYSSIDFTLYYAKLNQEVIATLDPVNQINTNLRNADDTQRIGAELNAQTRAAQNLLGSGADLLAKFNLNWVDARFDADPMFGNNTLPVVTPLSMYSALALNKSNNWQTELFAQSVSRGAYVDYTNTVRAGDYLTLGLRGQVQFKEWVLFAEARNLTDERYASTVIGASLNAAGADTASFAPGEPQSFTVGAQLKF

SEQ ID NO: 16085 - protein, 263 aa, Chlamydophila felis
MANADLDKQPDSVSSVLKVFGILQALGEEREIGITELSQRVMMSKSTVYRFLQTMKTLGYVAQEGESEKYSLTLKLFELGARALQNVDLIRSADIQMRELSRLTKETIHLGALDEDSIVYIHKIDSMYNLRMYSRIGRRNPLYSTAIGKVLLAWRDRDEVKQILEGVEYKRSTERTITSTEALLPVLDQVREQGYGEDNEEQEEGLRCIAVPVFDRFGVVIAGLSISFPTLRFSEERLQEYVAMLHTAARKISAQMGYHDYPF

SEQ ID NO: 16086 - protein, 205 aa, Chlamydophila felis
MGSIYGLYSFINNLFIVRRNHARSDIKTNELRNIIGGYETAHGKYNSTSYSGQVVGGYNYLWKETSFAPMAGIRLTKIKDSGYQEYGTSFQNLTIQKRQYNKVEGILGGEIKTTYYKDEFIIRPQIHAFINYDFKGKTPAIVADLNGLNEPLPVLAPKPTKMLYDLGAGAVIKKGRMEHGVQHYSLNLAKKYHAQSGTLRFKVNF

SEQ ID NO: 16087 - protein, 823 aa, Chlamydophila felis
MKASAILLATTALFAPVSALAQTVAGEDPSSLADTTEIIVTAVARGQNRLDSSVSVSSLSAEAIQQSAPRSVAEVFRNIPGIRSESSGGEGNANIAVRGLPVASGGAKFLQLQEDGLPVLEYGDITFGNADIFLRADFNVQRVEAIRGGSASTFASNSPGGVINLISKTGETEGGAIQASTGLDYSDYRLDVDYGGKLSDDLRFHIGGFYRQGTGPRQAGYDGNKGGQLKFNVTKDFAGGYIRFYGKYLNDRAIGYLPNPVRVTGSNSDPKYRNIPGFSINQDTLHSRYITRNVTLDGSNNPVVNDIRDGQHPVVKSFGLESRFEIADGWEVTERFRYSDVSGRFISNFPANVDSATTIAAAMGGAGATLSYANGPNAGQAIANPAALNGNGLLAQIVVFDTKLNSLNNITNDIRLTRDFEAGSGKFSFTAGFYKSRQTIDTEWLWTSLLSDVVGGGKAALVNVRSATGQFVTQDGIYGYGASYFGGCCRRTYNIDYNTNAPFASLTWTSEKLTLDGSIRYDFGDANGSIAGADLGGGRVGTVSRDMNGDGVISNAETRVSVVPLTSPAPVDYSFNYWSYSLGANYRLAQDLAIFARYSQGGRANADRLLFGPAVSTVDGHLVDSNAAVDMVKQAEGGVKYRAGGLALYATAFWARTEEQNFEATTQRFVDRKYRAYGLELEGTYRSGIFSLTAGGTWTKSNIVSDALTPAVVGNVPRRQAEFVFQATPQIDIGPVTVGANFIGTTSSYAQDSDQLKLPGYTTVNTFLQYRPIERVQLSLNANNLFNAKGFTEAEEGVIPANGIVRARSINGRTISAAVRLTF

SEQ ID NO: 16088 - protein, 441 aa, Chlamydophila felis
MTQRKRLSLALWSTLAGITPFAAFAEEQKEGFVEGSSLNILNRNFYMNRDHRHGESSPTGSGYSEAWAHGIMGRFESGFTQGTLGVGLDAFAMVGIKLDTGDGRNGLQTPFSVMPVNSDGNARNEYTKVGGALKARAFDTVVRAGDVFPTTPVVAFGDSRLLPESFRGVTAINDSFKGLTLQGGRLNGMSQPASSDMKEGFSTFYAGPVDSPWLAYFGGDYKATNRLNLSLYTSRLKDAWDQKYGAVSYVLPINDDLSLTSSLNYYNATDEGKRLLGEFDNDIWSASVDLKYGAHSLALSHQRNQGDDDFDYLRLSDSIYLTNSLQYSDFNSPKERSWMLTYNLDMTPYGVPGLTFMTRYGKGTDADYTNANNTYMRRDAQGNPLTDQKRWERNIEARYTFQTGTLKDLSVRVRQATTRATEFEQNLDEVRVIVEYPLSVL

SEQ ID NO: 16089 - protein, 744 aa, Chlamydophila felis
MKLSRTFITNPFTLAICAAITTQSPVVSASTDTEGRAPLDTVVITGRSEKVISDIAGTVWVVDSEQIEQQYRGGKNLSEILASAVPALDVSSQGRTNFGQNMRGRPMLVMIDGVSLNSSRSVSRQLDAIDPFNIASIEVLSGASSIYGAGATGGIINIVTFRADASELAFESYAGATSGFNGGEDFDYKIAQSVSGGNDKVKGRVSVVYGENKGAFDADGNINVPDITQGSLQFNEVVDVLGTLNITPDSAQSIQLLAQYYSSKQDSPYGIYFGENLAGAPNNITGNPADTSLIETRKGFSSDRQGGTERLMLNANYHHNNVLGQDLFLQASFRREEFSFIPFIYGSYLAASEQNTDVLTLRAAMVKSMDNLTLTYGIDSYLDKLTSNQALFDRNLSYQSGGLINRTEAKIGRYPGTEVASVAGFVQADYQLTDDWSLSGGYRYQWMQNTIDDFVAASVQQQIAQGNGTSADAVPGGSTDYTIGLFNLGTVYKLSKNAQIWANFSQGFDLADPAKYYGQGNYSAPDANGHHTLTDSINVSSSKMQGIKTNSVEIGARQYLDALSWQAAAYISESDKTLKYNRQTLNIDVNDAKKRIYGIEAEVAYWLTDNLQTGLTGHWVDSEEQDSEGKWSKMSVNYASASKAGAWLGWYEDNYSVRLQNQTLFDLSDENNGKIDGYSLFDLIGTVELPKGRLGFGIQNLLNEDYTTVWGQRAKGWYSYYGPEEMFDYRGRGRTYTLNYSLSY

SEQ ID NO: 16090 - protein, 1047 aa, Chlamydophila felis
MKNSKNLSLLSRLGKLQRLFLVALFSVLAIGAAAQSKTVSGTVIDQTGEPVIGANVLVKGTTNGVITDLDGRFTLSNVPNNGTISISFIGYKDQEISVAGKTNFQVTLQEDNAMLDEVVVVGYGVQKKSDVTGALTRVGSKELNAKPVSNAFEALQGKAAGVDITSSQRPGSVGSIRIRGNRSLNASNTPLYVVDGVPLSAGGIETLNPRDIESIDILKDASSTAIYGSRGANGVVLVTTKRGKVGQFALNYSGTVTMETIEDKSPVMSASDYITWKRWAYYNNNPEVYAPGNAPTYENDQKIFAGDTYALKNVNKGWEGNSWDGSKVSNTDWTGIVTRTGITHEHTLSATGGSENLQGSFSFGYLNNKGTQKGQEYERFNLAATVDITPKPWIKIGASINMSFADQQYGVDRMAGTNNGPGDIYGLAKSIPRYAVPYDDEGNVIATPHTESRTYTVVDEWKKVNDDRENYRALASFYAQLDFGKMWKPLEGLSYKFAFGPDFRYNRNGIFRDSSSASLAGSTNYASWGSNRYFSWTLDNMILYNRQFGKHNIGVTLLQTASKNNHESGSMSASDILVPEMLWNNMGIVDVTQSRYKAGMGTGLTESQMASYMARINYSFNDRYLLTVSGRYDGSSVLAAGNKWDFFPSAALGWRINQEEFMQDITWIDNLKLRIGVGTTGNSSVSPYGTLGGIFTGWMPFSTGNQMIFVTNEPYYVDMSKKANSMANRDLSWEKTTQWNYGIDFGFLSNRINGTIDVYHSKTKDLLMSVNIPTLTGYPSTMQNIGQTKNFGVDISLSVTPIRTEDFEWVSSLNAAYQKEEIVELANGKNDMIDNTWFIGQSIGVFYDYAADGIWKESDAAEMAKWNEKGSKFKVGMVKPVDQNGDYQLDANDDKIILGNKTPRWTLGWSNYFTWKGVELGIELYGRFGYMISTGGEAQAGQFQQREIDYWTPDNPNAEWQMPIYGSGDSYAGLLGYKDASFLKLRNISLGYNIPQNICKKIGINSLKVYVQGRNLGDIYSSIDYIDLDLGTSYYNRGVTFGLNVGF

SEQ ID NO: 16091 - protein, 849 aa, Chlamydophila felis
MQGILMKNSIYGVLLFSSFALSTATKLLADADSVNLATGFNGSTSETFNVKQTDNADGTTYILGSAITFEHINQLKPANTSCFANTAGDLTFTGNRRLLYFNNISSTAKGAAISTTADGKTLTISGALQLIFYMSPRLATGNGVIYSNSSVLIENNSQGSSGLNKSAGKGVFICCEKSTDVGATSPTLIIRNNGEFLTVGNAATSSGGAIYAEKMILSSGGYTKFQSNVSYDQGGAIAIAPNGEISLSADKGNIVFERNLKIANKQNTPNAIHLGDNAKFLQLRAANNKAIFFYDPITTTGSVADRLIINNSQGEASTYDGAIVFSSLNLFTHSPECKLSSFSQGLTLAAGSLVLEEGVCVQAPSFDQRAHSQLFMNPGTKLQATQNISVKNLHLNLNRIAEEPAYITTTDDASSVDICGPVVMHIDDEIFYNQTVLANELSVECLNLSSPHLDNITIDDVPAVPIMTLESHRGYQGTWEISWKEQPKLTFGKATIAPNKQMHLIWKPSGYVPFSGGTGEFTTSLVPNSLWNLFLDTRFSQQAIEKHAVSSGNGIWISSMTNSFLQGSTNNNHGFRHKSSGYTAGGKIQTLQDDIFSVSFSQLFGRSKDFGSATSKDTFLSGSIYAQHSRRLLPIMRFLAGTSTYRPRLLLSIPKNLPINFDVLVSYSYDSNHMKVKNSNRTQTRGSWNTYGYSAQIGSSIPFVLDVSHTFFQYVSPFIKLHWIYAHQVQFQEQGIKRRSFNNSNLKNLSLPLGLKIQGQTLRRLSYEFTGMYITDLYRCNPESVTSLISGGLLPWTTTGTNLSKQAALLQGSSNISLTSHINIFAQGTVEFRRSSYSYNMDFGSRVHF

SEQ ID NO: 16092 - protein, 788 aa, Chlamydophila felis
MAQSAENGIETIEVTATRRAGSLQEAPLNITALTSDTLAEQNIADLDDVARWVPGLTITDQGGRNDSPIIVRGLNTNSSGPSSDGGTVSTYVGEIPLFINMRLNDIQRVEVLIGPQGTLYGAGTLGGAIRYLPNKVELDVTSGEVTGNVFSVNESDSVGAEGGFVFNTPLIEDVLGVRMSLNKFHDPGFVDYNYLVREGGVSIADPDWTDARDVDSNLRSKKDANGEDTLSGRVALRWTPTENIDATLTYMYQKQEVEGRSIVHYNGLSPDNGLNDIIGKYESAYRYEEPREKEDDLLSLELSVDLGFAELVSATGKSTFEAVGQRDQTDLLIRLAYSYEEFPAFSSYTREEDNRDIFTQELRLVSKNDSDLSWIAGVFYNKIESDGRSLEFTPNFDEYAIETWETGGNLRTDDLEYISFDETEVTEKALYGEVSYAVTEQLDITLGARFYQYDLETASDVDLPLLYTSISVEEGAEDFRQGDEIILIPLENEADDSGSLFKFNASYQITTDVMGYVTVSEGFRIGGSNGVGACPPDLSGDTQEVCALPDEQIYAPDTTTNYELGLKSTWLKNRFHFNMALFNVDWDDAQVTGTTENGQQTILVNAGKANSKGVEMMSRAIFSDEFSAYATYAYTKAELTEDVAQLFDDSDGLDGDRLPGSPEHQFSLGVKYSTEVFGDKLLDVTYGLTAQSDIYSKIGLHESGEIISGYALSNLSASLSDEDWSVTLYVDNLFDKYAVSSSRNDLGDIGLAVAPDTNSNRGDILRYYGHYLERPRTVGLKFNYQFEM

SEQ ID NO: 16093 - protein, 942 aa, Chlamydophila felis
MKHPVYWFLVSSGLLASTSLSFAATVQETLNSSDSYNGNTATSAFQTKETQAGAEYTCEGNVCITYAGKGTALTKSCFTETTENLTFLGRGYSLCFDNINTTAKPAAIEVSAADKTLSISGFSLFSCSDCPPGTTGQGAIKSGGTATFENDFSVLFKKNCSTAAGGAINCKGLTLKGTSGIANFIENKSTDNGGAIEASGASSIENNSGVISFSGNTSAKHGGAIHSNSAVTIANNHRVEFSKNTTTGTADSSGGAICCKDNAAPELKFEGNAQLLFLENSSQVSGGALYSNKLTISSGGTTVFANNTVTNANPMGGAICLDTTSGECSLSADLGNIIFDGNKVITSGGNTTTKRNSIDLNTSGKFTQLRAKDGFGIYFYDPIADNGDANAALNINAPENATTYNGRVVFSGETLSATEKTEADNLKSIFKQPVTLSAGSLILKDGVTVEAKKITQTAGSAVVMDAGTTLQTPSTDGETITLPDLTINVASFGGEGGTSSPAKVHSQTANQALTVTAVSFIDDDGNGYEYPVFSKTRDFADSILLEAATGTTVTAPAIPTTPDTPSAHYGYQGNWTIAWAQGTAGTHEQKATLTWTGTGYIPNPERQAQLVPNTLWGAFTDMRALHQLMSVSATDLEQERGLWGAAITDFLQRKKTSTSKKYRHVGVGYAVGASVHMPTEDLFSLAFCQFFNNDKDFVVSKNRTHVYAGSLFFEHFHMLHPQNYLKVGSKFPPAFLANLPENVPMILNILFSYSHAENDMKTRYTKRYSPKPVTYPEVTGSWGTNCFGGEISTSFPIELSDSYMFERFVPFMKVQMIYGEQESFQEPTSEGRSFENSHLVNLALPIGVKFENISSNNKDTFDLTLVYSPDVYRSNPHCATSLVVTGAAWETKATNLARHAFVVRAANNFTYSEHIELFGHGGFELRGSAYSYNFDLGGKILF

SEQ ID NO: 16094 - protein, 771 aa, Chlamydophila felis
MRPRRSESCRRCGPPTVLSALWLLVVDGNAFAQSDGGLRELPPVQIFAGQTPRHKRPPASRHAGTSTRAGHRIFVYPAAAPASGTRSVASGPEGPPGMASALTVSGEELNARPFTRPGEVLEAVPGLIVTQHSGEGKANQYFVRGYNLDHGTDLAIYVDDVPVNMRTHAHGQGYADLNWLIPETISAMDVRKGPYFADESDFASVGSVRIGLIDRTEKGLAQVTAGSFGYRRLLGMDSAKLGEGAVLVAGEIGTYNGPWDNPDNARKLNGLVRFSQGTATDGLTVTGMAYANKWNSTDQVPQRAITSSFLDRFGSEDSTDGGNTNRFALSGRVAQSDELGSWKANAYVVKSQLDLFNNFTYYLSDPVLGDQFHQHDDRLMAGANISRTLNGSFAGLPMQTTVGLQSRYDAIDLALTNTVHRSYLSSVRSDKVGEGSVGVYAENTLRWTDWLRTTVGWRGDYYAANVISLFNSNNSGHADASLGSPKFRMVLGPFNQTEFFLGAGYGMHSNDARGATTTEDPSDPATKLSPSPLLVRTRGAEVGVRSRIIPGLDTSFSVFILDQDSEILFSGDAGNTEATRASRRYGFEWTNHCRPRSWIDIDADLAMTRARFRGYDSDQAEVYAALAGYPEAQIGNAPGNYIPNAPPMVASAGITLGEKTGWFGSLRWRYLAASPLTEDNAFRSSATGIFNGRLGYRADNGWRIQLDVLNLFDARANQITYAYGSLLKTDALYNLCTGGVAPAAVCRNGVMDYVLHPVEPLSFRLTVAGTF

SEQ ID NO: 16095 - protein, 397 aa, Chlamydophila felis
MSNDTLRLRALGACAAICLAPTAYAADDASPVTAEIGGRVHWDFTVFGNDDRGAPEHNDTQFRRVWLDVSGKFYGFNYKAEADFAGLQYEAGSRGILARDVYIAKKFSAGTLTVGQFKQYFSLDDRTGSNYEPFLERGYASTTLAPIYRKAISWQANRPDATWSTSAYSLESIDNSSTKGGALGTRLTYAPEMGEARLRHLGLSLAHERYSHPGSGGAASLLIRPRPENDLANNSRITLVRFADGRDTDFDKWSLEYAEVLGPWSWQSEFSGGLLDDGAQHAKVLASYGLVSWFVTGESRGYDRKSGRFSRIATPNRPSGAFELALRYDYMRGGQHQDGQPDFINASTQSWTLGGNWYFKPNLRVMVNLIDSHNRNRLSDAVVDHTQAVTGRFQYDF

SEQ ID NO: 16096 - protein, 384 aa, Chlamydophila felis
MNKTCLALVLPMLLTATSSQAVELYKDQKNTLDLTGWLGFVALNDSHDTSVIDDSSRLRFSFERSERNGWTAFATTEWGINMVSSDDGLVMQGGKLAAEKTDDFLYNRLGYVGMSHDVWGSLSFGKQWGAYYDVAGTTDLPNVFAGYSVGAYTFGDGGLTGTGRADSAFIYRNSVGPVQIALQYAAKTNGDVSLKNDDGSEMSNSELSFDSSYGASITYAATDKFKLLAGFNRGDFEGHLGNTQVDETNEIIGIGAMYGDYYHYAEGREASGLYVGFNAHQSKSNELVNGDLYDATGAELMTAYQFDNGFVPMVVLSYLDLDTDATTPIQGNWTRQFAMLGLHYRYSNDTVMFAEMKLDFSDMDDAALEAQEDNSFAVGINYFF

SEQ ID NO: 16097 - protein, 715 aa, Sphingomonas sp. A1
MTGDSSGFEGGFVIEDGALIAGSDQAFGGRSISMVGRGPTLGILDGVTVGSDLLVQNGGHFSVIEGQGTFTGEISEQTPPFDQPGGIPFTVLVPDVEEEPTFPLLTKIGAGELVFTDEVNVVDVDLAVANGLLTFNGTTNRAIMIRDAGALGGNGTLMTLAVGNGGTLAPGNSIGTLVVTGDTSFAAGSRFEVELAANGTSDRLEVGGTAALDGSVAPSDVDPAADYAARQRYTILTAAGGIADAFDGVEEDAALVEYELSQDDNNVYLTRIVVTQEPPAEPEEEEPQAPEEPDEPEEEEPQTPQDPEDEEPQAPEEPEEPEEEEPQAEGADDPLPDFGLPAEGSNATQLAMVLSEFDFSGRDETILNSLLNLNEAELNLAYRMLGGQIHAEVGRASAELSQVFNGAMLDAAGSVVAASEGAAGLGSMPVALSWAEVYGNGLDVDGDGNASGLTRDSYGVAVGTETGLSVFGDQLTVGVALGYSDAHLALTEVSETADIQSLHLGIYTESGAAPTETGIAYTSALSYGRHDIATERNIAFGSVDRTATDEYMANSLNVSVKTSYNVALDNRFGLAMASPFVALHYSQVEVGDVDETGAGSLNLSGSDNGDDWAAMSVGVTTTGTFSVGGNTVSTSSTLAYEKVLGDSIGSATLMLDGSPASFEVQGVDQSRDRIRAGAQGTMAIGDSTSLSVALDGIFAEDREELNVSTSVSFTF

SEQ ID NO: 16098 - protein, 842 aa, Sphingomonas sp. A1
MQQRRLAARPGRFRLSALALAIAAAPVGAVEENVVALEHIEVVGQAASIDAALNDQRDSDSVQSTVHADGVAQLPDENVAEAAQRLPGVSIERDQNEGRFVSVRGLGPDLNSVTINGTLVPAPESGRRAVALDVLPAELVQSLSVVKTLTPDMDANSLGGTIEVESLSAFDHDGLFYTLSSEASHDENTGENSPKFSGAISQRFSLGDGIDNFGVAAAYSWSDRDFGSDNVETGGDWDFEDGPRLEGAELRDYEISRERTGFGLNFDYRPDDYSSYYLRTLYSRYADSETRNAAGVEFADPLAPGGSGEAEGWRELKDRTEIQTIRSYVLGGERLLGPWTLKGQVGYSRSSENSRGLGSAVFESDEEFEDAGFTSRAKPHLNIGSGFFSADGFSFDEAEMARERTTDTERNLKLDLARDYELSGHAAQVKFGGKLSRRDKDNDTDIWTYEDLDEYGLSDAQLAMSGYTSGTVHYGLGNFGPGLSASRIRALLGGLDRDDFYDEEESRVNDYDMKEDIDAAYLMHSLDIGDLRIIAGMRYERTRFEARGSGIRDGDFESIDERNTYDHWLPGLHLRYRLGENTQVRAAITNSVVRPTFGQLAPGFVIDGDEASFGNPNLSPLESRNFDLGIEHYLGRAGVVSAFLFYKDIDNFAYNTDLAGSGVWADFSEANTYANGDRADLWGLELAWSQKFDWLPAPWNGLLVGGNLTFTHSEASISSRDPDSGRKRHRDIDLPNQSKRVGNLMLGWEDDRLSLRLSLNYKSDYLQEVAGIDDEDHDLYVDDQTFVDFSARYSLTPNLQLSFEAQNLTDEHYYVYSGHRSFNAQYEEYGPTYKVGLTLVNF

SEQ ID NO: 16099 - protein, 757 aa, Sphingomonas sp. A1
MSRPVVSRVLPFLGAALVAAAVPAAAGAQEIEEIIVTAQKRAQSAQDVPIALTAYSGEFLDRLGIDQLDKLSDYVPGLQIQLQSPNNPGFVIRGITSDSGSSQQEARVSVFVDGVPASRARGAVVEMFDLERVEVLKGPQGTLFGRGAQIGAVSIITAKPTLDEVEVKAEGSVGNYGQRRLEAAVNLPVNDRVAVRLAGTTRDRDGYIDNIAGSKALMGVGVQAARGSFLLVPNDDLTITGVVNYQEDDYTGTAFKNKRFAPAGGSTSPFTAAQLNRGDELGTDRSLFNATLTAEYELNDSLMLTSITGYREFNALEEFDADGTQAYLLEFAEDAQGKQWSQEFRLNYEIGDKLEGFAGVSYFYEDGFQRVPLRTDERQLAIFNPGGALPFPNLGPIITPAGTLNPLVALLGLPRSAGNPLPFPLPALATGEFTNFGTNKAYEAFADATYHVTEEFSLTGGIRFTHEEQESAFQQSVSPTAILLPALFPNVPRRELSEDFDSVVGRLVASYQPTPDSLFYASVSRGRRPAVVQVDATNREVLKNEIVWSYEAGSKLSLLDDRLTAEASAFWYDYSNFQTSVRVPNSALVRVDDAGEARSYGFEVALNAQATEWLTLFATYGYINARIDDEDSNGQQQELGGNTFRLTPKHAASVGANAVYAVADNLEVFFTPSFTFKSRVYFEDANTPGIEQGAYGLLNLRGGVQSADGVWTLTAFVENALDREYIIDAGNTGGSFGLPTFIAGTPRFYGVEVSARF

SEQ ID NO: 16100 - protein, 694 aa, Sphingomonas sp. A1
MKYPAQRSFSHGFGVLTLSTLLAAPHALADQPTTAGSSQLVLTPVLVSGEKVERDLRNTASSVSVKSASEIDSLKTGNASVHEVLNDVPNVIYTDTVGAPIIRGQDTQGPNNGANVFWGGTVPRATINLDGHYLNYNEMYFGAPSVWDVDSIEVYRGPQTTSQGANAIAGAIVVKTKDPTFTPEAAYQAEIGSYHSRRSSLAVSGPLSDNLAGRLALDYAARDTFIDYTNPSFASHNTDQDFRALNLRGKLLWLPDAVPGLGLKYTFAHGDSNRPTQEAASRPFHKLDHTGATMPSWHQQSNTHIVDVDYELDNGMKLFNQTQYSLSNVHRVIGVANGGDADIRQKNFSNESRITFGEQQDTLSGMAGLYLARTDSDEILYYGGISDFDDTKRNLGVFGEVSYRLNDRWTLTTALRLQQDQIQRSGTSPFAANGLDYDKTFTALLPKVSLAYALTPQWTVGGMVSRGYNPGGVSLNLSSKRFEAFDDERMWNYELFARASLLDDRLHLNANLFYMDMQDAQYNIPVVLASGLTQSYTINAEKAHAYGFELSADYRVLDNLTLKASAGALQTRIDDIDANNRYAGNEFARSPGYTVSFGPSWDITDRVNLNAQVRHIDGYYSDVANTKSYAIDGYTVADARMSYRFSDQVQVYTYVKNVFDERTPTYMQTNRGIGGIEASMTEPRTVGVGVKGAF

SEQ ID NO: 16101 - protein, 463 aa, Flavobacteria bacterium BBFL7
MQKTMMTFLLSSMLLGCQQTEVDLQSNIQLPDVYQYARLEKGAPIVQNWWESWQDPQLSRLIQQGLAQNHQLAIAKSKIQEAQAIVKIAQSTRFPTIGALANSGKSHLDIEQIDITPSGVLGGIRVAWEPDIFGQKRSDTDAAQATVLGAQQQFYAAQILVASEIAHYYLQALHNKKQQALLQRTQMALKALQNYIEGRFNAGQASAYERNEIKIKRHSLAAKQAILDAQFIAAQNAIAVLIGETPQHFKLDIGQMQNVDILSHLPRPPKGIQPADLLHQRPDIQAQTANVKAHAAKLASAKADLFPRFTLDFLWQTGRIKLDADLPTLQAWQNVVSAGIQLPIFTAGRIQANIQASDERLQQALLQYDRTLLQALAEVENHYQQQFSLTQQARLLTQASRTQQQQVRDTQKLFQYGDYTFDRVLQARLDALTLEEKQLENQLACAMNLVLLYKAIGVGWQSQ

SEQ ID NO: 16102 - protein, 236 aa, Flavobacteria bacterium BBFL7
MVRFWSGWRCGLAGAAAAAFLSAGTVAQAADPEAADMLAKLGRPGDFSLAPPEVSDDAPSGWYMRADAGYVASTGSRVTSAGVPAAGELSGSGWSVGGGIGYRFLPVLRGEVSLDYLDLGTARNGIAHMSSNATVALASLYWDVITVAGFTPYLSAGAGFSINSLDVAPAAFGPAVNDWQFAWSAGAGVSYALSADLSLDVSYRYLDLGSPSSAGVFAVSDAIAHQVRFGVRYMLK

SEQ ID NO: 16103 - protein, 465 aa, Flavobacteria bacterium BBFL7
MANSMIKHTKKLLALEIFSILTASCYIPKINAQPFFDDATLKGGIYYWQRDRSRKELTPGSDKYGQYTDNLKHSSLNIALDFSSGYIQDFIGFDFAGYTAVELSNGGPAAPNEIGFSDAKNVWDEKGTGDRNGFTFTTAATKLKLGPFWGKAGYIQPSGQTLLATNWSFLPGTYRGAEVGAEFDTEDSGKFNISYMWTDQYKAPWYREMYEFREADSTTTIDYLHSLGVKYDTKNKLVLEGAVGQAEGYMDQYLAKISYAFPLAGRDLRVSYQFYGAQDKDNSGGVNDVYDGLAWLQAFTLGYTYDALDFQVEGTMVHSPGQQGYFLQRMTSAYGTSNGRIDVWWDARSDFNSDNEKALFAGVTYDLSSWDLAGWKIGTSYVYAWDAKPSNNPIYDQSQRVRESAWNFDILYTIQTGKAKDTTFKLHYTRFDNHSDIPSWGGGFNNIFQDEKDIKFIVTAPFTIF

SEQ ID NO: 16104 - protein, 367 aa, Flavobacteria bacterium BBFL7
MNKKIIALAVSAAAFGTTAQAVELYNQDGSTFSVGGHVSVGVQDSEKGDAGVNSVSPRINFEATQDLGNGFTADAKGEWALNMLDGGDNSFTTRLGYIGVSHAELGRVAVGTQWAPYYTAGGVADLPIAFANDFLYDNHGALGTGRADAMLAYTNAFDFGNAGAFNFGLGWQGANDIDNTTTATTPPVTNGKFELGQRAQVQLGYDIAGFGINYAYTGGDITSTGLTVQNLDDKATSHLVSAKYGTYGKGLYIAGVYAMNDYMTSYDKGTQGLQLDDTKAYEAILAYGLSNSLNLSVNYESVKYDGNKVLASGYQGETIYATSAIQAEYDVTTRMRAYAGYEFDLQGTGAFKEDRDNMWMAGVRFFL

SEQ ID NO: 16105 - protein, 918 aa, Flavobacteria bacterium BBFL7
MTEWMNKWLMAIFCWMIFMPVPDLLAQSAKTKDDPRITLRMKEVSLPEVLSEIERQAGVTFSYESSLLKELPKISFQVKDEALTDCLTRLFESYPIVYKVSGKIVILKRRQRQVTISGFVRDQASSESLIGASVYEVASRKGSATNSYGFFSLTLPPGNIRLHASYIGYESCSFNFTELDRDTLLNIELRPNARLEEVVVTASERDRLSVNNTLMGTMEFSQKTIKATPTLFGESDIVKTLQLTPGVASGTEGLAGLYVRGGDQDGNLFLIDGNPVYQINHVGGLFSAFNPEAIRNLDFFKAGFPARYGGRLSSVVDVHTKEGNMKEYHGSATIGLISGNLSLEGPIIKDRTAFQIALRRSWLDVFSAPTIAIVNRVIKKNGSRINLRYAFHDLNLKLNHRFSDRSRMFFSLYNGNDVLKGGGTDFSTEEEQVPYTDGTHSSLRWGNLMGTLGWTYVFNNRLFGRVSGVFSRYRSNVRSSKEYNYGVEGEDNYLSSSSETSSSTSILDMGVRSSFDYTPSTSHVIRFGGDFLMHRFRPEYNEVKAAGSGMLEFSNIGKIYTNDLLWAREAAVFGEDDWNVLPSLRLNAGLRFSLFNVERKAYTLLEPRASLRWLLRDDLSFKASYARMGQYIHLLGNSYINLPTDAWMPVTRKLKPLISDQVSVGFYYNLMRSYSFSVEGYYKWMKNLLDYKDGYSFLPGTAAWEEKMAVGKGRSYGVEFLARKESGRTTGWIGYTLSWSDRRFDEIDNGRRFPARYDNRHKLNIVVSHKLSDKVELTAAWTYTSGNRMTLSLESYEQAGTLTISNQYKMNNWWEPSGEVVDLYTRRNNYQMPAYHRLDLGLNIYRPKKKGRMGIWNISIYNVYSRMNPFMVYKSDNWERTNNLVPDSSSPYSGKTKPCFKLIGIMPIIPSLSYTYKF

SEQ ID NO: 16106 - protein, 775 aa, Flavobacteria bacterium BBFL7
MIQRAFTRESARSRLLASTCGLSVALACVMTAGSSTATRAQTADTSTPRARHVLPEVRVESANPPKPQRAARSSDGRGARRAAAQAPKPAPAQQAAAATSDNSLKPMGGKLPQPGIPHTAQQSITVVDRAQIEQTSPTSLLDILQNVPGVSIARAGGIGGQIYLRGFSSNNWRSPMYIDGDRFRGRNTLQLNYFAPEEIERVEVVRGPASVVYGSEAMTGLVNVVTRRPQVDPFGPWRVTHGGFSAGYSSVDNGFSTYEWAQAAGMGFDVLGGVSYRKGGNYQTPSGPALNSDYESIGGNLRLGWSPTSNQRFELTLRDYWEEDGRAGGVGGAPGWPYMQVRQQPNQVHMAKLSYAGDFTDQLVQHVEGSFYANYFDTKLSTVNTATPGVVTSSVSHVGGPLVIGGRVQGVIPWDPAPWGLLKTTFGFDGFQEWRPGSTSWSVRQTATSSTITPEFKTGPDNTQANAGAFMLHEWKPIDLLTLSAGGRFDWFNTTSELSPVSSARALAVLRQNSDVTATAPTGSIGATVHVTPILDLLASVGTSYRYPTNSELFAFSGTSIPNPELKPETGLTYEGGFQLNFPTATFKVTAFDSHYANFLQSVFVNYNGASVTQSQNVGHATVNGVEAEWRWQATSSFNLHGNAAWLQATNTDTDAPLPFIAPWKGRVGVQYAPIGSGYAVGAAVDWASAKTRINTTQEYPTGAYAVPSIYASFDLGVLVSRRLGDTKLHLSLQNIFDTSYASASTYVNRSYSQSMYNPLLEPGRNFTARLTHTF

SEQ ID NO: 16107 - protein, 322 aa, Flavobacteria bacterium BBFL7
MKLYAKVFGGAAALLAAWPAMASDAVASEPAPYNPNFSFVGGVGVIDIQANELVYQAPGSGSKLSHLIWESTSAVISAEMTARSEAGWTAKLSGQIAFSGNSYMEDYDWNPSFSTNDGWNDWSNRSRHCDTDLDYFYSATVALGHDFQFSDQLLINVNGGFKYTSVKWTAYGGSYVYSVAGFRDSVGDFPGDAKAISYQQKLPVAFAGIDATYVQDRWNFGFALKGGTTFSAGATDHHWMRDLRFEDDFESAPVLMVGGSVGYQYNERTSFFVSGSYVKVFTARGDYNTYDIATGAETGGEDDWIGGDFAAATVMVGIKTSF

SEQ ID NO: 16108 - protein, 697 aa, Flavobacteria bacterium BBFL7
MKLYNLFSLSLFTLAMQAQAQEATDATEVKQADAEVEHLLISGVRQDRISGGATGLTMNISETPQSISVITSDLMDNFAAFNINDALRLATGVTVEAWETNRTNYSSRGFEIKNTQIDGVGLPNDWGIVTGAIDAYGYESIEVIRGANGLLTGVGNASGTINYVRKRPTNETGGEVSVIAGSYDFKRIQADYNTLLTEDGRWAARFVVAGEDTNSHLDGLSDNLGYFYGVVDGQLTDHSTLTVGISHQDANTDGNLWGGLVFNYTDGTQAEWDDSDSTTQDWTMWDTQNTNAFVEFTSQLSDNWRLDVNYHKRYFEEQDKLFYAYGTIDKETNLGLLGYPGRYDSDIDSDLLEVKTSGFFSAFGFEHEATFGVSYAQSTDTMFNYAADFTEAAWGALPAFPYALDAIAEPDWQERTLYSEIKQNLTRVFGSTKITLSDSLFMIAGVNAIDFERSGDNSGTTIDNSESELSPYVGFTYAITEDINAYASYSDIYQPQEQYDLSGQYLDPTKGKNTEAGIKVQWLDESLLTTFAYFTAEQENLASYAGINPDNGQYYYNGIDVDSKGFEIEMTGQLTDDLSVILGYTAIEIEDDQGADANTWAPRDYVNFSLNYTVPVVPSLTVGVSGRWQSETKNTDYNVTQDSYFLLNAYASYDITNDLSVRANLNNITDEKYLSSLHSSFFYAAPINGTVSVTYSF

SEQ ID NO: 16109 - protein, 288 aa, Flavobacteria bacterium BBFL7
MKKSIIALAVAGALTAPMVAQADATLYGSLRLSLTDQDGADLDLADNTSRIGIKGSSELFSGAKAIYQFEQAVRADDATGWNGGRLALIGVTGDFGTAQAGQMWTPHYLWTAAVTDILDNDASGADAGFTRVGNTLAYISPNMNGFQAAAAVIADAATGTEDIDTTHVAVKYSMDGLHVAASYLGNENANTDTTALAVSYAADNFYVGARVQDDEINHGAAGDEWSIAGSYSIENTKLLASFTDEDSAADESWSLEVQQKLGKQARVFAAYRELRGVEGVEVGYRVDF

SEQ ID NO: 16110 - protein, 623 aa, Flavobacteria bacterium BBFL7
MKLPVPLAVLLIGAPLAQVVAAPAVEELMVTGSYSPVSSEQLAASVTVINQQQLQQLGGNSLVNALRQIPSLWVEEQGGPGGISSINLRGAEANHTLVLLNGVQLNDPTNTRGGAFDLNGINIETIERIEIIRGAQSAIYGSDALAGVIHIITRAPAKRLTRINARLGEKGYESGGIAATGQAGSLGYSLSAQSRDAGEPVRGSTASNSEWNARLDWRNEAHQLDLALRYFDGERTSYPEQSGGPALAQSHALDTSEYTDKQASLAWRYAINNFWRSSLSAGWYEREENYDSPGILPYNAVPPNGADNQFTRTTVSWVNTLGDQQRYWANLGLESKKEKGESQGYLDFGFLMPADFSLSRRTDSAFINLNGYVLPGLLIQASSRYDDPDSAASNTSSQAGVRYRLNDQWSFFANAGEGYKLPSFSALGHPLVGNADLKPETSTSRELGVDWAYGAVSANLTWFEQEYRNLIDFDSDTFRNVNRERVDTAGAEASVNWQVNTQLNWRVQGSYTDIDMLSSDNNLLGRPQSTLGSSLHYQPNADWQFNLNYLHVDERFAVSLHDGQGQQQTLDSYNRLDASAYWQFNPHSRLGLNLENLADADYHTDIGFPAPGRLARVSLDIAF

SEQ ID NO: 16111 - protein, 381 aa, Flavobacteria bacterium BBFL7
MKLKVIVAATFVAWAAVAHAQSSVTLYGAIDTGLLYQSTNAPNFQSKLNLGHVYELKDSGILPSYWGLKGTEDIGGGYKVNFRLQGAFTSTNGKFGLGDTPGSATIFNQQATLGVSGPFGSIDAGRQITPMIYAMADTDVRNFRYFGSIFTAWLGLGQAAGWQGTSTNGPFGALYDSNAIVYQSPKFYGVSLALEYAPGGVPGQFQGGTRESAVLRYSNYGLNLSAVYYNGHDTNPFTTTPTGAVITAPSTGLDNNRFYYFGAMYTFHDLSVSTSYSIGKNPANSGQDDFEMISGGLGYQFTPFLKVTSGFYYLKDRNVSSNQSDLYAVGAEYSLSKSTLAYVQVGHVNNRGKMSQTITYGAPVPEGTSSTAAMIGIRHTF

SEQ ID NO: 16112 - protein, 380 aa, Flavobacteria bacterium BBFL7
MNLNKLTLALTLGGSLIATSVSAAGLGLSQIGTAESVATAGAANVTNNRDASAVVTNPAALSGITDSSTVIGVQYLDVKSEFEREAMGEGTTGTAGQFMPHLSYAKRLNDDWVAGIAMHSPGGLGMSYDNGVAGGPANIINENNIAIVNITASASYQLNDKLSLGASVIAQYADLQIDLFQGTEQANTIAGNNWTPSFALGAMYQLSDSTNLGLTYNYGGKHELALATHLPEPQSMDVNWPQSVDLGIEHQLTSDLTLMMSANWQQWSRYNDKYTDTWGAGMALSYQLNEWTLQSGLSFDSSPLDSADRDVVLPLDKQWRFGLGALKTLDSGSVLGIAYQYQSLGDGHIDGTTNGSLNPIQPQGFYSENRIHFITVSLSF

SEQ ID NO: 16113 - protein, 241 aa, Flavobacteria bacterium BBFL7
MKRISAGTVVLVAAISGAHAQSAGQWVVNAGWSHFAPQGSADPLTVNALGQSQVMTGSGGEIASGDTFGLTATYFLTDHIAATTVMGFPPTWHLNGAGTLSGFGELGTARAWSPAIIFNYYFGQPNARFRPYLGAGVTYTWFSNIKLSNPVSTGQIYFSPTVGTALEGPTSVSLSNSFAPVVNGGLTYNIDSHWSINASVAYSWVSTRATLTTRSSVGTVTSTSKFRVNPIVTFLSVGYRF

SEQ ID NO: 16114 - protein, 917 aa, Flavobacteria bacterium BBFL7
MNQIKAKPFSTCLLVLAWLLWGVFGTPLAKAPVLESATLTGYVRSLTGTPVAQARLTLLTARQTVAATTVSAADGRYLFDDVAPGTYELVASTSDGLGVRLAVSLAAGITTVRDLTVLPTPVAETVTVTADVGLVQDKDELGQTVTVIPVGRLQERATQGLSQAFAEEAGLSVQQTSASLGGVFVRGLVASRVSVFVDGVRYTTGAQRGGISTFFNLLEPSNLRGVEVLHGPHGAQYGSDSLGGSVQLLTATAPLTTGGFVFQGESTFFGISATAGFGHATRLAFGTPRFGGVVNLAGRRINTLRAGGGIDSRAAVTRFFDLPSNRFYGTRQPDTAFTEYAGSLKAVLTPRAGHQFVVHYQRGQQDGGQRSDQLLGGDGNLLAKLGNLMLDFGYLRYDGQRVGGLDSVTVTGSFNIQREERINQGGQGNPQALINAQYERTRAVGLSLFGAKMLPGRHTVLGGADAYRDVMRARAFDAHPVTGIATAARPRVPNGAYFNNYGFFVQDVWEAVPNRLRLAASLRYGVASYRPRARDNALVGGRAVVEDDSVRTAAWTFRFSGAWQLGRGWVLAGNVARGFRPPNMTDLGSLGLQGNGVFEVAAPAVAGRQAFIGTTADASAVSTGLPVRQVIPESSMSYEGSLRYRNGRMDADLTGFVTNINDLLTTRTLILPPGAVGTRLGTEIITAQLPTGAVFVAPATSPVRVRANFTKARIYGVESSLGIKLTASWSLGGNFTWLHAEDRATRRPPDVEGGTPPPQGLLRLRYQPPGRAWWVEGVVAAAHRQTRLSSLNLDDRRIGATRTRTQIQNFFRRGATVRGFVEPGPDGRLGTADDRLRLTGETLAQIQARVLGTAASAPLFPVLPGWATLNLRGGYRFGERHHLLVALDNMLDQNYRTISSGIDAPGRNLTVRYTIRF

SEQ ID NO: 16115 - protein, 739 aa, Flavobacteria bacterium BBFL7
MKMKKQCATLTFFIGLHGYTIAEDNPKNISLSVITVPGHHERQPDRSIITQNEIDQKQSDNVADLVNTVPGVSMAGGFRPSGQTLNIRGMGDTEDIRVQVDGATKNFEKYQQGSLFIEPELLRRVSIDKGNHYPQYGNGGFAGTIKLETKNAKDFLQENQLLGGLLKYGYNTNNNQRTFSGAIFMQNDQKNIDALVYATVRRAHDYKRADKTPIKYSANNQANFLAKVNWWLTPSQLLAFSKVHGNHNGWEPFAAKRDLLPGPTEAEITKYGLDLAWKRKLVAREQQDRSYSLQYQFLPENNPWINTVAQLSHSSTYQHDTRSEQASKTYLASLGNESWTRYTDLTFDVNNTSLFNVAKTSHTLLVGLQWVKHKRQTLIFDPSKLQKAEYNHGYFQPSYMPSGHQYTHAFYAQDKIKIHNLTVSIGARYDYVKNIGKPNIATIYNDPTAGHDYSSKHYPGWSSYLGLNYKLTPYLNLFSNISNTWRAPVIDEQYETQYAKATLSPTASSLDLKKERITQLRVGKQIHFDHILSNNDQLSFNSTFFYYKGKDEIFKTRGVRCFESAQNNNNEVCSKKIGNYRNLPGYQIKGFELEANYDSTYWFTNLSYSHTIGKRLASPRNPWLASTSWIAEIPPRKAVVTLGSHIPDTNLTLGWKSEFVRRQDRSPTDQDKDAGHWALPKSSGYALHGIFATWQPKQIKHLRIQFTVDNLLNRSYRPYLSELAAGTGRNIKLSISKQF

SEQ ID NO: 16116 - protein, 483 aa, Flavobacteria bacterium BBFL7
MKKLLLLSAILSSGLYAASIDHVQTYTPDYLANQAQTGMINGASAYYNPAGLGRLEQGKYFHVGFQFAHGHEKMSYGKKKHKAKLNQAIPNVSLTFVDEKGATFFNFGAIAGGGDLEYDGVSGVDVLTDLAQFKPLGIYDKGSTLKGSNKYEQITLGRSFNVDSNLSFSIAGRLVHGTRKLNGNLNIGANPTAQYKQAKAQQVAQEVSKAVDAATQGKGLSAAQIAAIKAQKTNEALTKLQQKVNGLNQNGLTGDIDSKREAWGYGFQLGVNYKVNDKLNLAARYDSRVKMNFKAKGHEYQLQTTDILGQTIGLSTFYPQYTINSKIRRDLPAILSVGASYKVTDSYLVSASGNFYFNRQAKMDRVKAFRGHQHGGDYKNGWEIALGNEYKLNEKFTLIGSINYADTGAKTASFNDTEYALNSVTLGGGIRYQYDDSLSITASVAHFIYQGADGNFKEKYGVAENQKYKKEITALGLSITKKF

SEQ ID NO: 16117 - protein, 1030 aa, Flavobacteria bacterium BBFL7
MFSEEGTTANTYTGPTTVNSGAVLILDRFTTDFSGNEIGFITVPGDLDITANGVVLTSAINQFASTSNVHVESTGSTLNGVALPGLELANNSQTISALTGAGTVELGTATLTITVGSTFDGVISDGSFGTGGNLTFNAPTTAANSTLILNGQSTYTGVTTIANGEIQLGTANALPTVTGLVVSAATDLTHPGGIIDLAGHNQKVGAIFGGGQIQLNGGATLTTGGVDFNQVSNFSGVISGDGGLVKVGPQTLQLRGANTYTGPTTVNGGTLDIFGSGVSATTVNTGAFLDLESGGSINTTATPGQTAVTLGRAASFSTVGTVQASGAGSIGVLMTEASAGLANFSGGVITANTGIKVTNPGGIDSIINAGILTGTGGVAVDARTSAGVSFLNAGTVNGSVLLGNGNNTVTLVTNSSNPSAIVGGSGTDILRLVGGDSNSLNLSTLTGLDELDKLGGGLWTLTGTGSFPNGTTINSGTINLVGNLVSNTLIQSDGLLAGTGTVTGNLTNFGVVSPGLAIGIVFPDSTVGTLTVRGNYTQASGGALLIQSGGVNNTDRLAISGRAQLDGTLAVEKVGKGLRLKLGQQVAFLTAGGGVNGKFANIILPAPVPSDTIIVPEVVYEENQVVLEGTRGSFVAVDNTVRLTYNEKQAAGALDSADDNRANRKLINFLETKRLADLPEQLDRIAPEEIASVYRIGVSLANVQTNNVQRRTADLRAGATGFSATDFQVNGGGNNTGGLMGANGPGGVEGKTVNPQAPDEHLGAFIKGIGDFAHVGDTGNARGYDMNTGGVTVGADYRLSNRLAVGVTAGYTGTVADLTGSGRVFVNGGKTGVYGTYFDKGFYADAAVTAGVNNYATKRDSVQGDAFGHTQGSEVDILVDTGYDWRLDGLTIGPTASFQYTYLGMDGFTEHGSLAPLTYLDQHQSSIRSSFGMHASYDWKVGAVIVRPELMLSWQHEYGDRSYSIDSRLAGGSSVFSVADSQIGRDSLLLGAGVSVLWNPRTSTFLYYDADLLQKEYNSQSVSGGLRMNF

SEQ ID NO: 16118 - protein, 711 aa, Flavobacteria bacterium BBFL7
MKHLPLLASLLGCLSINAWGQPSLELAPTTIGADEADAEPGLNLDQSSGMASRLGLSLRETPASVAVASRQDLERSGARTFQEAANALPGVNASAPPGFGGFVSYRGFTSSQITQMFNGINIATGLARPVDAWIYDRVELVGGPSSLINGAGSVGGSLNYVTKLADRREQAAEGLLGYGSYDTTQTAFGVNHALSPAGAEVQHYARLDVSHNTSNGYIDRQEREAWSLAFSLLSDLTPDLSHTLAVEYQDEHEDSPYWGTPVLNPKAGELKIDKHNRFNNYNVADGLYEQRTVWLRSIIDYRINPSTSLRNTLYHLDSQRDYRNLETYQYNADNSRVNRSTAYLVRHQGQQDGNQFELRHDDQLFGLDTTWSGGFEYKVNSTTNSPWNVPASNSVDPGNFQPGYFYDLKGTRQGWAKDKTNQVTTRALFVENRLALTDELSLLSGLRYDAIDLDVTNHRLITASNPRHLKRSWEPVTGRLGLTWQFLPSANVYVQYSTAAEQPSGTQNFEVSTGKQWEVGSKFDYLQGRGSATVAAYRIERKDFAVTDPLDPANSIPVGQQTSRGIELASSLHITPKLLAQANFAWVDAEYGEFNEKIASGAVVSRKGNTPTNVPDRLANLWLTYDLSPNWQTGVDARYVASVYADNANTLRMPAYTLYGSFLRYKVDSHTTVTGRVRNLTNEVYGQFAHVSPAYYLGQPRTFEVAVQTRF

SEQ ID NO: 16119 - protein, 226 aa, Flavobacteria bacterium BBFL7
MNKQGTFVAVATSILAMAAAGSASAAESGKFQIKAFATKVAVDGAITKVKVDQLRLPAGADTRAKDAWVPTVAAEYFFSPRVSVETICCVTQHDVRGSGPLNGAALVDNAEVIPATVTVKYHFPLSSGVKPYVGAGPAYFMVFGEKVGASARALGATKVGLSSELGAALQAGVDIPLPGKAVGLSIDVKRYFVDTTAQFRAGDRVVLETKHKLDPWVASAGVAWRF

SEQ ID NO: 16120 - protein, 355 aa, Flavobacteria bacterium BBFL7
MKKIIISLTLLAVSGFATAQSSVTLFGIADATFQRGSGSSASATQIGSGGNSSSRIGFRGVEDLGGGLSASFWLEAAFSLDNGTGGTTNTNNQTTGTTGGGGLTFGRRSTVSLSSGWGEVRLGRDYSVQYYNRFEFDPFGNNGVGSSQTNVGSLGGPVSSRVSNAIMYFLPADLGGFYGELQHYRGENASNAGTTADDGTGSGARMGYRAGPLNVAIAHARTQYARTATTGDIASSNIAARYEFGDFTAMGGYYRDQVGTIAGLTGRGAQIGGIYRIGSGDIKAQWSNYKTTAAGNPETKKLSLGYVHNLSKRTAIYGTYARVRNSGGATTALNGSVTAANQSSSGFDLGIRHSF

SEQ ID NO: 16121 - protein, 892 aa, Flavobacteria bacterium BBFL7
MKLIPIRLFHCVLCFTLLVFFLETNALYAEGKLEVTIQIVKSNTGKPVPNAVVISKKGKTSGISNAEGITKLTFPEPGYYEIKVSTADKTESLFREVRFKGQVILVSIAESNLSGILVSGERDKTPLSRYGLVQDEIKRLPGVSGDSLKALQTVPGVVIGAPVGILPSVFTNIGTNLITGNPYSNSERGDLSLRGGGTRQNQYYFDGFPLPYPFHLGNQSSVLNNNLIKSFDVYTGAFPAKYGYATGGIIAIEGTDRVDENKTIINVNLFLSDIYNQSKVLPGLAMISSGRKNYPNLVLLQAYPQGIPEDAKYAEYHDYQWKLIWDINPDHRVTVQTFGTRDRQAYTKAQADLERGGQDPRPPTGLDRMFRTDAARYIWKGKSFRNTLSYSRTWFDEFFELRFTNPLTAENIFGLQNRTSDTITYVQNAFEWELWEEHLKFEVGVQGRFRETTLKGENISSYNRLFYNIFNDLLNSNSAFRSVIDGDRIRYREKSAYTEFQFKYGGIRLTPGARVDHYSGSNESNLAPRITAGYVFESTKTSIMAGHGIHYNAPVSVEALSKKSGNPNLFMERSEHNSLGISQDFANHWQIKIEGFHNIFQNIIVPDSYIVDPYALNNDTRIFVNETAKVLANPIKAKNLNYSNAGYGYSEGVEIFLKKTKDPREQSGLFGWISYTNSITKRINNQSRLSSEESRNRTLQNNTRTLLAQTKLGTNYLNYYDDNNLELIYNNDKEELYDLDRTHILNIVFGYKFNSEWMVGGRFRYFSGTPYTPITGATRANQAATFGLNLYFPNYSGNYNSDRFLPFHQFDLRIDRIENYSWGYINTYIEFVNFYGRRNQAGFEFDNTRNFQRNLNPSPTYDTVNSPFIISQTPNGKMAIIPLINIGMEVRF

SEQ ID NO: 16122 - protein, 728 aa, Flavobacteria bacterium BBFL7
MKTLFKKDCRKGTKAQIYLGLFSVFFSLFSFSQETQKDSTKITELKEVTVTSVRAKDKNPITFTNISAAEIAPRNLGQDIPVLLQYLPSVVSTTDAGNGVGYTYMRVRGSDGSRINVTLNGIPFNDSESQGTFFVNLPDFASSLESVQLQRGVGTSTNGAGAFGASLNMQTKSFNEKAYAEVSNSVGSFATRKHTIAFGTGLHNNFEMNARISNIASDGFIDRASSNMFGYFFNANYVKETTLIKLLAFGGKEKTYQAWYGIEDPEKLKNDRTFNPAGMYFDENGNMQFYDNETDNYWQNHFQLHWSEKWSEKWISNAALHYTIGKGYFEQYKEDEDLTDYNLPDFNGNSISDLVRKRWLDNDFFGATFSLNYKNAKTDFLIGGAANRYLGLHYGEVVWTQNYIPNPNRYYDNYGNKDDVNFYTKASYNVTNKLNLFTDLQYRMVFYDATSIKFSDVNDTFRFFNPKAGVNYQLDTKNSFYGYFGIANKEPRRDDYENGAIKPERLFDYELGWKYNSRKVKLSANAFYMRYNDQLVLTGALNDVGSPVFTNSGKSYRVGLEVESTIAITEKLFLNPNVTISQNQNQDFYFQRDGVLQNLGNTAIAFSPNLILANRLTFLPIKNFQVSILSKFVGAQYMGNIDSENSKLDAYFVNDLNLNYEWKLNKTIKSIVFSGLINNILDLEYESNGYFYTYDDDWSNPGTINTIEGTGYFPQAGINFILGLSLKF

SEQ ID NO: 16123 - protein, 547 aa, Flavobacteria bacterium BBFL7
MNKLIRRAVTIFAVTSVASLFASGVLETSMAESLSTNVISLADTKAKDNTSHKSKKARKNHSKETPVDRKEVAPVHESKATGPKQDSCFGRMYTVKVNDDRNVEITQAVPEYATVGSPYPIEITATGKRDCVDVIITQQLPCEAEFVRSDPATTPTADGKLVWKIDRLGQGEKSKITVWVKPLKEGCCFTAATVCACPEIRSVTKCGQPAICVKQEGPENACLRCPVVYKINVVNQGTATARNVVVENPVPDGYAHSSGQRVLTFTLGDMQPGEHRTITVEFCPLKRGRATNIATVSYCGGHKNTASVTTVINEPCVQVSIAGADWSYVCKPVEYVISVSNPGDLVLRDVVVEDTLSPGVTVLEAAGAQISCNKVVWTVKELNPGESLQYKVLVRAQTPGQFTNNVVVKSCSDCGTCTSCAEATTYWKGVAATHMCVVDTCDPVCVGENTVYRICVTNRGSAEDTNVSLMLKFSKELQPVSFSGPTKGTITGNTVVFDSLPRLGSKETVEFSVTLKAVSAGDARGEAILSSDTLTVPVSDTENTHIY

SEQ ID NO: 16124 - protein, 1057 aa, Flavobacteria bacterium BBFL7
MNKLTYLLLCLVLGIGLATAQTRKVTGTVISAEDSEPIIGASVIVKGTTTGTVTDFDGVFSLDVPSSAKTLVISYVGMIAREVPVQDVLRVVLQSGTQNLEEVVVTAIGMKKQEKALGYAASTVKSEDLNAAKSGSVMSGLTGKVAGLNITSGGATGSSQKVIVRGISSFSANQPLYVVDGVPIMNDFQGEDSFSNSVDFGNQANDINPEDVESVTVLKGASATALYGSRAANGVIMVTTKRAGAERLSVTYDGSFMGSSVLRVPQTQDRFGQGWGSFGPMENGSWGPVLDGRDHIWGPYSDGSEGLLTPLSKPFSYVKNNLRDFYETGFETNNNVSIRMGNDKLGFVASYGNVKSDGVLPGDADSYARNTISLRGNMKYKRFSAELNLNYVRKDITQAAAGQGDDGATMFSEILQHAVDVDISSMKDYTNPYFNTDNFYTAYAENPYWVLDHNRNKYQDDRVYGKIELAFEIMKGLKAVGRLGGDFTNATQKRWNEKVTFASGSWSELGGKKQQPGTYTERRDKVEQIDATAFLNADYKIGEDIALNGMIGWNLNQQTSSYLKSYLYGLEQPGWFNLANGVDKPMTTTYSDRRRLVGLFAQGEFGYKNFWFVNASIRNDWSSTLPQGNNSFFYGGVNTSLIITDMFEDLKSDYLNFLKVRAAWGQTGNDAPIYRTSSYFTPTQISLGFGDLYLPINNTLGLTEYNRLPSMDLRPEITTEWEFGLTTHLFNNRLDIDAAYYNKSTKDQIISASLAPESRYTSMTRNVGKIANQGVELAVNGIPVRTKDFEWGLGFTFSKNWSEVKELWDDVTEYKLTSSYQVDFVAEVGQPLGVFKVPALATTDDGKVIVDNNGMPTIDASKKEIVGTSTPNFLMGFNTHFTWKGITLSAVLDWRNGGEFYSYTSQLLTFAGNSTYTVFNNREPFVVPNSVKVVNGQYVENDIPIVHWGGASSAVNTYYNNASNYAQYRNWILPKDYLKLREITLSYSLPKAWLKQTPFSMVQVSLIGRNLFMWTPKKNNYVDPEGTNYGNDILSEIGEFGAAPTNRTFGGGIKVVL

SEQ ID NO: 16125 - protein, 955 aa, Flavobacteria bacterium BBFL7
MQEAECQLPKITHCIAIAVSAALASMVFPSQAAWVDVDSLPSSGLVSQLPPELQAIIPAQASTGFTKVGTMPNYVYQWNTGTIPVYGNGLTLNGPGAEAFEHTVTVIQNSGTGSPGVIFGNDLTIRTQSANAANNGRDVDGIRTHGANTPDNPVFIITGDRTRIYVDGQDGDGINAGYNSLGQGWTGSANIYVGDDLYIKTTGSQGRGITANAMRDASRAKNTIVVGNRAHIVTTGDSSEGLRTGQSGSLIRLGDDATIETSGASSTGIYAASSSRTELGNNATITVNGASAHAVYATNATVNLGENATISVNSASKAASYSKAPAGLYALSRGAINLAGGAAITMAGDNSSESYAISTETGGIVDGSSGGRFVIDGDIRAAGATAASGTLPQQNSTIKLNMTDNSRWDGASYITSATAGTGVISVQMSDATWNMTSSSTLTDLTLNSGATINFSHEDGEPWQTLTINEDYVGNGGKLVFNTVLNDDDSETDRLQVLGNTSGNTFVAVNNIGGAGAQTIEGIEIVNVAGNSNGTFEKASRIVAGAYDYNVVQKGKNWYLTSYIEPDEPIIPDPVDPVIPDPVDPDPVDPVIPDPVIPDPVDPDPVDPEPVDPVIPDPVIPDIGQSDTPPITEHQFRPEVGSYLANNYAANTLFMTRLHDRLGETQYTDMLTGEKKVTSLWMRNVGAHTRFNDGSGQLKTRINSYVLQLGGDLAQWSTDGLDRWHIGAMAGYANSQNRTQSSVSDYHSRGQVTGYSVGLYGTWYANNIDRSGAYVDTWMLYNWFDNKDMGQDQAAEKYKSKGITASVEAGYSFRLGESAHQSYWLQPKAQVVWMGVQADDNREANGTLVKDDTAGNLLTRMGVKAYINGHNAIDNDKSREFQPFVEANWIHNTQPASVKMNDVSSDMRGTKNIGELKVGIEGQITPRLNVWGNVAQQVGDTGYSDTRGMLGMKYSF

SEQ ID NO: 16126 - protein, 1165 aa, Escherichia coli O1:K1 / APEC
MNKNIRILQFLVSIIYSVQSHFSGAQTIQLNGNGIPKSITRSITGVDGNAALNISVPYKTSYTQNILSVESSINIKGGTSNTSIGGAGVYGENFTLNNNGSVWGGDGYNGGIAVSGNKISINNYRNVYGGNGLGGSGSSGGAGLSGDDIIVDNYRSIYGGDDVGGTGGSGVTGSNITVHNSGGILGGNGVNGGDGINGSNLFITNDNMISGGYGIKQGGDAISGNQITLNNNGIVQGGYGPDGGCSVYGEDIHINNHGNLSGLYNSQKDAYNTSIIFSGGYNSLDIYSDSVINGDIKLASIPVNGTNELIIKNINNATAINGGLMIGNGSSVYLSGKNSIFNGNISIDEDASMNLSVGNANVHANTITLKSDSWLNIDTSIKNWTQDYYTLLSSDTGISIADNSHIVQYNVLLTEGAESYVYTSLNDDDNKLISMLRWNNTKGMGYGTFNIEKDATLNIGVSLSDNLSPLLYDGWDGKSLTKSGNGTLILSATNNYTGNTEVKSGVLILAAPDALGRTEYLYLSRGAELDMNGYPQTISKLLTAAGSVLNIHGGSLILNNGGESAGTIAGDGSLNINGGMLDITGNNRNFSGVFTVNKGAHLAVSTADNLGTAFVDNYGTLTLNSTSAWQLTNNISGYGNVRKTGAGALNISDNAKWTGMTDIIQGTVILGNADSPVMLGSNQVIVEEQGKLSGFGGVAGNLSNSGIVDLTTYMPGNILTVGGNYTGRNGLILLQTETGGDNSKTDRLVIKGNASGRTRVAVTQAGGTGAETLNGIEVIHVSGNADNAEFIQTERITAGAYDYILKRGQGINSTNWYLISRKDIPVPQPEAVPENHDNNLRPEAGSYVASIAAANNLFVTNLYERQGQELYISHMTGEENEAGIWMYNKGKHNRWRDNSSQLRTRGNSYVVLIGGDIAQWSLNGTDRWHTGMMAGYGHNNNSTNALSTGYHSEGRMNGYTAGLYATWYANDETHNGSYLDSWLQYSWFDNHINGERLPAESWKSKGFTVSLEAGYSWKAGEFTDNYKGSHEWYVQPQLQVVRMNVKSDKYHESNGTSIENTGNGNILTRLGARTWLTSKNGKNTRYAVPFRPFVEAHWLHNSRVFGTSMNGVSIYQDGARDIGEINGGVVGMITPEVAFRADAGIQLGEHGYHNTSAMLSVEYRF

SEQ ID NO: 16127 - protein, 402 aa, Vibrio mimicus
MNKTLIAGAILASLVAPTVSAIEIYKDDKNAVSIGGFIDARAIHTQDTTEVVNGASRINFGFERALSHDWKAFALLEWGINPFGSSEIVYNNKFETVQDEFFYNRLGYAGLSHDTWGTLTIGKQWGAWYDVVYGTNYGFVWDGNAAGVYTYNKDDGAVNGTGRGDKVIQYRNSVGDFSYAIQAQLKNSTFFTCDFDDITQDDCQALWQQGKREAQQVEYNYTYGGAVTWKATDKLALAVGVNRGEFDVTYGNGDQITAVDLIYGVGATWGDFDTDGFYASLNYNYNENHDTDNIGRLIKEAFGIESLFSYKFENGFRAFVSYNLLDAGNDYVIQPNFNADPNDVFKRQFVVAGLHYVWDKDTVLYVEGRKDFSDFSSADVEQEARMALSEDDGIAIGIRYTL

SEQ ID NO: 16128 - protein, 146 aa, Vibrio mimicus
ADEHVRKLDLGFVWDPHLTWWEIGGWHFALLGEAHAAWWHTDEGNVHQNIGEFGVTPVIRFIKGSGAFRPFVEAGVGVRVLTSPRISSTFSLGSAFQFADMVGAGAQFGDHQQYQLGYRFQHVSNGGIKEPNPGINFHQIYVQYNF

SEQ ID NO: 16129 - protein, 111 aa, Anaplasma ovis
GLLGNSPANVPFNTASLWTTYELQQGDLQGLGFGFGLFYVGDRQGDFNNTYIIPGYLRTDAAIYYQRDNWRAGVNIQNLFNEKYFQGANFGRVAIEPGAPLTVIGSFSVTF

SEQ ID NO: 16130 - protein, 816 aa, Jannaschia sp.
MRRTTILLSATTALVTMAGPAAPSRAHAQSVSDTTATPTPPAPSTVMRKVARTASASPATDGDKDEQVIVTGTRDPHQTARSSVSPIQVVTAAQLAATGQADVRDALIQLAPSVARSIRVNGSANMTDAISLRGLTPNQTLVLVNGKRRHTTAVLSNNAGPQQGATPVDIDMIPVSAVDHIEILQDGAAAQYGSDAIAGVVNIILKHDTHGLEAQSLNGGRYAGDGFTSGESLNWGTSLSGRGFFDLNAEYKYQDHTFRATPDSRTGRNDFMDIGDPRQQRETIGYNMEYAITDDVKLYSFATYGHRNGESYQDYRVPTASLPMYPYGFSPQETLDENDYSVTVGFKGRKFNWDWDLSTTYGGDSERMGLFDSINTAMLQNFGSSPTRFHLMSFSNTQWTTDAGVRRAFDVPLLAAPLNLALGAQYRYDSYHIGAGDMGSYYGTGASAFHGLSPDNASDSNRDVTAGYIDVSTQLLPKWQVDLAGRFEHYTDAGDTETGKVSSRYDVNRYFGLRGTVASGFRAPTLAEEHWSNMSVAATTATGYIPVDSAGARLLGAKPLKPERSTSFSAGFVVNPIDNLHVTVDAYQIDLRDRIMAAGVYNGASAIEALALNGFAIPAGVTANAVTAQYYANAASTRTRGLDITANYLTRLGRYGRINWDVAANFNQTTIRHVAEDGNGNSLLNAQQEAYLTSYTPRNRVIFGGVWHYGDLDFTVHEIRYGHATSQLEYYTGPLAYSNTQFMRFLNPPRYETNLVIGYQVSPRWHVALGANNVGNARQKKIPEQFRYLGAYAYDVNIEQIGYNGGFYYFQVNFKL

SEQ ID NO: 16131 - protein, 910 aa, Jannaschia sp.
MTRFTKAAVLGATALAAGLVAAPAMAQQPDVITVTAQKREQTLQETPVSVAVVTDTAIQQSQIRDAADLQTLVPSLRVAEFAASTNTEFNLRGIGTSSFNPGLEPSVGVFVDGVYRPRAGAAINDLLSIERVEVIRGPQSTLFGRNTPAGVVSFITKEPEFEFGGDAELTAGSYGQFVAKATVTGPIIEDVLAFRLDATTHTNDGYLDNVAPNAQREQLNDRNRQSYRGQLLWYPTDNTEVRVIADLGVIDENCCAAPFAFYDPIDQGALIALGGTALPADPHDGQIAVDGNVNTQLDTAGLSAQIDHEFDGFTFTSITAYRTYDESQNIDADFSDIDLLGARNIDNEYNSFTQEFRFTSNGGQFIDWMFGGFYYKNELEFNQRLVYGADTKAFFDLASAGQVADLVAAFGLPAGTGGVTLTEFLVGANNQLGVNSVPLLPAGGYLQEGDALQRENYQYDTTSWSAFAQFDINFTDRLTLTLGGRYTEEDKDMETAININDPISALSFTSLGANLRLPEASLCPGFPDGNTCPFLLTTVLAQQAAGDAQLAAQLEGALQASGIPGATLGNPLIVYDPTVAAFLANTPFNLLNGFTAFQNFTPVDASQYPTSRSDDNFSYSAILSYDVTDTFNVYASYSTGFKPGGFNLSYEAAETGIFEFEEEDASSWEIGAKGTLLDGSLVYAITYFNQEIENFQSENFVGNGFALDNAGSIEVSGIEFDFSYAPTDRLFFTLGGSYLIDNKYGEYLYGPCPDSSPLFGPVYDPADPKFSACSTPRTNARGVTGTFNDLSGVDRGSSELVASTTGTYTHPINDRLDLILRGEAQYTSEFNLVTSLDPRPVAIQDDFTLYNASITLSASDESWALQFWGRNITDEEYVKGGFPSVGYLGASFNNYPGDPRTYGVTLRARF

SEQ ID NO: 16132 - protein, 726 aa, Jannaschia sp.
MSYRDLRGVLPSRPSHLALVVAAVCASGAVCAQTATGNAVPATELREVVVSASGFEQDIKEAPASITVIPREELAKGRFGSLTDALESVEGIDVGAPAGKTGGLNISIRGMPSDYTLVLIDGRRQNSAGNVTPNGFGETQTSFMPPIGAIERIEVIRGPMSTLYGSDAMGGVINIITRKVGKTWTGSVSADYTLQEESEFGDIKSGKFYLSGPIKEDLLGLSIRGSTQRRAASDITYAGANGQPAVAIMGANPVKSEINNLGLRLALTPNRYHDITLDLDSGRQTYDNSRGQLGTLGLQGGYGPEQKYNRDQLTLAHTGRFGFGTWDTSFMVNRTETMGRTIPPGTPGATPGAARTLEVESKVLDSKLVLPWGAHLTTLGGQWWDAEMKDGVAPNKFAFTQKALFAEDEWSLTDAFKLTLGARYDRHSLFGGKLSPRIYGVWNAAPQWTVKGGISNGYKTPRVEQLAPGINGFGQQGRLPLVGSPNLKPETSRTTELGVYFDSPTGFAGSATVFNNEFKDKITSGPGLINCDFAAAPNRPGCVSFGNWPLVDAFGQSINVDEAVTRGLELSARMPLGRGWNASANYTFTKSEQKSGPNRGNPLSDTPKHALNARLNWEPGAQWNLWLRAEYRSERFRDPGTSASTQAAKAALGNYKPYTQFHLGGSYRVSKQFTINAAIYNLFNKGFVDYQPYNVPGQVQGALLFGNRYANSQEGRRLWVSANYEF

SEQ ID NO: 16133 - protein, 1071 aa, Jannaschia sp.
MKTMFKVKVCLLMLLCSVAAAMANPPVPVEKVKGTIKTPNGEPVIGATIIEKGTTNGTITDVNGNFVLKIMNKIGELEAACVGFKKVVFKPEKEIVSLIMEEDTKVLGEVVVTALGITREAKSLGYSVQKLGGDGVVQAHESNFVNALSNRIAGVQITNSSGGIGASSSIQIRGQNFVGGYNYNNSPLFVVDGVPISNNNEQSTRSFTGRQDYNNPNFTSGEAEVDYGNAAGEINQEDIESVSILKGPNASALYGARAANGVILITTKSGKGQKGLGVTYSSTVSFETALRLPEFQNSFGQGLEGKYAYVDGAGGGVNDKDVANWGPAMNGQLITQFDSPLDDNGNRIAIPFVSGGNQLEDFLQTGHNISNTITLSNSNDKLNYRLTYTNNQQKGIVPNTGLAKNTIGLSAGYQIIPQLRADVTMNYVHTNSDNRASTGAKNADNIMAIFLKMPRNVSLNSLQQQWRDGKENVAQNTPIGDETSTGINNPYFVVYNNLNGNTRDRVYGNLRLKYDILKGLSLQIRSGLDVYSDKRTMRHAVTSQSFFNGYYQEDDVSFMEINNDFLLSYRLPDEAVRNFGFSISAGGNMMNQISKRLGAIAPELTIPGVYNLTNNAKPILAGNSLTQKKVNSLYVTAQFSYLNGLFLDLTGRNDWSSALPKKNNSYFYPSASLSAVLTDLFDIRSNILTFAKVRTSTSMVRRDLEPYQTASNFIISQGWGGNSTATANNNYPNPDIKPEKVVSYEFGGDFRFFNSRVGIDVAYYKSITTDLIIPITLNPSAGYDTKLMNVGKMTNQGIELMVNVVPVRTKDLEWSLNFNFSKNKNKVVALAEDKGISRIRQIERWASLELRTENTKGDGSYGSLYGDYLVYKDGQLQLKNGLPVEENGDWGYLGNVNPDWTGGLGTDFKYKNWTFSALFGFQHGGSVYSRTYIEGMRNGSLKESLAWRDADGAGMIVADGIDVETGQKNTVAVPVRNYVQAYYDNDMIATFDASYVKLRELKIGYTLPKKWLKNTPLKNVSVSAFGRNLFIWTDVPNIDPEVASYDGQLKGIETMSLPSTRSFGFNLNVTL

SEQ ID NO: 16134 - protein, 978 aa, Jannaschia sp.
MMRNTLYLSIILALSPCSVPLAFAAGADGLEARVSTPIAAQPLARALEQLSRGSGVQFLYSAGGDARMAGAVPRGATVRQALDALLAGTGLGYTVVDGNVIAIDPAPARNQPKPAAPKPREAEAMVAPTLDTVKVIAAHEVIDQKKSSPVIKDSVVYDEMDSYGDETLAESLMAAPGLSAVEDAGEPRYVTVRGVQANLNYTTIDGIAIASVGGSGSGERMNNLQLIPSDIGTRTDIYKSFSAEQAPDAIGGVIDIISRSAFDRSGKYVFADVAGIYSTAETNVERSAGGNHETLGHFGKSAKMVFSNQFGVDQEFGIVAVARYEQRSRNSVKRWVESNYYYNDAGKYLTDGTTGPDQAKGWNGLRAPGNFSTGTYTNFITNFGGSAKLEWKPSDDPFYASLLLYSYRFYENSTMNKTDLYGNAKFPVRNQTEDSGTTQINSIYIKNRHDRWDRSNRGAIASFNWDMGDRSRLTLRGGHTEETFHNSQVYWGVRAYPSNLFVDYENDSHGFPNAVAVSDSSLLTSSAFKLNPAQAYVSPRDAKESIDNLRADFSYNIDADARGFGLAAGAEYRHLKIWQDIDFDYFKSSATLNDYLYPGSTLLGSVPGFPLIDNRKWNEQLLPKLGNNNAAYPNANFTSDYKYVEDITNAYVSAHYAWDRLLLIGGLRYDHTRFDAYSPFSDDGGTTYTSAFRNTSGGYNNLLPSLNATFKLTEDQRLRFSASRTLGRPTPSNIAQATSTSCGDDEEGRGFCSIKQGNADLQPRRSTNIDLAWDLYFNGNNGLVSVALFDKVIKDDIYTLTTFEDVGDTRYRVTQPMNTDESKLRGVEFAVANRNLQWGRQRFDMYFNATRLEGQTNYRISDGTERRLDRLLYQPDWSLNGSVIWRMPWKSAQLRLSGTYRSRMLVDFGDTRWLDSYYDPYMTFNMGFSHKVSKHVTLKYEAKNLFNTQPTYSTGPNGRFRTEIDDYGRFFYFHIIYN

SEQ ID NO: 16135 - protein, 240 aa, Jannaschia sp.
MKKVLALTALAVASTSAFAGSSYVTGNVQFHDTYLQGSKATSTLEAGHTFDSNTTLLVEFDAIPLGKTQTPAPGTKGPLPATTLGVEQVFNATDHLWFAAGYHHLIQDGETIQYRPLIKIGYNFDNGLSLSNRTRVHINNQLDGQARKSDTDVRLDNKIAYQFADQPIALSYNNVYVVAGDKDANGDDKVNTMDHELRATWTRDGVQPYFEFRSQAHGLKNADGSSAVNNAVVFGASYGF

SEQ ID NO: 16136 - protein, 938 aa, Jannaschia sp.
MNRFLLIGLLMLKGICTTVAAPLLSVVTGTVQDASTGEAVIGAAVILQNTTYGAVADADGRFVINNVKPGTYTIEVQMLSYQRVVIEGCQIKPGENTLPLISLQPSAEEIDEVVVTTVRRLSSEAAVMQAVRNSKMVVSGVSKQMIARTQDRDAGEVVRRIPGISIIDDKFIVARGLSQRYNNVWVNDAAIPSSEADSRAFSFDLIPAGQIENIMILKSPVPEIPADFTGGFVKINTKDTPGELPFALSYSIGFNTATFGHDFLYNPGSGSDWFGCDNGKRGVRGGITGAFDNDDPDFVTDMTRHGFNNDWSIKTRKPIPDQRFSFSYGHSFRLGNGADLALNGALNYSYATRTFSNMENSRYGVYNKVEDKPEYYYKYTDDQYQTNVKVGALLNLAYLNGKNRYYFRNIFNQIGQDKLTLREGWQNMSSLYIQEKTEYCYTSRSTYSGQIAGVHTLELGTLDWDAGYSYADKNQPDRRIVNRQENDMVGDAHYGQMQIDQNEIRRDFMKLREHIASAGINYSCTLREGSSFAPELKVGLYGEYRTRDYRTRAYFYRFDTDNLPADFAYGDVIDDILQDGNYGADKLYIYDDSDNRNSYKGDNILTAAYAGIDLPFGRWNVYAGVRFEYSRMALTSYTKIKDWDSETRNYTHADPFPSVNVTYRINDKHLLRAAYGMSTNRPEFREVSPSVYYDFDLFSDVKGNADLKAAYIQNADLRWEWYPAAGEGISVAVFYKHFRNPIETAILDAGSGSYTYTFENADRANLYGVELDVKKNLDFMGMRNFSVVLNGSLMKSRVDFDDESLEHDRPLQGQSPYLVNAGLFYQSPKLGLTVGVLYNRIGKRIVGIGRSDMSVGGSIDNDIPDMYEMPRNALDVVVSKSFGKHWELKFNAKDLLNEKVQFAQFPKFENGGDVVSRKQITKQFTAGRMFSLSVTAKF

SEQ ID NO: 16137 - protein, 1064 aa, Jannaschia sp.
MKHISIWILLLFSSTIFSQIKITGTITDKNTGDIIPYVSISSSKTNGTNSELNGDYSLIISKENQFLTFTYLGYKTQKVRIGNKNTINIQLVEQETSLNEIVVTALGIRRQTKELGYVVQELKSEELTEVKTPNFLDNLSGKLAGVTISQGATGVGSSSKITIRGEASFSNNNPLFIVDGTPINNNTAFNFTNEAAAGFQEIDFGNGAMEINPDDIASVTVLKGPSAAALYGTRASNGVLVIKTKDGSKKRGLGVSINSSVTFESAFRLPDFQNEFGQGNSGQFKYVDGLGGGTNDNITYSWGPRLDAGNFIAQFDAPVTLPDGTIVRGGDTSLYNSASITPTLFKSNPNNLKDFYQTGITTINNISITDSFDSGSYRLSITDLDSESIIPGVNLHRKTAAIKMNFKPSEKTKVTASVNYVNAGSDNRPANGYGSENANYSLVAWGPRSLNIDSLKDYWQPGLEGLQQYSFNYTFFDNPFFILQENTNSFNRDRVFGNIAINHKFTDNLSISLRSGMDYSSEKRKFKRNFSSNRFKNGAYAEHDVFYREVNTDFLVNYTNNFNDFSFDASFGGNRLDQTASTKQLQTSNLAQPEIFSFNNAASPIEAFQFDSKKRINSFYGIAKFGYKNYVYVDITGRNDWSSALATPFSIAGNSFFYPSISSSFILSNLIALPENISFAKLRASVAQVGNDTNPYQTSGAFVSQTTFNGQATFSNQDFIPNAKLKPERTTSYEFGADLRFFKDRLNVDFTYYNATTKDQIISLPIAISSGYNQQVINGGEVNTTGVEIILGGTPIKTRNLKWNTTFNFAANKSIIKDLPQEEGRLTLAYSSIYNSANQTVWFQVDEGGRIGDLYGTGYEKNENGQFLLDNNGRFIANNNLIKIGNYNPDFTLGWNNSFSYKVWNASFLFDWRQGGEIVSRTRALGNVGGQLAESANRPTEGIIAQGVNVNTGQPNTVAVSAESYYRQFYDRNHEENNVYDASYLKLRQFSIGYTLDLNEGFLGLTDTSTMNFSFIGNNLFVITENPHFDPEQLAVQGDGFVSGVEDLSYASSRSLGFKVGFNF

SEQ ID NO: 16138 - protein, 392 aa, Francisella tularensis
MRLKSIVIATTVLLGSATASIAAGSDNIDTSANTNSATTQSSGFAANNFIAPFANTYSALTNKDNTWGPQDRTGQWYLGVDANGLAGTPNSPSGAGANFTIGYNINKYFAVQYNQLVGRVFAGLGEGVVNFSNNTMFTPYAAGGAGWANLAGQATGAWDVGGGLKFELSRNVQASVDYRYIQTMAPSNISGANGRAGTNMIGAGLTWFFGGKDTTNNDTGNIQDNGATTAAQTVAMPTIDESKYVLPAGIKQCEGNFNLTEDGVACYTVNGDDVTVYLDTKFAYDKATLNAKGKKAIASFVNFIKDSNIGSVTVKGYASQGQTGSEFDIYNQKLSEKRAQAVADYMKQLGLDSEKIITKGFGYDDTLGGIPKSDPRNQRVEASVSAPLKEAN

SEQ ID NO: 16139 - protein, 564 aa, Neptuniibacter caesariensis
MLNAGLTYDILDWLNVSARIRVDNTDNTYQQKLYASTISTLTEGSTQGHYTIQKVNETQTYADFMVNINKRIDDFTVVVNAGTSLSDNSSDLLGYGGPIRDTGVPNVFNVFDLDNAKKRTTQEGWEEMTQSIFASAEIGWKSMLYLTLTGRNDWASQLKGSNPTSFFYPSVGLSAVISEMVTLPKAIDYLKVRGSFSSVGTPYPRFLVQPTYSYDPTKQDWNAKTHYPIGKLKPERTDSWEIGVDGTFFKDFKVSGSFYYANTYNQTFDPKITVSSGYSTLYVQTGYVRNLGVEGLLSYGHTWRDFGWNSNFTFSWNKNKIVELVKDYVHPETGEIVNKDRLELKGLGYTKFILKEGGTLGDLYTNADFIRDDKGYIQIDKNGDVAKTDNLPDIKLGSVFPKANLAWNNSFSYKGIYAGFQLSARLGGIVYSATQAALDQYGVSEASAAARDRGGVLVNGRSWVNAQQYYEIVATSSGLPQYYTYSATNLRLQEAHIGYTIPRKWLGNICDINVSVVGRNLWMIYCKAPFDPEAIATTSNFYQGIDYFMMPSTRNFGFNVKINF

SEQ ID NO: 16140 - protein, 319 aa, Neptuniibacter caesariensis
MKKSIIAIAVSSAALASVSVQAAEGSTVDVYGNIQYAYVDKEAGGNFEDNGSTIGLKGDTKINDDLTAFFKYEIEIKADQKAGLEDSGKSNLDQAYVGLKGSFGKVQIGSFDTIYNNAIQDNINQFEYLSPTKAANSSEGDTIAFFTPSMSGFEMQVAIQVKGKASETNTEGNPNGDKMSSMTVLKYSTDMFSVALAHDTRSNIAGPTTSKNAKATTGLALTVLPLENLSVTAKYETTESTQDILGLAARYGYGAGDVYASYQNVDPDAAGSSSFNEYAAGVTYDLASNVYVYAELGEFENAKSSTTDTQTAVGVYYGF

SEQ ID NO: 16141 - protein, 392 aa, Neptuniibacter caesariensis
MVHNTRFKFSVLATFIGSQFLAYSAQANQQETMVVVSDQSLRVGQTIDSTQLEHQQANELSDVFRTAPEVQVGGGSAVSQKIYLRGIEDNMLNITIDGAVQAANVYHHQGRLSIEPELLKSVKVQPGVVRATDGAGALGGSIAFETKNPQDLLDADQRAGAQFKAGYYSNTQGYKTSATGYAQATDSLSMLASVTVGELDDFVDGKGQTQPHTGSENKAGLFKAVADLNQEQQLVFGYEARRDQAYRYHRPQWQPSAKNAPINQEMARDTFTSKYNYTPVDNHWVDTQVTLYLTETSLEHLQGPWGDYLGEGESVGADVRNTSRFQNFAVTYGADYREDEGRLMSPTYGSEKDQGKVHGIYAQADWSFDSQWRLTAGARYDKYQLEESKGSE

SEQ ID NO: 16142 - protein, 929 aa, Neptuniibacter caesariensis
MRVYLLIMLFFSGISFAQNTITGSVTDGNKQSIPGANVVVLGSTSGVSTDFDGSFKLTTNEKLPFTLKVSAVGFESKTISVTSANQKVNVILKDEETKLDEIVVSASRTPERVIESPVTIERMGLQEIKNTTAATFYDGLENLKEVNFNTSSISFKSVNTRGFATVANTRFMQLVDGMDNSSPALNFVLGNLIGVSDIDVASVELLPGASSALYGANAFNGIMFMTSKSPFTNEGISVYYKYGQTSQDAAGTNDYNDFGIRAAKAFTKHFAMKANFTYMEASEWIANDTRSMTGGSVGHAMNQNYDGLNIYGDEVTTFIPNVGQVSRTGYREQDLTDNKVQSMKADFSAHIKPWADDTEFILQYKIGMGSTIYQGANRYALKDFLMQQGKFEVKGKNFFGRIYFTSEDAGNSYDMRFAAWNVNRAAKSDTEWFTNYATAYQYAGAVMGTNANESAAIARNFADYNVLPAQISFIPKPTGSPRFEPGSPQFNSALKTVVANPDLTQGAKFIDHSKLYHSDVNYNFKDMIDWAEIQVGGSWRKYVMDSQGTIFTDYDGPIEYKEYGAYAQLQKKFLDDRLKFTGSLRYDKSQNFDGNVSPRISFVYSAGANKNHNFRLSYQTGFRNPTTQDQYIGLDLGPFALIGSAPENLDRFQETVNVSAAGQAAGQPATIGMSGQNAYHNAYTVASVQAFAASSNPAVLQVADIGLVKPEQVQAFEAGYRTVVQNDLSVDLNAYYNIYNDFMNTARVISPYYGTVGTDPSNPAVQQTYQALAFGDRRVYQVYTNTTAQISSFGFGVGLSKKVYKDFEVGANYNYSQFNFNQEDDPDFVAGFNTPKHRIKASLGNAKVVKNLGFNVNVRWNSEYLWESSFGDGMIPENTVLDAQINYAVPKLKSVIKVGATNLFGKDYLQVIGAGMIGQMWFASWTINP

SEQ ID NO: 16143 - protein, 326 aa, Neptuniibacter caesariensis
MKKLALAAALCAAFTGSAFAQSSVTLYGRLNTSIEFQDNDVSDATVMKNNASRWGLRGNEDLGGGLSAFFQLESGFGSDDGTGTGGFGRDAYVGLKSTSWGQIKMGKIALGALYGSTIDYIGVFNHDTGTTSEDNIYSLRVGFSNAVEYTSPNFGPVSFAVTVAAGEGTGPKTYEGVVNYDVDGLHIGAGYSKSEDTFGNDTIKGFSAGAAYTMGPFLLGLAYENSDDVVLGKRNQVTGTVQYTVGASEFHVSVGWADEWDNLADSDAIQYTLGYNYNLSKRTKVYAFYYAIDNNSFPYGGSGTATLPVLADNKFSSIGLGIRHNF

SEQ ID NO: 16144 - protein, 889 aa, Neptuniibacter caesariensis
MVLSTPSLACAAEMTATTLDSVNVQATHAAAPGSLNEQRLSNSVNSVMSKQQIDAIPSGGIANVVAHMPGLSAYSDMHLGQATTGENAYVSIRGMDASYNAYTLNGFGMPETDSSTRAISLNMLAPFGIQSVQVSKSPTPDMPGDSIGGAINMRTPNAFDFAQDVYAKSTAQGQFNALAHHLGGKDSGGTFQQELAWKFGQGDAFGIYASAYYGKNNNMAQAPAPNSKYVPADPTLAQATDLRDVGPLISTRYKYSLYTSQIERYGGTLSLDWQGDTSALYARAIYGSYGVTGTQDQSSARLETYRKQPTAVRGGYFNTHDIDETLATLQLGGETTLDRLRFDYGSSFGRGTRSRPDYVSASLYGFTPGSFAFDLSDPTYPSIGPSSPALKDFFYNLDSSLLWKVQGHDAGSHDNRFNAHTDIAYQVDGAVLNSVKLGLSADHSEREAYDHPFFHKDGNFVTNGPYFGGPNYAFPTAGGPPLSAIPGRITDNAFDGHYAGPFKLLDRGWMRAQALPYKYIDDPNGAGSYTANDYNANTTSSNEAIYSGYAMAALHIGAVSVLPGVRYELTRYAADSWQSSGDGRNGSFVDTGSTYGKVLPGISINYRPDDLTVYRAALRRSFSRPAFGLISGETVYSIDDTQKVVGISKPNPNLQASTADNADLSAEFYDHNGGVLSASTYYKRINGFIYTSQSATSNDSTLGGLVPTGTTFENGVPVTMPQNGGTAKLYGLELAASKRLQQLPGLWSNLGVTANLTLQHSQADSKRSDQPEKTWLPRAPERIYNLDLFYDDTHLRMDLSYNYTGLQLLGLTTDRLNYYLQPVKSLDFNATYHLPHHIDVGVAAKNLLNAATFYETQGKSKRYMAYDPGADGAYVQTGRTYMLTLGYTY

SEQ ID NO: 16145 - protein, 186 aa, Neptuniibacter caesariensis
MKKLILAALTIASVTGIASTSAFASNEMYALGGFGMDDGDVGGQFTFGSQIMQSKWYVESTLLVISTDEKDLQTKQEFDSLMLSLTPMYKHSFSENFAVYGKAGAFYAHSDTKLVFLSSDNNEVHKGSHGDFGLTYGIGAEYKSLKPVFGHSKFVTRAGFDWYEFGGSTGWYTAESVLSIQAGFTF

SEQ ID NO: 16146 - protein, 829 aa, Neptuniibacter caesariensis
MKLKKLSLYFPLLAFSALSLQTTAQETVNQEAEADESNAIETIMVTAQRKSQSLQDAAVPMLAVNQDSLTRQGLDSGQDLGRLSPSLGISPGGGPLTSIFVRGVGALTVNPLTDAAVAQNIDGVYLGRSSGAAGQALFDLERVEVLKGPQGTLYGRNATGGVVNYIPEKPQLRETSGYAQVEAGNYSRLGFQGAYNAPLGDDAAVRFSVNSLQRDGYSDDGTNDADTFAIRAQVYFEPSDEFNIRFAADYSENSGIGQGGDLIGTFSNDSGSLTDFTPSGIELFSGPTSDAANDIRTGVLHTPSFAPYKPLSIDDLGQDLSFTGLMVELNYTTESGTFSVIPAYRKSDQVYTFVGPGFAPAKTSEENEQTSLEARFTTDFEGPFNGILGAFYFDEEIQTSGVFAQNYASPIQNYENGGDSWAIFGQGTYDISETFRINLGLRYTEDKKYVEGISDTFVTFCGGTPASGDFLTPPASFGNGCASGAIPAHPITSDRDEFIAYFVNEGLIAPDSVATIPGMGPPPAYPFTIPGNISPQIATIANVGEGFIQADLDYSETTYRIGLEYDVAKDNLLYATFETGYRAGGVDLSAVSPTYDPEYIDAFTIGSKNRFLDNTLQLNLEAFHWKYDGQQVTYFTTLDSASSFPIANGDSTIQGLDVDMIWAVGQNTTISGNAQFLDSTYDSLTLVSDPGQGRFGCASTGVTGAIENYDCSGESLLYSPDFGAGMAINHHIEFDEYNLSLTAQASHRSEQETNFLFVDATKAKSYTTLDLDATLMSASGDINWAISVFVRNVTDEIFVANSNVNNRGLTYAIHNPPRTFGIRLKADFY

SEQ ID NO: 16147 - protein, 1411 aa, Neptuniibacter caesariensis
MIPAGPVLASVGFTLAIGAGAVSPAHAINECGPAIGGVVTCNTSTYPKGPGIHIEYRIDTGLRATIDSVAVRWADDAGSDRPAIDIRSDKVTSEGDLIVTIEGSTVTTGEPDRIGTRSDREVGEYADGLRVTQRGAGLVSATMLSGSIITYGYNAAGIYAWQPGANENNKSDVIADFSGEDSTIETFGSYSQGIYGRTETGIGNVAVTAKDGTIVTHGLSSIGVRGLKHSASLGDGDVTVAGDNITVTTGGNLSIGMEARVEDSKSGRGNASVFVRNEAAIETSGTRAHGAQAFNLDPGDSTVVLEKSKITTRGEGAIGIRAEAGDGNAVTEVTKGSIATAGASAIGLAAISQGNMGEARVSLDGGDVSTGGDNAEGLIATAKGAGGTATARLVDGNVKTAGRDAEGLIAHAGDESIPTSINADASVIMQAGSITTTGDGAGGMIAETDIGPTPSTGKATAVQRAGTIMTSGGEIGGNEGSYAIAALSFGSGLASIEQAGGSATTAGAQSHALYALSIFGNTMVTQAAGSSAVATGAKASGLRALAGPGGGNEVTLDGKVTAGSAPAVHTIGSAGSKITIGSAAEIDGSASGTAIRDGDSDLDAADETGGNSTATLAGKVTGDVVMGLGNDIINLTGGVLDGDVYGDDRLATAADGDDSFTWSGGTWLSSFFGGNGSDTATVSAQSYDGTHHYLDGGDDVSTADGWTDRLNLSGVTASANGANIVNWEIVTLDAADVTILDGALEAGSEPETGLFLTNGSVLNGSDAFALAGNMAIDGTSQFIAFGEDIANGVYSISGNLVNAGTVDMQDGGTGDVLSVGGNYTGAENSTVYIDTYLGDDASPTDHITVGGDTAGSTAISIGNAGGPSAQTVAGIRVVGVAGASSGTFVLANANSEIKETGEAAITRGAYAYALRQVDNDDWFLQSTLAEDDTGPDTGGEQAVDPETEGGETVDPGTGGGETVDPGTGGGETVDPGTGGGETVDPGTGGGETVDPGTGGGETVDPGTGGGETVDPGTGGGETVDPGTGGGETVDPETGGGETVDPGTGGGETVDPGTGGGETVDPGTGGGETVIPSYNQGVPVYETYARNLLGFIQLPTLRRRASGERVPALRSCGSVPLNVEGNQTAACAEDNTVWARIDGTRAHVEPEESGARVSEYDSRSWLLQAGIDALLHSSGKGELIGGLTAHYGGINTDVSSFYGDGSIDTRGYGLGATLTWYGQNGFYLDGQGQLTRFDSDLDSDILGRLADGNDGLGYAVSIEAGHRIGLGDTWALTPQAQLVNTSVNFDDFVDPYGARVSLDDGNSLRGRIGLALDREQQWQGAEGDGRSSRLYGTIDLYREFLGDTRADVSGVSFGIEADDWIGEIGIGGSYNWGDDKYSLYGEARASTGLSDFGGSYAVRASVGLKMKF

SEQ ID NO: 16148 - protein, 762 aa, Neptuniibacter caesariensis
MTHIKTRKYAPRVSLLATATLAAGFAPLAAQAADNADAASRKATDLDKVQVRGSWFNPSSPKFTAELLNTPKSVSIVSEKLIAETGATNLQDALRMVPGITFGAGEGGNPTGDRPFIRGFDSQSNMFVDGLRDVGSQTREIFDLEQVEVVKGPSSAYGGRDSGGGSLNLVSKTPKLKNETSASMGIGTDSYARGTVDANYVLGDGIAARLNLMKHESDIAGRDAANVSRWGIAPSIAFGLNGPAQLIASHYHMQSDDLPDAGGFPYGNPNGAPASKWVDGRPMVPDRNNYYGLVDRDFQRTRADISTLDASYDFGGHKLRNIARLGNTSNDYLWTQPDDSQGNPNNYGTLWRRTNSRAVDVKSFADQLGLTGAFQTGALKHSYSAGVEYSDEKMTRGSYLMTPGTSNPLTGNSKCPTTGAATGYNCTSFANPNPNDPWAATHAVYRSDKALDVEQRTKTTSAYLFDTIELNAQWSFNLGLRYDDFRTTLTTPVAGAAPTRVRNDNDFLNYQAGVVFKPAANGSIYLSWGTSSTPPGMDGGDGSDGLSAAVADLKPQDTKNLELGTKWDLLDNRLNLTAAIFHTVMNNARVTIDNGTSQNAGKKEINGFELGFTGQLTDAWSLYGGYTYLDSELKDNGFVCAVSGRTCPSNVYVPSPNNGNEFPNTAKHSANLWTTYRFPIGLTIGAGAFYSDKQYGDVANTKWIASYTRFDAMASYAIQDNISLQLNVQNLTDKTYFTKAYASHYASIAPGRSATLALNVKF

SEQ ID NO: 16149 - protein, 496 aa, Neptuniibacter caesariensis
MFQIRNISLWMVIIGAPFEDQNKKPRLLGKIPRRCFRPMPGNPDGTGTERKFRVFPRPFKALATCLRTNRGPRLDSKIYFVPADFRPYTPFHQRHIVPYMERKKAKNSAVGTRVADRFARGHRPRHLEQRSGDQMVKQAVAALLGAGAVAGAWAQSSVTLYGSLDAGVAYVNNVGGGAKWSMIQGNTQPDRWGLKGTEDLGGGLKTIFQLENGFYTNNGQMAAAGTMWNRQAFVGLNSDKLGTLTLGHQTPFNFDWLDPLSTAFLAQSWYAFHPGNLDQLADTSTVPFNNSVKYRTPTFAGFTAGAMLGFGNTTNFSTGRTMSFGVNYANGPFKAAAVYSNEHDQAFSMATVGGIAGPGGTFQGMPVASYVAKKAQNMGAGLSYRFGPLLVHGLYTRVKLQANDHSDTFQSYDAGANYQSSPFNVIAGGAASSTLAGRRWTQFELGDTYSLSKRTQVYANVLYEHASGNAKAAFFTAGASSTANQVIFLTGIHHSF

SEQ ID NO: 16150 - protein, 255 aa, Photobacterium sp. SKA34
MNNKWILVALLASPIACADSLIHWSDFSVTGLYGDSFEVDPAEQTTITLETAGGWKYGDWFAFQDFIYFNDAPSDSNHANYGEIGTRFSASKIFDSKLGFGPLTDLSLALQYEQGNAAASTILYGIGSDWAVPGFSYLNVNVYYRSELSNPFVAPGASDGWQVTPAWRIDFGDTGIVFDGFIDWVFAPSEDAYESVLHINPQLKYDLGAAINGKSGQFYVGVEYDYWKNKYGIPNGIPGLDVDQSAFSLLIQYHL

SEQ ID NO: 16151 - protein, 734 aa, Photobacterium sp. SKA34
MPAHTPRLKPHSLALALATLLPSVAFAAGQDSSHRDRHLTELSSVQVTASPLQGDAESLARPVDVLAGERLDEQKAGTLGDTVAKLPGVQSTFFGPGVGRPIIRGQEGPRVAVLSNGMGNMDASTVSADHATSIEPFLADQIEVLKGPATLLFGSGAIGGAVNVVDGRIARELPERPLSGRAELRGNSVNNERSGMFRLDGVSGNVVLHVDGLVRNGDDYRIPGYAVIDSLEDHHDHDHEHAGEEGEEPRRGRLDNSSIRTRAGGVGATWLGDGGYFGVSASTYRTNYGIPNGAHVHADGDDHGHDHGHDHGDEEEGGDEHDVRIDMVQNRFETKAGIYNPVSFLKNINARVAYTDYEHVELEAGTPSTRFTNRGIEARLEAVQQQIGGWDGAFGLQFGNSDFGAKGEEAFVPDTGTRNIGLFVLQEKQFGPFKLELGGRHDQVKLDPTGDYRRRTFGATNLSAAGIWKLNDTVDLRIGVDSSERAPTNEELYAAGAHIATRSLEIGDANLKTERGQRVELGIHTHSERLDFSASVYQTRFKDFIYLADTGVTEGLPVRAWTQQDAVFRGAEAEALVHLFEGGAGDWDLRVFGDYVKAKLDGSGSRNLDIAVPHGDHNHNYSVELANTGYLPRIAPARVGADLRWSKDGWRASVGAVRYSRQKDVAQNEAPSDGYTLVDAHLAYRWDRNASNSYEVFLDGSNLTNREVRPHTSLLRDYSPLPGRGVAFGIRAFF

SEQ ID NO: 16152 - protein, 391 aa, Photobacterium sp. SKA34
MSKAAGLKTRIAVAVATALTILAGSSTAAQAQSSVTLYGIIDEGLNYTSNAKGHGTFQMKSGDTFGSRWGIAGSEDLGGGTRALFRLENGFDVNSGAFRQGGREFGRQAWVGLQSDRLGTLSFGRQYDPTIDLWSGLTGAGGVSGDVASHPFDNDNADFDFRVNNSVKYTSPNFNGLKAEAMYGFSNDTGFANNRLYSAALQYKLAGLTAALGYLKIDAGGSANGAVSTDAVFTGSSEQNIVAGLSYAFAATKLGLAYSHVDVYDPTANAYIASTATRPPGGRWQSWKFDNFEVNAKYAFTPSLWLFGAYTFTEARLHASTGDFEPKWHQLSLMLDYDLSKRTSLYMQAAYQHVVSAHTGTAFDFATTPASAGASSGENQTLVRLGMIHRF

SEQ ID NO: 16153 - protein, 359 aa, Photobacterium sp. SKA34
MSKKWRTAKRLSVIGVGLLINSAAQAQSSVTLFGVLDGGLLYTNKTLDPATGRNAGKQVSVIDGGSYYSQLGLTGTEDLGGGVKATFRLVSGLNIANGGLLHCNGNLFGCEAWVGIEGAPGKLKLGLQFSPFFLAVYDTDPRSLSLFGSGSIPLVDNVLGTGIFNANAVSYTSPTIAGLQVSGLYAFGGKAGDFQAGRQYAVRVKYQLGGLTVNAAIYDGNSGGTAQTPVPTTVQYEGRLLGVGYQFGSVTAKASFVNYKVAGSFNNNVYGGGLTWYVLPTLDVNGGVWVTSDRNRTTNHSVLAALGTDYFLSKATTLYAQVGVVNNHGAMNTGLSMIGALYEVQGTSMGAVLGIRHTF

SEQ ID NO: 16154 - protein, 317 aa, Photobacterium sp. SKA34
MKKVALASAILASLAAGTVNAATVYQDDDKSLSIGGRAEARFNLSDANKGDDGTGNAFKDKSRARINLKGKAKINDQVTAFGKYEAEISDSSDSTVKSRYVFAGFDTQAGAFSYGKQDSAQVMLTDYTDILATFGGDGVDLVDGNKDKRENNFLYAGEFNNFTVSANYIAENNDAVKDSDSYGIAAQYAFPFGLSLGAGYVSGQDGVDVDANQYNLAASYEFNNFYAAATYASGEDGNTDLTGYELATAFKMNQFIAQAAYNFKQSEDGGVKTDKVDYFVLEGIYKFNKNLRTYAGYLFNQIDGEDDELQMGIRYDF

SEQ ID NO: 16155 - protein, 641 aa, Photobacterium sp. SKA34
MSMALVPGLASAEEILLDPINVSGETEAQHGTLSVSGEALEDLAPKEMSRLFAGESSVMSSVIPTGNKTYVNGLDSSMMNVTVDGTLQSDGVFHHATTGMFNPALFKAATVKPGVVAADDGPRANAGSISYETKDAADLLEVGDNFGGLAGMSFDSNSKTFRSNLALFGRQGGFEYLVYGDRATGDNYKDGSGTTYRGSAADLTSFLGKIAYQWDNGYRLEFSGSESRDDGWRQARPNFGDLTGAVFPLFDTEVKQSNYALSLKNENAAGGFSPEFHLGFSSSFLNQGNPSDPSYTRALWGGEVETWNGKVQNEFLFGKHSLTAGIDFFNQEGTGGAIAGTYTDPLTLSGSFGPYTEKTRNLGIFAQMRSEFSDVFSMSYGLRADYQSFTGWDGTKISDEGISYNVAGSYAVSNAVTLEAAYSQVWGGYELGETGIINYSFPWVNYQGMRAQETENMRIGVTVNTGNWDAHFALFRTDAENVRARNSADQAQASNIVSEGIDASLGYSFATGYLRGTYTYADVTEDGQTSSTTNYYSAQPVGHILALQGAFDVATDWKVGGTAEAALSLDLAASRLPAYEVVNLFAEYKPSKVEGLTVRAEINNLFDSYYVSRATQGSDNSRVLPFSEPGRSFALYATLAF

SEQ ID NO: 16156 - protein, 696 aa, Photobacterium sp. SKA34
MFSKSQLTLLIGAVLSAPVAYAESTEVDEHMVVTGRDYGYKADTNSTAMRMEMTQLETPGQVAVIDEQLIDEQRASTLGEVLQNDASISAGGTGRNRERFSLRGFELGSSSGFLRDGHQHWSHYRQPVELLERVEVMKGPAGLLYGKSAPGGLVNMVAKKPTHETQVNFSQDVGSNNHTRSVLDVSGSLNQDESLRARAVVAKEDYDSWRKYGDGSTPSTDRFVGGLFVDYDFNEDVTLSLHYDRTEDKGSVDSGAYIVDGKPVLGRDHVWDAQWSKINNEVENYGFDVKAQLTDVWALNTGFNYQDFTRHDVESYPNFSNFEESGLVKQGGNDRNDHWKFKTAYTDFVGEFDALGMQHQLLVGSNWLGYSYDRFQRSFNSVEVAPNQSTPVPSYKSGKPKESHSSYNAWGFYAQDMVTINDYWQVLAGVRFDRQTQEGKAAEEAVSPKVAAIFHPAENGSIYLAYSESFEPQGTVTSGSTNYVNDGEQLDPLRGKQYELGTKWGLLDNRLFVSGAVFNITQENSTIDVQVGKDLYEKTQAGERVHNGAELALQGNVTNKLSMSASAMYLDAEYTKDQKYQGNRPVDVPEFAASVWSTYNVTPATDVNLGVIYEGSRFGDAANTFKKDGYTRVDLGMAHTYKYDANLDIIGRINVENVFDTDYMAGGGSTSKDYVGATGVTLGEGRNFMATLEFKY

SEQ ID NO: 16157 - protein, 297 aa, Photobacterium sp. SKA34
MENLMNKKNKFFTISTAMVCLLLLPGISFSETINNSAKKQPGLYISGQYKPSVSVFSNFSVKETNVPTKQLIALKKDINSVAVGSNATTGISNPGNFTIPYTAEFQDNVANFNGAVGYSFPDSLRIEIEGFHEKFDVKNPGGYTQVKDAYRYFALARDLKDGFFEPKAEDTGVYHTVMKNDGLSILSTMVNVCYDFSVDELPVLPYICAGMGINAIEFFDALHVKFAYQGKLGISYQLFTKVNLFLDGYYHQVIGNQFKNLNVNHVYTLKESPKVTSAVATLDIAYFGGEVGIRFTF

SEQ ID NO: 16158 - protein, 812 aa, Photobacterium sp. SKA34
MKKILLLLCFVGTISAVYGQNKKQAKKVTITGKVFEKSTNQPLEYATIIFQDTAKKRTVTGGITNSKGAFSIEVEADTYDVTIEFISFKSQEIKAKSLTKDMSIGSFYLAEDAQALKAVEVIAEKTTVQLKLDKKIYNVGKDLTVRGGTVSDVLDNVPSVSVDVEGNVALRGNDNVRILINGKPSGLVGLNSTDALRQLPADAIEKVEIITSPSARYDAEGTAGILNIILRRSKLEGINGAITTNVAYPKGYGISGNLNYRTGDFNFFTTSGYNYRTVPGNANTFTEYFNGDDPNTFLNEDRDFDRIRKGFNSNFGVEWYINDKTSITASLVYRDSDNERETSNILTQFDSDFNVTNVSTRFDPETEADKTIQYAVNFDKNFEESGHKLTADFQYESSTEAENSFILVNDVLAEQVATIEKQDRILLQTDYTVPLSETAQFEFGYRGNFLDLNTDYLVAFLEDDVFVSDTNLSNVLNYREYVNAFYTQYGNKINDKFSFLLGLRMESTRITIDQITSGDFDKKNYVGFFPTINLGYEISEDQSITLGYNRRIRRPRSRFINPFPSRSSITNIFQGNPDIDPSYSNGIDLGYLNRFGKLTLNTSVYFQRATDVFNFISEDTGQTTLLNGEEVPIIRRTPINLARNDRFGFEFTLTYNPSRKWRVNGNFNLFQSYNRGEFNGVNFDADNLSWFVRVNNKVTLPGNIDWQTRLFYRGPNEDAQNIRKGIFSANLAFSKDLLDDKASIAFNVSDVFNSRKRRSESFTDTFRSDGEFQWRERTFNLSFTYRFNQKKQRERNGRDQNDDDEGGFSAKP

SEQ ID NO: 16159 - protein, 653 aa, Photobacterium sp. SKA34
MTPHSSPHRLPPLRLARAVPFLYLLPCLALAAPVELEPTVVSATTTERKLRDAPASVSLIAAEDLRRRPVRDLQEALRGSESLQFNGVGMSRRGISVRGMSSEHTLVLVDGQRISTSSGAIAHSDFDLGWVPVESIERIEVVRGPMSSLYGSEALGGVVNVITRRATDTWTGSGLLDGGVREDGLGGQSHQLGAYLAGPLVPGKLGLALNGESRRQQETPDADERRLSELEGGNADSGGLNLSWTPDDAQRIDLGHQRGRERRWRNSETGGPRSRYYESRDVIERERWSLAHNGQWDWGSSQLRTYRNRLERHNARSDGQPPSNPQRLTDSVVDGHLSVPAFERHLFTLGGEWRKEELEDRSVNTAGDASARHKALFLQDEIAFGPDWSLTLGSRFDKHEAFGWESSPRLYLLHHLSDALTLRAGVGRGYKAPSLKQLSPEYAAVGGGGRFTIYGNPDLKPETNTSYELGADYQGDGWSLKGTVFENDVRDLIQTVCVARCGVRGGEIRNYENVDRARIRGLELGGGVDLPADLRWELNYTYLDARNRTAGQRLGDRSRHLANSQLRWSPNARFSAQLRTEYVGSQVAYSSNVGYALPAYSLWHLELSQKLNENLTLRGGIENLGDQRLADDDTHFTYAEPGRTFHLGLVASF

SEQ ID NO: 16160 - protein, 698 aa, Photobacterium sp. SKA34
MKKTFIYSTVAQTVLLTIAGTAIAAEDGTEQLDTIDVVTEGSMFRMGEVPFHQAKSAVAITREQLDSQNVDKLDEVAKYQAGFANQVFGNDTNTNWFRVRGAEVSQAVNGLPTFSYGFFTPYVNSFGLEAIEVTKGADAMTFGAAKSGGLINYVTKRAHKDQIGHGEFKTTFGSHNQYGLAADYTGTLTDDERLRYRVVASYLGRDGDWEGTDNQTLYIAPTLTWDISDKTRFTLLTGYQRDHGTPSSNFLPQEGTLVPSPRGYIHRRTNLGDPVKDTETNRQYNIGYEFSHDFNNGLSFNSSYSYSHIDNYHRGAYAYPSAYNADWSPLAPSAAGYSLSRAVVFNDGKAISHTTNNYLTWNYDNAWLKNTLVVGTDYRHNKVDALYSLYGTTSNTNLFTPSVGWNQAQDVSAAPHVQIKSRQLGFYLQNNARFADKYVLGLGIRHDRAEQREYTSTQKVKDNHTSYSASLMYEAPFGLNPYFSYSESFNLPTGLSGDETLYDPNITRQYELGLKYIPTWLDGTISVAGFRAKDTGALVGNGLGATISSADPIYRKGFEVQADVNFTSNWTGTLAYTYTKSESKDSAGKKTRQPLIPTNMVAAKTAYSFTEGLLKDLTVGVGLRYLGHSVTSKGSLYSHARLPSATVVDLMARYAITPNWIAQVNIDNVGNRRYVSGCDYYCYYGAERRATANLSYKF

SEQ ID NO: 16161 - protein, 715 aa, Photobacterium sp. SKA34
MNTFDLPLPARQAAPYARGCLTALILAALAPGLAHAQQTTPTLPAVTVTEGTPGEIATGPVQGYVARRSATATKTDTALADTPQSVSVITAERMRDQGAQTVQDALRYTAGMRGETYGLDSRGDWSTVRGSDPVVFLDGMQQTFGYYASARPDPFSLERIEVLKGPASVLYGQGTVGGIVNLVSKRPQEEQQGELQLQYGSFDRKQLAVDVTGPLNEDRTLLYRVVAIGRDSDTQVKKVEDDRYVLAPSLTWRPDSTLEWTVLANVQKDETGSTTQFLPHAGTVLPAPGGLGRIPVDVFMSEPGFDEYNTEQKSLTSLFTYRPNDTWTFRQNLRYSESEVSYQTIYPAFPPALQPNGDIDRVYWVAKPELKYWTVDNQLQANLQHGRLRQTVLAGLDYQYALTKRRWAYGAAGTLNLYNPVYGNFTPPGAGDFYDDPDNTVRQTGVYVQDQLTWDERWIAVIGLRHDRAVNETEGGDTQKDSAVTKRLALMYKAGGGFSPYVSYTESFKPEIGLDGYGKAFKPLRGKQYELGVKYEPAGGAGLVSAAVYDLREQNRKSPDPINPLNQLQSGETRVRGLELEAQLRITRDWDLIGTYSYTDSEVLEGTNEGKRLPSVPEQMASLWSQHRFSVAGVSGFRAGFGIRYIGDSRDGTDSLTTPGYTLYDAMLGYDVGRWSLALNVNNIGDKTYYTTCLSRGDCFVGTRRTVLATASYRF

SEQ ID NO: 16162 - protein, 392 aa, Photobacterium sp. SKA34
MRLKSIVIATTVLLGSATASIAAGSDNIDTSANTNSATTQSSGFAANNFIAPFANTYSALTNKDNTWGPQDRTGQWYLGVDANGLAGTPNSPSGAGANFTIGYNINKYFAVQYNQLVGRVFAGLGEGVVNFSNNTMFTPYAAGGAGWANLAGQATGAWDVGGGLKFELSRNVQASVDYRYIQTMAPSNISGANGRAGTNMIGAGLTWFFGGKDTTNNDTGNIQDNGATTAAQTVAMPTIDESKYVLPAGIKQCEGNFNLTEDGVACYTVNGDEVTVYLDTKFAYDKATLNAKGKKAIASFVNFIKDSNISSVTVKGYASQGQTGSEFDIYNQKLSEKRAQAVADYMKQLGLDSEKIITKGFGYNDTLGGIHKSDPRNQRVEASVSAPLKEAN

SEQ ID NO: 16163 - protein, 1117 aa, Photobacterium sp. SKA34
MNKQLLLILLLLGFGLTGFGQEQRTITGRVVGAKDGLPIPGASVFVDKATIGAQSGVPGVIQNSAIGTMTGTDGKFSLNVPAGTKTIRVSYLGYSSIAINIENKADFSIRMESNDNALSEVVVNGYTNIAKRKNTTATALIEYDKIRQTGVSGVDQMLQGQVAGVNVTNISGGPGSAPKIRIRGTASLNGGQDPLWVLDGIPLEGTNLPAIYDKDNIDALRNLPIAGLNPDDIADITILKDAAATAIYGARASNGVIVITTKKGKKGPTAINFNASTFIAERPDFDKLNLMNASEKVDFELALANRADLTYRDNQGSIARILNNNNELANYRANGFAALSPATQAEINNLRQNNTNWGNELYQSAVNQQYGLSLSGGSDAANYYFSSGYYNEKGTTKETGLEKYNVTLKTDFTISPKLTAGAALFGSKTNRKSYLTEIDARTNPSNYSRNVNPYQTVRDANGNFVYDQDIFGTSNLTGDVYLPFNAVEERENTRYGLDNSSLKGVFDLNYQVYSDLKLSTQLGLQFEETGAERYMGVNSYAGRKLKESTRYYNSATRKYEYFLPAGGAMQNDKTSLFQYNWKMMAEYSKVIADKHEIEAVLGTELRRNKNTDLTTRAFGFNEQTLTNSNIVFPNADFAGYESFRTYRKGFVENAFASIYGTLSYTYDRKYTVYGSIRYDGSDLFGVDPKYRYLPIYSVSGAWNASEEDFIKNIKVISNLRLRASYGLQGNVDKNTSPKIIGRYDDVTILPGGTETAVIVTSPPNDKLRWEKTSTFNAGLELGLFNNALQVTVDYYNRYGKDLIGSQALQLENGFEFTNSNFARIRNKGLELSVSTRNISTNKFSWSTDFNISHNKSKVLRENVASNQRTPSREGLPVNSLFVLKTAGLDANGLPLLVKDGQVLSIEDFYQLYDPYADFFPGEAAETRLTADQFKDLYTYVGDRDPKFTGGLTNRFRLGNFDLAVTAIFNLNQWVMARAPYNPAAFDRGQNFSKDLLSVVTPGSGSQLPAIFGKDTYEDRWMAYYYLNNGDTGSSFSNLDIYAKKMSYVRINSMRMGYTLPSAIAKRIKANSIRFSVEARNPFVFGSSYKGYFDPETYGNIYSQPITKSISFGLNATF

SEQ ID NO: 16164 - protein, 326 aa, Photobacterium sp. SKA34
MKKTLLALAVLAAAGSVNAVEILKSDAGTVDFYGQLRQEFKKLDGKDATLSSGSSRAGFDAKYAISEGVNLLGKAEVSLSESANTLAKYVNKNEVEKSNPGNVYMRLHFIGVSTDFGTLNFGKQIQISDDVWGAENSYFFGGDSVLYANDGVHDSMIKYEFDHDAFWVKASFGLDEDNKEEQQTELFAGTAFGDFSVYGGFGATELTSSNVKTEQTYYMLTAAYSIGDLGLGTTYYHNKTEVGSNADVKKDSFVLAADYKVADKTKLYGGYEFIETKNANSDVDNAYAGVEYKFASWGRVYAEANYKKEEGKSSTDNYGIGARVYW

SEQ ID NO: 16165 - protein, 1042 aa, Photobacterium sp. SKA34
MSKKNYFKERIMLLILLFAFMTPFGTLAQTIQLTGLVTDAANEPIIGASVVEKGTTNGVITDFDGNFALSVSPKATIIISYVGYATQEVPVNGKTNIRVTLKEDTEMLDEVVVVGYGTMKKSDMTGAISSVDVDDLVKRTTTNPAEALQGKIAGVNIMKAGGNAGAGVQVKIRGVKTFGDNQPLYIIDGFPGDIENVNPQDIQSMEVLKDGAAAAIYGSVAANGVIIVTTKNGKKGDMKIDFSTYVSFTSVAKKLELLNAEEYKSVHKQMYQNYMNQYPDDTEVTMPAFVNKNTGIDTDWQDAMLRGGVSQNYMFSIRGGSENAQYSLSYNHADEKGIFLGNNYRQDNARLKLHMSKYIFDIDANIAFKFTDSKQPEYSIKEMYMISPLVPIYDDTREYGFGLSDFDDLPSNRNVMADQHYEKSTDKKYHTTANVALTMNFTPWLNFKTSYAYRGEHQRQTYHTPAYVADPKAKRDYPYHSETTGYWEEHVWENVLSFNKTFGKHNVNAMAGTSMTARKYTWNSVGVEGKTTVYKVEDGKLVTSEIPGGFLDPSFSTVGAGAGGTFDGSGTKWKYNRASFFGRLNYNYNDRYLVQATVRYDGSSKFGKDNRWGCFPSVALGWRISQEEFFPKDIALNNLKFRVSWGRLGNENALGYYDFLALISTYNEMYQGYVKGNGDNAWAGSIARGLENRSLKWETTDTKNIGFDFGFFNSKLTGTLNYYYNQTEDLLITKVLPPSAGMTNPTLNVGKIRNTGFELELNWGDAIKDFDYNIGFNMSTTKNKVVELSDADQVLQGEGLKYGTEHFPTETRVGKPIGAFYLYRTDGIFQSMDEVNAHVNKDGQLLQPNAQPGDIRFKDLDGNGSIDAGDKEYCGSGIPTLEANLNLSFGYKGFDLSIVLGSAWNFKLYNGNKYFYEGMNSKSNMLKSTLNAWTPDNRNTDVPRAVYQDPNGNMKESDRFLENGDFVRLRQAQLGYTLPKSLMQKFYIEKLRFYVSGENLFTITGYDGIDPEFSRASVLNTGVDKLIYPFTRSFTVGAQLTF

SEQ ID NO: 16166 - protein, 448 aa, Photobacterium sp. SKA34
MMNKNKITLSLTAALALGMSSNALAAGFQLAEYSATGLGRAFAGEAAMADNASAQFRNPAMLTYLEGTQISVGAIYVDPNIDVKGNLQLNDQTIDQTESRDIANSAVIPNFYISRQLNDKATLGLAFGTNFGMRTDLGTQFSASLFGNQAEVHTVEINPNLGYKINDQFSVGAGVRYIMAKGHFGAALPSALPAAVSGMLSPQQKYIYDQGLAGKNLKYMEGEDNAWGWQAGAAWQINPANRIGVSYRSAVDLNLSGHASGLAYNSQTLPGSLPLELPASAEIATFHQLNDQWAIHTSINWTDWSSFEKLEANIPALGSHSNDLIKEENWKDNYRFAIGTTYQVNSKLALRSGIAYDMAAVDEAHRTQTIPETDRTWLSLGAGYQWSKNLTLDAGLTYVYAKKAHLNETDKSINGLASGLLQQPTKLSFAGTTSGDVWLAGVQASYRF

SEQ ID NO: 16167 - protein, 1049 aa, Photobacterium sp. SKA34
MSVNFAASANTLLKDVQDQMQRQISGTVTSETDGLGIIGANILLKGSVQGTVTDIDGNFTLMVPDEGAVLVISYIGYLKQEVEVGARDRIDIVLEEDFAGLDEVVVVGFGSKEREDISGAVTSVKMDKVLGDRPVTDAAKALQGTVPGLQITYGSGQPGSGTNINIRGFTSINGGTPLVLVNNVPMSLDDVNPRDIEDVVVLKDASAASIYGAEAAFGVILITTKTGGLKQPMKLEYSNNFGFTRPSTLPEKASPLDFVTALDDWGQQTYWTGQNVSDWIGYINEYNSNPSAYPDGYITDPNGLRYYTRENDLYGEFLGANGFEQIHNISVNGGSENTSYRVSLGFNDEDGIMVTDKDSYTRYTANVDLTTQFSPKFSTTLNTIYKNGLRTGPLGGSWSNLYYSAINYHSATPIGSDDLGGGEQIPFATPANRIKNSPERENFEEVIRFFLRGTYKPMPGMEFNAEYTFEKSRNEISSPSFTPTMINPATLSITPYNPGASSYFTSSNKRNYHAMNLYGKYDKSFGEHALNFMVGMNQQVSVNEGFNASRQELISPSNPGLSTATGVVNVSDFYTDYGIVGFFGRANYQFNEKYLLEVNGRYDGSSRFPEGNRFGFFPSVSGAWKISREPFMAGIASAITELKLRGSWGEIGNQAVENTWGNYPYLPTMNSSNIGWIDNDTGVRAVSLSAPGLVSANYSWERVRTTNVGIDFGLFENKLFTTFDWYNRQTLDMLAAGSQLPSVIGATAPLQNVADLKTVGWELDIKWRENLNKFNYSLGFNLYNNNTEITRFQNEAGLLSQYYVGQNINEIWGFTTDGFYTVDDFVEGSLDDNLLNGELKDGVPSYRGVNQNPGDIKYLDLNGDGEIFTGNSTLDDPGDRSIIGNSTRGMEFGFNGYMSYRNFDLSFLIRGIGKRDVWIDNPVSFPYTFEFTTIYNHQLDYWTPENTNAFYPRNYPNGGGNYGNSRRVQSKYLSNGAYLRLQNITVGYTLNDQLLDKLKITRFRMYVSGENLLNFDHLPNGLDADLTGISNGGNYPFIKKVSIGVNVTF

SEQ ID NO: 16168 - protein, 420 aa, Photobacterium sp. SKA34
MTFKKRYIAIAITSSMLSAEANAAGFQVSEQSATGLGRAFAGEAAIADNPGVLARNPASMTKFDKMAISAQGSLVLPNIDVTGHDAPNGEQTAEDVAPLAFVPSTYFVQPLNERLSWGMSLFSNYGVTTDYPEDFYDGTSAGKTSLITINLNPSVAYKLNDQWSIGVGVSAVYAQAELYRHYGKNALPFYPTIKPSDKTINMEGETWGFGWNIGTLFEIDENNRFGLAYRSQVDLDFDGDFTDYSGQVLGSNHRGSTIDAKLAAPLPATAEFSGFHQLNNQFALHYSIFWTQWSKFTELKATSNECNFGGQLPGVCLLKEEKYDDAFRWAIGSTYNLNPQVTLRAGFAYDKQGGKATLSIPDTDRFWYSAGASYKYNDQLSFDLGVSYVYGKDGTFTEAGDSFTATSDAFIGAAQVNYIF

SEQ ID NO: 16169 - protein, 1010 aa, Photobacterium sp. SKA34
MKKIFLIFMIVFTAQVSLAQVKNVKGVITDSDGMPLPGASVAVQGGQKGATTDFDGLYSIEVQKGQTLVFSYVGLETQNIVVGDAATINVKMQVAASNALSEVVVTSLGIKKTRKSLTYAAQELKGDELVRVKDANVINTIAGKIAGVAVTKSAGGTGGSTKVVIRGNSSVSNSQPLYVIDGIPMLNSGSGQPNDTFGSLAGGNRDGGDVISLVNPDDYEGMTVLKGAAASVLYGSQGANGVILLSSKKAKAGKANINLSSVTTFETAAYLPKFQTDYLAAAGADESWGAKGQSKDHVKDFFTTGTTQITSLGYSIGSENSSTAFSYANTSASGIIPGNNLKKNNFGIRQTAKFFDDKLVFAANANYTSQNIANKPVNGFYFNPLTGVYLMPRGNDFNYYKDNYEEFDPSRNLMAQNWMTNRDIMQNPYWAINRNKSEDKNDFFNGALSLTYKATNWLSIASRYSYNRVTSLYDKRIFATTQGTLSHANGRYISENALSTQRYGDLIATINTKIGSDFSFNANIGASVTNTLTNQKTILDSGIGGGLKYANWFTLHNFNNNDGNYQTIDSRREVQSVFAATTFGYKDMLFLDLTGRNDWSSTLVNTGTSNYFYPSVGLTAIISEMATLPEWINYGKVRGTYAQVGNDIYPFISVPTNYYPNGSGSKYNPLVTPKPGTTLKPELKSEFEFGTEWRMFNNRLGFEVSYYNSETKNQYLQVVAPVGNSAGADFYGINAGSIENKGFEVVLNAGIIRGDKFTWDSTINFSQNKNKVKEIPEELGGKVNLTDPGVNGYKYTLTEGRPYGVIEGFKMLKDDQGRILLNSDGKIQKTDFVELGNSNPDFMLGFSNSFKFGSFFANILIDGRFGGEVMSLTQAQNDAFGVSKATGDARNAGGVKINAVMPDGTAVTTMDAQSYYTTVGGRAGITGEYIYDATNVSLREISIGYNFNPKALPFIQTASISFIARNLFFIYKDAPFDPNIALSTGQGLQGVDIYGLPSTRSIGLNLNVTF

SEQ ID NO: 16170 - protein, 222 aa, Photobacterium sp. SKA34
MKKILLTTAAVLISASAASAADLAARPYTKAPPYAPPAPIYNWTGFYLGGHIGGAFGGANNIFAPGVAFNNNDGVFMGGVQVGYDTQFSPNWVFGLEANYSFLDTGSFFANRGLGSVTGRLGYTWGPALLYVKGGYGWADSRFTNGFGGNGGRDGYTVGGGLEYLFTQNWSGKVEYQYYDLGTVNLVAPVVANFRNDQHTIKVGLNYRFNWGAPVAPMAPGY

SEQ ID NO: 16171 - protein, 269 aa, Photobacterium sp. SKA34
MRKSLVALSVLAATALPSLANAADYSDDIHKNDYKWMQFNLMYAYKELPRSNDAHTGHDYLEMEFGGRSGIFDLYGYVDVFNLTNSDSQDKSGSDDKMFMKFAPRISLDALTGKDLSFGPVQEVYLATLMNWSGNTGPNSVNNYFVGLGSDINVPWFGKVGFNVYSLYDMNKKDWNGYQVSTNWFKPFYTFANGSFLSYQGYIDYQFGMKDKYATASNGGAMFNGLYWHSERFAVGYGLKAYHNVYGIKDSDGFKSSGVAQYVSLSYKF

SEQ ID NO: 16172 - protein, 319 aa, Photobacterium sp. SKA34
MKLKSLSLSVLAALSLGVATQAMADDAVANDATQSVDKAGFWIGAGMGMGIVDSNDLSNVGGTGEAFSSKLEAGYDFNKNVGLYTSYDYMHDLGNADLHLGTLGVKGNYYFTQDLSVFGKLGATYIFAEGEIDDSFTGTAGVGLEYQLTNAVSTKIGYDYYQNLELNQGQDTDLHQVYWGMTYKFGQPATPMIVTQDVEVVKEVPVEVTTMTRSNFVLPYQTGQVDVNDYGRYNLNEVAQTLQANPELTAEIIGRTDSTGTAAINAKVSEARANAVSQYLIDNGVDASRLTVTSVADQNPLTDDSGKSLIERSVEVVIK

SEQ ID NO: 16173 - protein, 654 aa, Photobacterium sp. SKA34
MLKGCKFKLLPTTVAVSSALFTQIAVADSEGEHEKMVVMGNPLQATEVFIDSEQLERQQANDINDIFRTDPEVSIGGGTGVAQKIYVRGLEDSQLNVTIDGAVQSGNIFHHQGRLSIEPELLKQVEVAAGAGRATDGAGALGGTIRFKTKDAEDMLQGDERFGGLVKAGYYDNTEGYKTSVSGYGYLTDNVSVVATMVYSDLGNYTDGDGNEQPFTEAQNKVGFIKLVGDITDAQKITLSYDHRGDEAYRNFRPHWAESRKNFPLDQEMNRDTFTLNYGLNPADNPYLELDVTAYNTETELKHKSRPDAPRETNNIAKTHSYGGDIRNTSSFNSFAITYGVDYRKDTTDGTFLAYSPDTYEFKGTVAGVYVQSDFRIVEPLLLSVGGRYDTYELEDSYGTEVDHSGFSPNVSLNYSVIPGLNVYAGYAEAFRGAQIPDSFMTDIELDPNRKAERAHNTEVGASWVNGGLNLSATAYINKIDDVVGKSAKNQGDLETKGFTARAGYTFNDLSMSLSFNHSRSDLDGQRLIDENFGIGTSTGDTWVADINYYVLDNLLIGYTGRYVDRLDDAVEVVEIYKGEEYVTNYSEKPGYAVHDIYSQWQPLSGEELTLSLAVKNLFDKDYRDHASYGDVNAIASAPREPGRDIRFNVAYAF

SEQ ID NO: 16174 - protein, 357 aa, Photobacterium sp. SKA34
MNKHLIALAVTAATLSGAASAAQVYSDDTSSLAIGGRIEATGVMQQQADSNKKDADPAKASNEVVDMSRARINLDAKTQIADGVQGVGFFEKEFHSNTDASPAGRGADETRYAYAGVNSDKYGQIVYGKADGSLGMLTDVTDIMAYAGSVVGSTKLAVADRTNNNLAYAGNFGDLTFKANYVFSGAAYDDAGNKTDVHGFSTGAIYKVADTGLALGAGYGEQRDQNGVNTHKARSEQTFATASYTMGDLYFGGLYKSGRRDGKNLVNGDVTDTQGYEFAAAYTMGKTVFTTTYGFMKDENAHNVYDELANAAAVDATYYFNSNFRTYASYTFNMLDKNEVGKVAASDQFVLGARYDF

SEQ ID NO: 16175 - protein, 351 aa, Oceanicola granulosus HTCC2516
MKSILFATTALVATAGVASAEIALTGNAEMGIYAPAVSDGEDGLEMGETQFFTDMDIRFTLSGEADNGLTFGATIDLDEAADRGEPGRFESPNVQGGEAIFISYGGATFTMGDTDGALDARVPELALAGGSLNDDETTHLGFNHADGFSDSDGDGDYSVINDGVGLSLDGFGDGQIARLDYAYDAFTFSASLEQVADGADAETLAGDDIGDTIWALGVSYSGQVSTVDLTVGLGYQSLDEVADVTSIAATGGFGNGFSAGLTYTDMSIDDADDIQHWGIGFGYEMNAIAVGVNYGEYTQDDDKLSGFGLAATYDLGGGLSARFGYGYSDVDPDAGSADDYDNYSLGLSMSF

SEQ ID NO: 16176 - protein, 263 aa, Oceanicola granulosus HTCC2516
MVLSACGGVKYEYKDGVMYGDGKEATGTFEFKAGKYKVKANFVDGLVDGLLEKYYPDGSIMVKDTYVNGENTKEEIYYKNGQLMGTFSDDEDLKFYYDDGKLIMTYNDKTGETLIYHENGNPLMTTNNKETAIYNENNEMLFKVENNKLVDIGATLKNLENGSFEFVKDNKVIAKIDANGEIINYLYSTGETMLKVNEATGITEFFFKNGNTFMKQEGNKSVVNYKDGKTLYELEGDVWKFYNQEGEEIISNFELITDIKKVD

SEQ ID NO: 16177 - protein, 436 aa, Oceanicola granulosus HTCC2516
MKTLATGAALLALGTTSAYAAGLDRSNQGISSIFDADGATSLSFGVVVPKLTGKDISGGGSYDAGVTYSQGSVTFTKDAGEKFNFSVIFDHPYGVDINYDSDPLTTMLGGTKADLNSIAATFVGRYKVSDRISVFAGMGVQRIDASVGLNGQAYAQAISAAGTARTFNGMIAGTGLPPVTAQEVGGAAAAANAGNFAPIAALNTRYAPTGNPAAGNALVTNFANAVTGFNATGGYNFDMDATTEPNYLIGAAYEIEEIGLRVSGTYRFETKHKADTVENVLGTTTNGSVEFVTPRSFNLEAQTGIAEGTLLTASYRWVEYSAVDLVPDFLQSDLVNLDDQERYTLGVARRFSDKLAGSATFIYEPETGDLVSPLGPTNGLKGISLGGRWTDGPLQVSGGINYSWLGDATAEVASRPVTDFSDNHALGIGFSAKLTF

SEQ ID NO: 16178 - protein, 125 aa, Oceanicola granulosus HTCC2516
QEDDIGEEIFVSYDLPKRYGAVQPTFGASLTTDDDFWVGAGGKWSTERISDSPIFIELSLMPGVYFNGDGPDLGFPLQWRGSLGAGVNFGDTGSISVFFDHRSNANATEVNPGIETVSIRLSYQL

SEQ ID NO: 16179 - protein, 1105 aa, Oceanicola granulosus HTCC2516
MTGARTFEDNKNMALKTKVLLATTMLGSLTAFAPALALAQTAPAAPAQEAATVEEVVVTGSRIRRDPTNSPTPLIQVSRDDVVSTGQASVIDVLADIPALSGSLVPEDTTGAGLNDGGLSLLNLRDLGTGRTLTLVDGRRHVGSNGAGLSVDVDTIPRLLIQNDEVITGSNSALYGADAVSGVVNFVLRKNFDGLEVDGTVAQINQDGQLNRRLSALAGRNFFDGRLNVYASAEYEKNDEVRDSQVDWRKKAWVLLNRDSDVSNSLPDGVLDNILISDARTLSIGPVGGITVLANSLRPSDPNDPDIPFQSCSTAIAPMSANCFAIEPGNSFIYDQAGAARNPSFGTYRDENGFQRVTNIGGDGLNPNTDFSQGSRLPRSVNYRFQGGVNFDVTEDLQFFTEAKYVKEKTFDEGQQTFFDIGILPVAAGVNPSWFSTSSFNIGLDNAYLPTNVRNAILANTRTPITAFNTTTGAITTTPTISDVRARHSLFGPARSQLNEKELKRFVAGFRGSKDDFGFIHNLSYELGYTYGELKNKNFERGVDAPRYKFAADAVVDTAGIVNGKPGEIVCRVQVLDKQGATIRDDARSSRDGRTVNYAKGTKAYEEITNCKPFRVFGPGGMTQDAANYLLAEINVQEKNVQQDALGFVSGELWDFWGAGRIGLAVGAEWRREETEAIGRSSSTGDRILFMNTGPDFPTSSYETKEYFGEFRLPLLRDLPFAKSVEIGAAYRNSEYTTIGKTETYNFNLLWRPIQDVMFRATSGKSVRAPTLGETFRPPTQTFATITDPCDARVLINLTDAKIKANREKNCAALGIPAGTNIIYTSSVAGKNAGNPFLKPEESYSVTASLIITPRFWPKSTFVFDYYDIEIKDVIASVTAQTAANQCVNGDVLNAGICSTITRIGGTASGTTPAYGMIDFIQGSVNYARSTNRGIDFQFLYRTDVQDIIGKDWGRLNYRLAGNYLFEQHDFTNISNPNEHIDFETGLGLPRVRFSSRLSWEVNDKLAVTWNADWQASQWLSNGTRPFDIDDAKIDPDNRDLRYYSTRPFVQHDFTVTYAPREHLVLRGGVVNAFDREPDRWLGNSTSDNFDLFGRRFFLGFNYKM

SEQ ID NO: 16180 - protein, 824 aa, Novosphingobium aromaticivorans
MIIVGSNDLLGQAIDAGATGSDGYINDVDPGHILNITGNVPNGQTVSVVTGDGSQGDQTNVLTLGSNIYTPKNYTLEGISFFLQNAVMYDLENAVTGYTPFYVSDYNFTNGLDVSSDMGALGLAGVISGSKDVNIHEGGIAYLTNNNSYTGATNIAEKGWLGIGGTGSISQSAVVNVAGSFDIAHSETGQNIRSLSGSGQVVLGDNTLLLSQAQDTFSGSIRDDYAEGSTRAAMVPVPILTGGENQTHGGVIIGGGQEIFSGNNSYSGKTGVAAAAQLILTGRLDKSQVENAGRFENNGETTAIVNSTGIVSGNGLFAGGLTVKQGIVTPGAVLNNGGGNMHVSHNLVLDSAATYLTQIGSNSASMIAVEGKAEINNATLVSLATSEAGRPKLGQNYTILTASDGISGQFGAVKSDLTGNALYPFLTTGVDYQSNIVSLEIERSNIAFTNAAQNRNERNVATVLDAMPSTSSLALPATLLDFAAARNAFNSLSGEIHASARTALIQNATEIRDMAINRMRAADCIPGASTEKTANRDSRSTGATCDSDQGQTLWMQSYGNWSHNSHSANAAGMSNSVGGFVLGGETSLIPNWHIGALVGYGHSGFSVSERASSGHSNNVTLGGYANTHWDRLGLRMGATYTWDRLATRRKVLYADFTDQQSSRYNGGTVQAFADIGYRFDIGRVMVEPFGNAAYINQHTNAFRESGGAAALSGHALSSNMAYATFGSRLASRVTLGKSTVLTPNATIGYRHAFGTITSSIKENFLNQTADFNVSGVPLAENSAMVSIGLQAQVKNRLQLGLSYSGQYSAHYSSSGLKGNISWVF

SEQ ID NO: 16181 - protein, 446 aa, Novosphingobium aromaticivorans
MTRMPLATASLLALAISLAGCGDDKKAEAPATPAASTQPAAPAAAPAAKVDEAAAKAVIKNYADLAEATFADALSTAKDLQKAIDAFLAKPDAETLKAAKEAWFAARTPYSQSEAFRFGNAIIDDWEGQVNAWPLDEGLIDYVAKDYQHALGNPGATANIVANTEIQVGEDKIDVKEITGEKLASLNELGGSEANVATGYHAIEFLLWGQDLNGTGPGAGNRPATDYAQGKDCTGGHCDRRAAYLKAVTDLLVSDLEYMAGQWKAGVADNYRAKLEAEPVDTGLRKMFFGMGSLSLGELAGERMKVALEANSTEDEHDCFSDDTHHTLFFNGKSIRNIYLGEYKRIDGSVVKGPSLADLVAKADAAANDTLKADLADTEAKLQAIVDSAEKDGVHFDQMIAPDNKDGQQKIRDAIAALVKQTGAIEQAAGKLGIQDLKPDNADHEF

SEQ ID NO: 16182 - protein, 1086 aa, Novosphingobium aromaticivorans
MRKLTVLFIMLLLGIHMMYAQQLSIKGTVTDKRLNDPIIGASVLVEGTSNGTITDMDGNFSLKNVSKGNVLVVSYIGYQPQRLTIDDNQTTFRIMLTEDTQTLDEVVVVGFGTQKKVNLTGAVATVDTKTLESRPVTSVSQALQGVMPGLNIDINDKGGRLDYSPSMNIRGAGNLGTGSSASPLVLIDGAEGDINSLNPQDIANISVLKDAAASSIYGSRAPFGVILITTKSGEAGKTTIQYSDNFRWSRPTNIPDMLDSYRFTKYFNAAKANSGSTATFLFSNETIDRIQKYMAGEYPYTSDPNGRQGSTDFFAFNMDSNDNQNWPRNFIDKTSFGQEHNLSISGGSEKVKYYISGAFLSQEGQMNYSDEKKKRYNISGKVNGQVTKWLNLDFNARFIREDISMPTFMKLYGDRFFSETTKLYPTMPLYDNNGHYTRNPKLMQLTSGGRSNSSKDTYFTQGGFHLTPIKGLGIHGQATLRTESYRHQYNVNKVYLYTYDNQPVEEAWLGGDPDLAAGKTFVQSETQQTSMMTTALYADYEHSWNKHNFKATAGMNSEYYYINNLEGKRYDVVNEKVPSINTATGTSNLKAYSKEWATMGYFARVNYDYDGKYLLEANIRRDATSRFRGDERWGTFPSVSVGWNIAREQFWEPIQDYVNLFKVRFSYGSLGNQNADNYYPTYSIQNITVGSVDEGGRWLLEQANKSSIASSPGLVSSLLTWERVTSYNIGIDFGAFNNRLTGYAEYYIRDTKDMVGPAEEISPIVGASAPKLNNTALRTKGWELQVNWQDRIGQVGYRVSLNLSDAQTEVTEYPNLDKTFFTKDSDGNIVDNYWKGKKLGEIWGFKTVGMAKTDQEIQDYIAIHDQSRLPNIGNNIWKAGDIMYANLDDNPAIEKGTSASDPKDLCIIGNSTPRYRFGITLGADYKGFDISLMFQGVAKRDIWVGGDDKTATQKGMIFWGINGGQWDSTGYEEHWDFFRPEGDELGANLNAYYPRPIIDSKQNQQVQSRYLQNAAYIRLKNLQIGYTLPKTLTQKINLQKVRVFFSGDNLWTGSKMSKNFDPELLYQNGMTYPISYTLSCGINITL

SEQ ID NO: 16183 - protein, 796 aa, Novosphingobium aromaticivorans
MSGHPRPARPTHRAGPRRVALAVFVLSMHGAAVPAQSAATPLPSNRTSSRTPVAPAQKIDPRTHAAAPPAPAPKAETLVVTRQATAPDARRFALPQTSAGIDRRTIEATVNIVDTEDALKYLPSLLLRKRNNGDTQATLETRTWGVNSSARSLVYVDDAPISALISNNNTNGAPRWGMVTPEQIERIDMLYGPFAAEYPGNSMGGVVLVTTRMPDRFTATVKQTGSVQTYDAYRTRGNYGTANSAVTIGDRIGRLSWLFSANREESLGQPLFFVTSSGMPAGTTGGIAALSKTGSVANVMGAGGLQHSTTDNVTLRLAYDFTPWLRLNYTVGYWDNQTRARSQSYLTNAAGAATFGGVAGFANDTYTYDEQHLMNAVSLKTRTQGHWDGEAIFTDYDYLKDIQRNPAGVLGGTNFTPNGYIARMDGSGWMTADVKGIWRPSGVGGAHELSFGGHRDQYDLENPTYNTGNWASSPAAGNGTLHSSGRGTTTTYALWAQEAWKFAPGFTLTVGGRLEFWRASNGFNQAGAVAASQPPEHSTNFSPKATLAWRINPDWTAKLSFGEAWRYPTVSELYQIVSTGGTYAVPNATLRPEQVFSSEAMIERRTHSGSLRLSLFQENTHNALISQSTLLNNIYTTTFQNVTEVRNRGVEFVAERRDLLIKGFDLSNSLTYVDSRILSDPGFQSSTGTTAAGKHVPYVPDWRDTVQATWHATKRLDLSAALRYQGRMYSTLDNTDRVGHVFGAFDKFLVADVHVHWHVTGPLTFDAGIDNINNARYYEYHPFPMRTYVADLKASF

SEQ ID NO: 16184 - protein, 459 aa, Novosphingobium aromaticivorans
MIGRKWRNFMLPNFFVFCVLCMGGVSPIVFAQGESSTDARSEVEELKQQLKLMEEAFARQQEQMDVLKNRIEIISTETKVVVKEETKQAVQDYFSTDEAKEILGVGMPDMIVEYTPDDKKSALSIRTTDGNYSLNIGGRLQMQYEYKDKDDDFGESDTQNIDVRRARLNFGGNIYSKDLHYYVEIDGDKFDVGVRDFYVYWTPLEELNTKIGYFKVPFNRQRLASSATLLLQERSIASEFFDQDRDYGVDLYGKPFDGYMEYHAAVFQGAGEDQADWFQGKDNFDNELMFVLNARYNPFGKYNYYDETDLAYSDTLKATIGASVAFNGKRKDVKEEDYDNITGVVDCGLVYKGISWNNEYYLMSRDPESGGESLESEGFHTQLGYFVLPKKLELAGRYSVIDPDDDISNDIQREYTFGVNYYFRGHRSKIQADFGHLVTEGEEEDKEENRVRVQYQIMF

SEQ ID NO: 16185 - protein, 211 aa, Novosphingobium aromaticivorans
MKFLSVLLCSVLCYLPTAWANVDLNIKYSSNYLMPAYVHFKADGAQYAVDAKINVPLYNIQFLSTGTQDAKQFNMVDYQDIRNGKPYATSKIQADSIEYGKVKNGLTKKALALPTFDLFTMAFQLSYYDKLPINFQITNGKKLYPMHNVFVKKSEAKVKVDKQEAVQITYQFKTGDKDIVVKKLAGEQFPRFISYNRDGDNYELEFSGFVK

SEQ ID NO: 16186 - protein, 409 aa, Novosphingobium aromaticivorans
MKNQPLTNKTSPRVKTIITLAVATSLSISFAHAKANVERENNEISTKASQDTEVNKSTESSFEDAWDFADLYDNEQGDYLKLSGRLQLDSTWVDSDQGDFNDTLWRRFRFGFKGKYGEFKVALEADVNLNDSLSDAYNRLTDANVSWSLDKDTELKFLKQSTGFTLDGKTSSKKLLTPQRNNLTNNLWFTSEYFTGVSVKSKLADDWSYKTGVFSSDGSDEISINDASYFAMFSTSKKLAKNNLWDKGEVSFDYVYNDTHEDGNTRDFSQVISTSSKFKQNDWGLQSDISWGKGDLGQSDLFGIVVMPTYQQSEKIQWVARYTYLSSSEDNGVRLGRYDSKVVDDYGQSSVDGERGDKYQEVYAGVNWFINEHKLKLQAGLQYAKMDDNANDGGAYDGWNFTLAMRSYW

SEQ ID NO: 16187 - protein, 511 aa, Novosphingobium aromaticivorans
MMKMRWLSAAVMLTLYTSSSWAFSIDDVAKQAQSLAGKGYETPKSNLPSVFRDMKYADYQQIQFNHDKAYWNNLKTPFKLEFYHQGMYFDTPVKINEVTATAVKRIKYSPDYFTFGDVQHDKDTVKDLGFAGFKVLYPINSKDKNDEIVSMLGASYFRVIGAGQVYGLSARGLAIDTALPSGEEFPRFKEFWIERPKPTDKRLTIYALLDSPRATGAYKFVVMPGRDTVVDVQSKIYLRDKVGKLGVAPLTSMFLFGPNQPSPANNYRPELHDSNGLSIHAGNGEWIWRPLNNPKHLAVSSFSMENPQGFGLLQRGRDFSRFEDLDDRYDLRPSAWVTPKGEWGKGSVELVEIPTNDETNDNIVAYWTPDQLPEPGKEMNFKYTITFSRDEDKLHAPDNAWVQQTRRSTGDVKQSNLIRQPDGTIAFVVDFTGAEMKKLPEDTPVTAQTSIGDNGEIVESTVRYNPVTKGWRLVMRVKVKDAKKTTEMRAALVNADQTLSETWSYQLPANE

SEQ ID NO: 16188 - protein, 760 aa, Novosphingobium aromaticivorans
MAQALIVRRAVPFTPLTVQRPVRSAMPTLRFPRKTALLPVCLAASFAGSPLMAQEQLEEGAQSSAAEPVELQSVEITASADASADGLTQPYAGEQVARGGRVGILGNQDYMETPFTSTAYTSKLIQDQQARSVSDIVQNDPSVRVARGFGNMQELYVVRGFTLFSDDISYNGLYGLLPRQYVAAEFIERAEVFRGASAFLNGAAPGGTGLGGAINLLPKRAPNEPLTRMTVGANSGGQGTVAADLGRRFGEGNQFGIRLNAAKRAGETGVEDENQTLDMFALGLDYQGDRLRLSADVGHQYHFLDNPRPSVTPNGGIPSAPDADDNFAQPWTYSKEKQTFGTFRAEYDFADAITGWAAAGVRDGEEQNRLSNPRATSEGSTTASRFDNHRKDRVYTGEIGMRFRVQTGAVSHEIVTSAAMHDFEEKNAFTFFGPVIGNIYDPFAAPLPTTVTFPGGDLSDPKRTEQVSTQSLAIADTLGFLDDRLRVTLGARRQGIETRSYAPVTGDRIDRYDAYETTPVAGILYQLNDELSVYANYIEGLTKGDTAPAESGGQQVLNSGTSLAPYVAKQTEIGLKYDGGNLGGSIAVFSTERPFGIVENQVFREGGEQRNRGIELSVFGEPAYGTRLLGGLTLLDAEQKKTLNGVNDGNDAIGVPKAQANIGGEWDVPGVQGLTLTSLVVHTGKQYASASNDLRLPSWTRLDLGARYRMTIDDRDVTFRARLDNATGRDYWASTGGYPGSNYLVLGAPRTLSVSATVDF

SEQ ID NO: 16189 - protein, 433 aa, Novosphingobium aromaticivorans
MKTTWLKTALAVAVGALSSQAMAAGFALNEQSISGMGTSFAGRSSSADDATTLFGNPAGMSRLKREEVSFGMAAIHAKTKIKNASAATPQIDALGGARLPLNGSNDGDMVPFTAVPMGYYVKPIDEKWAVGVGLYVPFGMITDYENGFQGRYHGDYSEVRVVTVQPTVSYRFNEQLSIGFGPTINRIDGQLESAALNRTSPGTADGRVKVKGDDTALGFNAGVLYEFSPQTRAGITYHSKVKYTLEGDTKLSGAGFAGATGKYDASLDLDTPESVDVSLTHELNDQWTLYAGAMWTRWSRFEAIIIENEGIPAPLQGSLAPIVEDQDWRDTWSYALGAAYKLNREWTLRTGLAFDQSPTNNVDRSPRIPTGDRTAVSFGLGWNPTDDITVDLAYSYLWEEDTKVRREHPTKGVYSADYENSAHGFGASLSYRF

SEQ ID NO: 16190 - protein, 774 aa, Novosphingobium aromaticivorans
MITININMRNNLNAIDNNYHLLTESFMRVVNKGLALPFTKKIMTQAVAIGIASISLNTHANTEVKELATTVVKEEKKDDYKVEKASSEKYQTSLLNTPKTITVVNEQVLKDQGVTSLNDALRNVAGVSTFGAGEGGGGNITTNDKITIRGFSANGNIYIDGIRDIAGYSRDMFNFEQVEVTKGASSSITGKGSSGGSINLVTKQAEQDEFSNAEASYDDAERLRLTLDHNTQLNEKVALRINGLYTQGGDAFDNGVEEYQTTAIAPSLRVDFNDRTSLIADLLYMKQDNNPMLGLPWVNADAAAQLGYKEGPLPTQFWNNYYGVAKRDFEDVSVNLATLLIEHQLADNILLRSQTRLASNEKQSILSRPLVRSSRDAETGKYTYFNEISVDWVQAIDQENDLFVTQFDAIFNLASGNIKHDLVVGAEYYQEETTRYTLSSSLKLNSNFVSIDKPNTNSPFSGEISRSGEPTVVKGTGLALYALDSITLNDQWLATVGLRFEDYQAEGSSYVRQVIDNKRVSVYVDDLSADGTFFSWNGSLAYKPNAQTNYYFGIANSQDPAGGDLAFSGSSLEGITRVSSLDPQEAKTYELGAKWDLFAEKLQISTALFLTKKTVLDTDLDGTYFLAGEQQAKGLEFSANGSINDQLSVLASYTHQETEVTQDYNPDTQGNGLSAAPEDSANVWFNYTLDKLSLGAGAQYSSGNIYWRRNTAYFDSGSQTILNVMAGYDVTDKLALQFNIDNLTDKEYVTDYSARGHFRPGNPRTMKLTVRYQF

SEQ ID NO: 16191 - protein, 871 aa, Novosphingobium aromaticivorans
MKNATNLKGLCSLLLLLVTTISLAQTKISGTVNDKAGMPIPGVNIILDGTTKGAVTDFDGKFAITGVEDGTYTLKASSVGYTTYNQSVNANGSAIVLKIKLADDAESLDQVIITGVVNPRSKIESSVSVTSMQPATIKQSAPRSTAEIFRTIPGIRSESSGGEGNANIAVRGVPISSGGSKYVQLQEDGLPVLLYGDISFGTADIFTRFDYNVKRIEAIRGGSASTLTSNGPGGIINIISKTGKNEGGAIGTTFGLDYNSFRTDFNYGSKIGDGLYFHAGGFYRAGEGVRETGFTANNGGQLKLSLTKEFENGSVRVYAKYLNDRAAAYLPMPIQVTGTNSDPDWGNAPNFDATRGSLHSANLTQTVRIGADGQIQRGDVTDGMNPLSTSVGMQANFDLGNDWKVMNNARYSANSGAFVSPFPSQVADATTIADSFGAGSTLAFTDGSPVSGNSLVARIHMFDVELNNFNNFMNDFKLSKSFDNLDVTVGYFKSFQSISMSWLWNSYLQEVNDDNARLINVFDAGNNALSENGLYAYGTPFWGNLHRNYDTDYNVSAPYVNFTLEASENFTIDASLRYDKGRVSGSFTGGTQREFDVNNDGVISVPEQNVFAIDNANPTAVDYDYDYVSYSVGLNYKLQDNQAVFGRYSRGASAKADRILFSGLDYLDGDRINALDFINQAEIGYKRGFENGAIYATAFYAKTEEEGGFEASTNSIIENDYKSLGVEVEGFYRFNDFSLRGAVTWTDAEVDSGDNAGNTPRRQPDFIYNVIPSYNFGNEKQNSVGLSFIGQSKAFAQDNNELVMPGFLIVNSFVNVGITKSLNVNIAANNIFDSLGITESEEGSIVEGQTNIVRARPLPGRSISLTLQYMF

SEQ ID NO: 16192 - protein, 903 aa, Novosphingobium aromaticivorans
MTGSAIRSVDVETQQPVLAISRKMIEQQGFTTIADVLQNLTSAGAPALSRSRTLSSGEDVGGSYANIRNLGATRTLVLVNGKRLGASTSGLQDLSQIPMSAVERIDVLKDGASVLYGSDAIAGVINIITRKSVEGLELSAQHGQFSQGDGKDSTFSLVTGARGERGGYTLALEYQKADPVFARDRWFSKHGGSGPGYPRAGWSDLSQNGSWCDPALYDCATGNSVFKTLNRGGDPKNPNDYHPITPAEYSNGNEQMHVQTGIERRSLFLSSDYALSDQITFTTDIGYNERISDQQIAGYPYESTKFGTPLAGNSAFNPVGHDIAFNRRLWELPRTTESKLKSLRVAPTLSGYFELASKTFDWEVGALFNRNEVTKTGRGDMSLIASRQALGQSFVDGNGVARCGSAGAPIAGCLAWNPLLPYGVAGAGSLADPELQRFLFPTFTDTGITKTRSYFANISGPVLELPAGELSVAMGYQYRKEEGRYVPDAFAQSRQSTALGAQTTAGGYSLNEVFAEVNVPVLRDLPFAKELTVNVAARYSDYSNFGSTTNTKASFAWRPVEELMVRGTFAEGFRAPSISDLYGGLGTSFETYVDPCGIGATNSVNGNAACNAAGVPRGYEQLAQGLKPCTSYPCATPNEFTTGSNPNLRPEESKSKTVGVVWSPRWVNGLDINLDWYSYKITNMIIEDNVDRILRDCYVLGNASRCGSVKRAADGHITSMFYGLTNLGAMKTEGWDLGIRYRLPEYAFGRFTLDLQNSYVSKYDEEKQNSAGDTIMDGRIGRPGVFRLRSNLGVNWQLGNLSAQYTVRYYSGMMEGCMPNRPCTAPERIANGEPDAVRRVGSNAFHDIQVSYRLPWDGTVAVGSNNVFDHRGPIMFSKPESSFPYYGGFDIGRTVYVKYSQRF

SEQ ID NO: 16193 - protein, 2098 aa, Novosphingobium aromaticivorans
MATITDKGTNGTADVQDLVVGDYGQGSLIVSDGGALESYSGSYIGSNNGSTGRVEVTGTGSTWGSSYWIYVGDNGDGTLTVSDGGAVSNAFSKIGRIGGSSGRVEVTGTGSTWTNTDDLVIGVSGDGTLMVSDGGTVSNTHGRIGHYSSSTGSVEVTGTGSAWINSSWLTVGDFGEGALKVSDGGSVSNANSNIGSGSGSTGAVEVTGTGSTWESSGTLDVGGDGDGTLTISEDAIVSVSGVTRLGSNATGSGVLNIGAASGETAVAAGMLDAPSVKFGNGTGVINFNHTDTDYIFSSAIRRNGMVNQLSGTTILTGANTYTGGTTVSGGTLELRGGSASSDSGEISITGGRLQVTNSETVGDTTVDGGALAIATGETLTTGAFTLVDGTVMGGTLLGSSYTVESGNIATALTGTGALTKNGNGTVTLTGTNTYTGDTIISGGTLELRGLSALTDTQELRVGYAGTGALIIAEGSEVNSENMFIGRVSGSVTVTGSAASLDVTTNSIIGLYGTGTLTISDGGRVTSGQASAIGGTDATGAVTVTDEGSVWEAGSLNVGQYGVGSLKIENGGKVTSDSTIIGFDSTSFSGTSSGLVIVTGAGSVWENRDRLVVGDKAPGTLTIADGAIVDADDVFILAYDAISQGTLNIGAAAGETAVKAGTLDTEEVRFGEGTGVINFNHTDTDYTFSADISGTGSVNQLSGTTILTGTNTSDTIVSGGMLVVNGTIGDVTINGGTLGGSGTINGSTTVTSGTIAAGNSPGTLTIVDDLNLTSASVLDFELGSPSGTAGVDSDLIAVGGDLTLDGTLDITDAGGLDAGVYNLITYGGSLTDNGLVVGTAPIGFLYNVQTATVGQVNLLVNPDQLSFWNGAVTSADGTVHGGSGTWSSAGSNWTDATGSASAPYQPDSTLIFQGTPGTVAVDSAGVSVSKGMQFAVDGYSVTGGDVVLNARSQFDNISFRVGDGTNLSTGFTSTIASNLTGTGSLQKTGLGTLVLTGDNTYNGSTTVSKGVLEFRDGATLSEGQFFRVGGSATASLIIADGSDVSARIYTFVATGAGSSGAVTVTGPGTRFQAGSTFGIGYHGNGTLSILEGGLVSGISGNIGSYAGSTGTVEVTGEGSHWKNDFGLDTQGISLAVGRDGTGTLTIAEGGRVTSQKGVIGSGAGSSGDVVVTGDGSLWENSHYMNIGLLGRGTLTISDGGVVEVENSAHLGRMTGSSGTLNIGAAAGDLALAAGVLDAAAVKFGDGDGVINFNHTDTDYTFSLAISGDGIVNQLAGTTILTGANTYTGNTIVSGGELVVNSTIGDVTVNGGVLGGSGTINGSATVTSGTIAAGNSPGTLTVGGDLNLTSASVLDFELGSPSGTAGVDSDLIAVGGDLTLDGSLNITDVGGFDAGVYNLITYGGSLTDNDLEIGLAPTEFNYDIQTATAGQVNLLVNANLLSFWNGAVTSTDGTIHGGSGTWSATGTNWTDADGTGSAPHDPDSFLIFQAEAGAVTVDSAGVSVSKGMQFATDGYSVSGGDIALTGATAIRVGDGTDAGTGYSTVIASDLTGTGSLKKTGLGTLILTGTNTFSGNTTVSGGALVVDGSIGDVRTDGGSLGGSGTLGAVTVNSGAVIAPGNSIGTMNTTSTVFNAGSVYEVELNNGGAAAGVNSDLLAASNTVTINGGTVHVMPENGTDNGSTYTAGTTYTIITAGGGINGTFDSPTPTDDFAFFNFALSYDPNSVFLTSELAVPTFCVSGMSANQCATGDGVFSLDSGTLYNAVLNLADEEAPQALDQLSGEVHASIRTALLEDSRFAREAVLNRMRIATGAVAADGQAQAEKRISESASFWGQGFGGWGSWSGNHNTAGLDRSVGGLFVGGDVLIGDNTRLGAFGGYDNNRLEVNGRRSSVTVDTVYLGAYGGAQFDALGLRVGGSYAWHDIDTARSVAFTGLSENLAGSYDARTAQFFGEVGYRFDHNTSSLEPFANVSYVRLSSDGYSETGGTAALTAGHETMDSTFTTIGLRIGTLADLGEFSAKLSAQAAWQHAFGGKEPFASHAFNGGSNFSVAGAPVARDALVLDVGAAVDLGEDAAIGLSYNGRFGSGLTDQGVRANLTLRF

SEQ ID NO: 16194 - protein, 1079 aa, Novosphingobium aromaticivorans
MKKLLSVLFLLSFTLASVYAQNIQVKGTVVSGSDNEPLPGVNVVVKGTTNGGITDLDGNFTLSVPADATLSITYIGFRSQEVAVNGKTSLKIVLQEDSETLDEVVVVGYGVQKKSVVTASIAKVSSEDLENKSPVRMDNALKGLAAGVDVTSASGQPGDSPRVRIRGIGTINNSDPLYIVDGMPIGGGLDFVNPNDIESIEVLKDAASGAIYGARAANGVILVTTKKGKMGKAQINYNFSYGWQSAWKHRDVTSATDYAVLQNEMRVNGGEKPVYADPYNLIDANGNAIKGFGTDWQELLFNDNAPVVNHDVTISGASDKVNYYLSLGYFSQDGIVGGNYGHSNYDRLTIRSNNQYNVIDASKERNFLNRLDVGVNIAYMRTHSTGIATNSEFGSALGSALYLSPILTPTLTGDAAKEMIDFYGAYDLPRDENGNPYTVPGYKGAYQEMNNPLAMMTLSPQKNWSHKFVPKFSVDLQLWDKLKYHFSYSADMGFWGYDKATTSRFYLSGNNNALHTSVENNKEQNVTWQLENTLTYDKTIGKHSFGIVLGQSALKYKGDYLKGSRWNLVNPGKPSIDYATGNVEYIYKTDGSGNPILDADGNKIITGVTVQHGVSGAPRVEHRMSSMFLRLNYNYDERYMFQATVRRDGSSRFGSNNKYGTFPSVSVGWNVMNEAFMENTRDWLSNFKIRGSWGKNGNDNIIEFGYTSLTAMGNNVLLGKDAIKWIGSKAERLANPNLKWEESEQTDLGVDLGFFNNALTFSADYYIKKTNGMIMEMPIPSYVGESKPYGNVGDMENSGFEFELGYKWNVGDAHFAVKGNATYLKNELKNLGNDTGYMDFDGIQGLSGGGTRGSNGKPFPYFFGYKTDGVFQNMDEVRAYVNKDGGMIMPDAVPGDTRFVDVNQDGQISADDRTDIGNGTPDWTYGLNLNADWKGFDFNIFFQGVAGADVFDATWRSDVASGNYPSWMLNRWTGEGTSNKYPRLATGNATNWLVSDLYVCDGSYLRLKNITLGYTLPKTLTRKLTIERLRVYVQAENLVTWTKYWGFDPEISSGATSLGVDRGIYPQARTYTVGVNVSF

SEQ ID NO: 16195 - protein, 367 aa, Novosphingobium aromaticivorans
MKSIRKPSHLLMLAMAAACGGEASAQSAVTLYGRINTALEYSYANTATDGTRLGGVGRLTNNRSVFGMRGEEGLGGSLKAIWQIESNFSLDTGQGQVAGRNTRVGLQGDAGTLFLGHWQTPYTESTMAYDPYYPTTAGYMALIGNGSTSSSDNVQDTSSFDRRQKNIIVYKSPSFAGFSGAAAWGVNEEKTTVPRNPGLYSFSAAYDNGPLNVVLAYEVHQHYQTAGRNDDAMKAGVSYKFPTTTVALLYERLHYRTATGDLTRNGYYASLVQKLGPGSVRVGFGLASNGAGNATETVGFFRSGAETGATQVTVGYDYPLSKRTALYAYYSRINNKRNAIYDFAINELGVSAGSDPQTVALGMRHFF

SEQ ID NO: 16196 - protein, 876 aa, Novosphingobium aromaticivorans
MGALAVALAAPVAAQEQAPAPAQAERQGGVRTIVVTAQRRSEDLQDVPVSVSAIGAQELEELNIDTFEDYLEQIPSVTAGGNGPGQSTIYIRGLASTTPNITVAGVAGLAPNVALYLNDQPLSQPGRNLDVYAADLERIEVLSGPQGTLFGASSQAGVVRLITNKPDLNGFSVNGSAGVSFTKGGESSYQGEVTVNVPVTDTFALRGVVYLDDQGGYIDNVQGTRDLTESARFRPEGFVRENGVPVNANRAGFQSTSDLSGVTFLETNNAGLVEDDFNDTQYAGFRISGLWEVTPDWTVNVSHQRQSLESDGVFFADPELGGLDDLEIERFEEDRLEDDFSNTSWTVEGRIAMLDVIYTGAYTDRESDQRADYTDYLFAGQYLPYYICDGSVSYPGSADPSGTCQPPNLYINSFSKTEVFTQELRLSTPDDWRVRFQGGGFYSDLSLEERVDFAYPGNVAAAPFGPFKTNFPQMTGFVSDPGPFPADTIFRNDIRRTDEQFGIFGEVSFDIVPDLLTATFGARYYDVEVDFEGSANGSFCNSFSAEDQNAFGTDISDLYNGDGVFNFIGSCDPALRQTFDLNDTLEDIQNAGLSAGQAQQVFNAIRAPDTASTSGTIFKGTVTLTPTPDLLFYATYSEGFRPGLLNRPGGAVAPGTGFVVPFEVDTDEVKNYELGWKMDLIDGQFRFNGSAFFVDISNLQTQIFDPSITNLFFSSNAADAEIYGIEADFVIAPFSTPGLTIAGAFSILDTEITDVLIPTTDVIEGEELAYAPGFQGNLRARYEWDVSDELTAYIQPQVSYSASKFTDIIEINKIELDSYTLFDLSVGVKAEQWGFEIFGENLSDERAEISGIFGNDRERIITNRPLTVGARVTFNY

SEQ ID NO: 16197 - protein, 355 aa, Novosphingobium aromaticivorans
MTTLRLRSPHRCRPPALAAAATLAALSGPAHAQSTLTLYGVADAGVQYLSRADGRHAAWRLQNYGILPSQLGIKGEEDLGGGWRARFQLEQGINLNDSTATVPGYAFFRGAYVGMGGPAGTVTLGRQFSTLFDKTLFYDPLWYASYSGQGVLVPLSANFVDHSIKFQSATFAGFDVEALAAMAGIAGNTRAGRVLELGGQFTSRGLSASAVLHRSHGTAQGGADRSAQRRDIGTFAARYAFASLPLTVHAGVQRLTGELDPARTIVWGGARYQASGRFGFAGGIYHTDSPTPQVGHPTLFIASTTCSLSKRTVAYLNLGYAKNSGRSAQTVYEYDPTPLAGASQFGAMLGMYHVF

SEQ ID NO: 16198 - protein, 502 aa, Novosphingobium aromaticivorans
MKRRLLTALLLSSALVLPCAQAQAQTVAELQRQINELKALIKAQSEAQGRGGRGPLRQANARNTDAGTFPAAGRPKESAIGQPAAPGPVPHRFAIDEPETWYDALVPPAPQLLADGPNHSARPKTWFERLSLRGYTQLRGNEFLSGDDTAPAGVSRLRSVHDSGITDRNNFTFRRVRLVLQGDIHERVFLYIQPDFAVGVGDRQHFTQLRDAYADVFLDDERRTKLRFGQQKVPYGWENLQSSQNRLTLDRSDAINSGVPGERDIGITFYYTPAHVQRIWDRLAKGGQKLFGNYGALGVGIYNGQTINRVEGNNDLMTVMMATWPFELDGLGEAFKGQVVEVGGSAYRNRFRPEATFGSSTALGNTFDDERVGVHAMLYPQPFGLQGEWNWGRGPEFDPVARAILTKPLQGGYVQAMYKVDHSPVGPFMPYIRWQTYDGGWKVGTNAPRLDTDEVELGVEFQPIKSVELTLAYANMKRREASSSRFGRAEGDLFRGQLQINY

SEQ ID NO: 16199 - protein, 182 aa, Novosphingobium aromaticivorans
MRFKGVVAFISLAVALGVLAYLFLSVKKEMPATSHAISQTHAISQTNEGLSQTDAKSHDIDLEENSPTETSHNEKASHNEEDHNNALSQNLDAQESINYPVVEHYSEIPFEEKKREYSKLIIKDLKDYQWWCLKEILKKEQIDYAYDNTKNQPNLIIYLDENKKERLLADLDYYKIRYHAVF

SEQ ID NO: 16200 - protein, 347 aa, Novosphingobium aromaticivorans
MITPRFIRTAAAVAVAACGAVAHAQSTLTLYGALDVGVQYLTHADAHRSAVQLQNYGIVPSQIGIKGSEPLGGGWRALFKLEQGINVNDGTATVPGLAFFRGAYVGIAGPIGTVTLGRQFSVLFDKTLFYDPLWYASYSGQGVIVPMSANFIDRSVKYQSPTFAGFDVEALVATAGIAGNTRAGRVLELGGQYTSNGLSVGAVLHQSHGDVSATDDASGRRRELGTLAARYAFAALPLTVYAGVERRTGDLDAARTIVWGGARYLTAGGIGLNAGVYHTDSRTPAIGHPTLFIASTTYALSKRSVAYVNLGYARNGNRSSQTVYEYDPTPLAGASQFGAMVGMYHLF

SEQ ID NO: 16201 - protein, 209 aa, Novosphingobium aromaticivorans [sequence omitted]

SEQ ID NO: 16202 - protein, 427 aa, Novosphingobium aromaticivorans
MRGKAINTMTRAVKPRRFAIRPIIYASVLSAGVLLCAFSAHADERDQLKSIQADIAAKERAVRQKQQQRASLLAQLKKQEEAISEATRKLRETQNTLNQLNKQIDEMNASIAKLEQQKAAQERSLAAQLDAAFRQGEHTGIQLILSGEESQRGQRLQAYFGYLNQARQETIAQLKQTREEVAMQRAELEEKQSEQQTLLYEQRAQQAKLTQALNERKKTLAGLESSIQQGQQQLSELRANESRLRNSIARAEAAAKARAEREAREAQAVRDRQKEATRKGTTYKPTESEKSLMSRTGGLGAPRGQAFWPVRGPTLHRYGEQLQGELRWKGMVIGASEGTEVKAIADGRVILADWLQGYGLVVVVEHGKGDMSLYGYNQSALVSVGSQVRAGQPIALVGSSGGQGRPSLYFEIRRQGQAVNPQPWLGR

SEQ ID NO: 16203 - protein, 373 aa, Novosphingobium aromaticivorans
MAIRSTAAVAILGVAAQAQAVSFETGGYQTDIYGYARLNASYDIDSNQALSTRSGSYSGLVNNDDAADGHFGADAFQSRIGVKTVSPEGVKINVEGDFRGGGGGSLRLRHAYGEYNGVLMGQTWSNFTSFVGNTSTLDFDSLPGVAGYQSRTTQARYTTGPLSLSLEDPQSSFVTAPANAAQKDSLPALTARLQDSAGGLSYSAALLAHQVGYDTGSEDESAMGFATFVAAKIALSDMITVQGSLSYTDGANSYLYRSGENFGAASAYVDPASGDVETISGYGGTVGAGFNLGGGRSINVGYGIVEVDWDDAEDDGVAVAGQSESNSAVMANYQWTPVKNVMMGVEYAFLKRENVSGDDGDASRILFAAQYNF

SEQ ID NO: 16204 - protein, 697 aa, Novosphingobium aromaticivorans
MKLSSLFALTPLALALSVQAQTPQTNTDDVKEADVEKIRIVGVRQNRVSRGATGLTMEVSETPQSISILSEDLMQSFGAFNINDALKLAPGINVEEWETNRTNYTARGFEIKNTQIDGVGLPNDWGIVTGSVEAYGYEEIEVIRGANGLLTGVGNASGTINYVRKRPTNEEGGEIGASIGSYNFKRVQGDYSMLLTEDGSWAARVVGSVEDKESHLDGLENDRSFVYGVIDGQLTDNATVTFGLSYQDANTDGNTWGGLVFNYTDGTQAEWDINDTTTQEWTKWDTETTNAFVELDYVFDNDWQLLLSYNYRDFEDQSKLFYAYGAIDKDTGLGLVGWPGRYDSERDSHLVEGRVFGDFELFGRNHEVNFGVSHATSDDVSFVHAFDYATTPAYGPTPAFPYALDAIAEPDWLDVSEYSNIEQTLTRYFGSARFSVTDDMHVIAGFNAIDFERKGQNAGAVIDNSESEASPYVGATYAVTEDVNAYVSYSDVYQPQEQYDINGQYLDPTKGQNFEAGVKAQWFDNRLLTTFAYFTAEQDNLAAYAGTNPDTLQYYYEGVSVESDGFEIEVAGQVTDALRVNASYTNIDVEDEQGNDANLWAPRDVVTFQLGYTIPQAPEVEVGFGGRWQSEISNVDYNVKQGAYFLGNVYASRAFTDDLTVRMNINNIFDKKYINSLHTVGYYGAGINAQLSASYTF

SEQ ID NO: 16205 - protein, 989 aa, Novosphingobium aromaticivorans
MPGANPASEEVMSLQRPIPSLARPLSRLSPLTLALRWALLGLSAAGAGLLGSGLAHAQSVGQHSAATRLDDATPRSYDIPAGSLGASLGAFASQSDLLLSFDPELTRGRTAPALKGRYSVLEGLQRVLSNTGLQVAAGTSGAYLLVEPRMSGEAPADLSPVVVSAAELADPQKETYTAPRSSVYLSSEDIDRFGRVSVGDLLQGIPGVQVGDSRNGGALDVNIRGIQGQSRVAVRVDGAEQALDVYRGYAGTQQRSYIDPDLVSSVTVDKGPSTRSGAIGGSVEMRTIGVKDILVDGKDLGVRFTGDVWNNGVAPQHRSASSKTENLSSVPHDDRGSLFGSQAKSGSAAFAYRNEHLDLVAAYAQRNQGNYFSGKKGQDRYRVYNRYGREESSVAKVYNAGEEVLNSSSETESYLLKATWRIADEHTLDLGYRRYDGRTGEIMPSDIFRFGTAGIYQYPLSEVKIDTYTARYRYLPENNPLVDLSTGLWMTEAKSDMLTSVLAPRSQAYRSDRNWTRQDNRRIGGDLNNVARFETDFGDFKLDLGGSFQVEDIQPQKSVVTTLHDINANRTLRDATRQEYGLNGKLEFKPVERLTLWGGGRYSHFNSKDNGISASPRREDRDMRFITVSRPGYYGSMMWFPDQNGQYTDATDPRLNNGIVTNNTNNPFEGIPFDEFGPANVTVHPSRVTNVVTGYNYSKKGSSRGGGFSPAFGINFELAPDTFVYASYTEGLRLPSLFETSQGTLQVEPGKDLKPERSRSWEIGASALRDSLLADGDSAAIKLAYFNNTIKNYITRYYDPGQMGLMTFSNTDSYRTSGLELQSHYDAGRVFADLSATYYLKTETCDAAFAARLRAGANRYQRTENTPNCTPGSFMGSYTNTQNPPRLATNLTAGLRFFDQALTLGGRMTYTSGPTATADKPWQVGATTPQIEYRSVQLFDLFLKYKLFEHTELNASLQNLTDRYYLDPLAQSFMPAPGRTLRVGMQAKF

SEQ ID NO: 16206 - protein, 484 aa, Novosphingobium aromaticivorans
MLHQLTLAEIARALADKQFSAEELTRTLLGRIRQLDPQLNSFISITDDLAIAQAKAADERRANGENGALLGAPIAHKDLFCTQGVRTSCGSKMLDNFVSPYDATVVEKLTAAGAVTLGKLNMDEFAMGSSNQSSHYGAVKNPWSLDRVPGGSSGGSAAAVAARLLPAATGTDTGGSIRQPAALTNLTGIKPTYGRVSRWGMIAYASSLDQGGPLARTAEDCALMLGVMAGFDPKDSTSVEQPVDDYLAALQKPLSGLRIGLPREYFGAGLDSRIADAVLAVVEELKTLGATVKDISLPNMQHAIPAYYVIAPAEASSNLSRFDGVRYGYRCDAPQNLEDLYKRSRAEGFGSEVKNRIMVGTYALSAGYYDAYYLQAQKIRRLIKNDFVSAFAEVDVILGPTTPNPAWKIGEKNDDPVSQYLEDIYTITANLAGLPGLSMPAGFVDGLPVGVQLLAPYFQEGRLLNVAHQYQQVSDWHTRTPAGF

SEQ ID NO: 16207 - protein, 690 aa, Novosphingobium aromaticivorans
MNFRTTLTLTLIASLLIPNALADETPQDETVDLDPLVVTSADATEPGRITFDPQIAIQPLPANDGADALKHIAGFSVIRKGGTDGDPTFRGMAGSRLPVLLDGTCTLGGCGQRMDPPTAYVFPSSFDQVTVLKGPQSVQHGPGASAGVVLFERSAPRFTATDSSLKLFSNIGSFGRRDLSVEALTGNANAYARFQGSTSQADDFEDGDGNVSNSSYERWNAQLALGYTPSETSGLEFTYSQSDGEAAYADRMMDGVSFDRTAYALRYRADQLDGPVRAIDTQVYYNYVDHVMDNFSLRDFTPSMMMSMPMLSNPDRQTYGASLKLELDRRGKLDSTLGLDTQSNRHRVRTAMGPATTSYQSNPWQEDGTFDQVGVYGEFEYTLSEQNNILFGARLDDWQARDKRAQLRVGMMNSSMMPNPTANTKSSDTLASGFLRFERELNQSGSKLYAGIGHSERFPDYWELFSKESETSISAFNTAPEKVTQLDIGSLHNWGDFDLSLSGFLADHQDFILIESAYPKSMGMMTRMATISRNIDATTWGGEAKLSYQNETGWYTSGSLAYTHGTNDTDHLALAQISPLEFTLEGGRRREAWSFGWLARFVAEQDRFALHQGNIVGQDIGPSESFAVLSLHSSYRINEYWNLASGIDNLFDETYAEHISRAGAAIAGYTQTTRINEPARTLWARMTAEF

SEQ ID NO: 16208 - protein, 1061 aa, Novosphingobium aromaticivorans
MRERKLVERAVRISGMFVLLSGMGLQPCLASHSYNAASAGVVQVEQQKQKITGCVLDVMGSPLPGASVLVKGAPGRGAITDMDGNFSVEAEQGEQLEISFIGMETQVVTVSAKTRLQITLKEDSKTLDEVVVVGYGTQKKANLTGAVASVSAETLESRPITNLSQGLQGMIGNLNISADNGAPGKGYGFNVRGTTSINSSGPLVLVDGVQMDPNMINPADVESVSVLKDAASASIYGTQAAYGVVLITTKKGKDEKAKISFSSNWSINSPTRKPEYMDSWTFANFHNLTNRNSGGGDYYDKNYMDHIYAYYTDPKHNLPVFIDPSNPNKYLYCGNTDWIDETIKDNTLMQQYTLSLNGGSGKTAYYGSIGFLDQGGTLKHYDDKYRRFNVNLNLTSDVTNWLQVRLKTVYNNTYRDAPYGSNNSDETAQINSAFYGADLRPMMPVYHPDGNFSGQGSWTNMVATQAISGERKNKENDLWLTGGLKITPLKDWTINVDYTYNMYILSKKQHGKEILEHTANPDIVTVFPHTTPSRVKFTTDDNYYQTFNAYTDYSKSLGKHNIKLLLGYNYETKSYRWFNAERENLISNDLAGLGQAYGEKYNGSGQHSWATMGYFARINYNYDERYLLELNGRYDGSSKFPKDKRFVFFPSVSAAWRISSEAFFEPAKKIVDELKIRASYGSLGNQSVGGDYPYIATMGTNGEMGYLVDGKKIASVSPGGIVSPYLTWETVRQIDLGLDWALLNSRLYGTFDWYMRKTLDMVTNGTPLPAVLGTGAPQANTADLKTTGWELSMGWRDRVNKDFSYDVSFVLSDYQAEITKFNNPQNLLSTHYVGKKWGEIWGLVTEGLFQSAEEVSAHADQSEIYGGGWYPGDVKYKDLNGDGKINKGKNTLDDPGDQKIIGNSEPRYSYGIKGGLQWRDFDFDVFFQGIGKKDVVLGGNQFWGFGNEWHVPFKHALDSWTEDNRNAYFPRSTYDNVTGNRETQTRYLQNAAYLRLKSITLGYSLPKALLAKWKIDHVRFYVSGQNLLTFDHLFDIYDPETVSLSTYPLTKSVSFGLNITL

SEQ ID NO: 16209 - protein, 315 aa, Novosphingobium aromaticivorans
MRMKLLGIVLTAPVALSSFASTGAISFTPGNISTDISLGTLSGKTKERVYNPDEGGRKVSQLDWKFSNAAIIKGAINWDLMPWLSLGANGWSTIDSRSSNMVDKDWLDPHNVGTWTDESKHPNTRLNYANEFDLNIKGWILNEPEYQLGVMAGYQESRYSFNATGGTYIYSENGGFRNEMGSFPDGERGIGYKQRFKMPYIGFIGSYRYDSFEFGGSFKYSGWVEASDNDEHYARAITFRSKVKNQNYYSIAANAGYYVTPHAKVFVEGSWNRITNKKGDTAVYDKNTGASDYSKNIAGIENYNFMTTVGLKYTF

SEQ ID NO: 16210 - protein, 1047 aa, Novosphingobium aromaticivorans
MRPKVILNLLFFLFCCTAVQAQTGRQITGKVIDAMGELPGVSVVIKGTTNGTTTDLNGEFKLDNVKNGDVLQFSFIGYKTENVKVGNQSKFDITMTENTQTLEEVTVVAVGYGDVRRRDLTGSIGSANMGDLTKTPVSNITESLGGRIAGVQVSSGDGGPGDNFNIVIRGAGSLTGSTAPLYVIDGFPSESSGLGSINPNDIESIDILKDASATAIYGARGANGVVIVTTKKGGAGKPTITYNGSVKVGLVKNTPEVMNAYDFVMLQQEIMGSGEEFQKNYITELYPTLDAYHNAKSYDWQDYIYRTALSHNHHISMTGSQGDLKYTTSLSYDDTQGVIINSGVKRYQGRVNLSQKVNNKLKIDFTGNYASTVQDGPTVSSATSSMSTAYMYSVWSFRPVSPTGSDLLNQMYDEGVNMSEDYRFNPVKSAQNEYRHKTTNNLQFNVGAEYEIIKKLKLKVTAGYTSTDYKNEEFNGSQTRTGNSHPSNTQSKGINAYLYQSEARSYLNENTLSYQLNKNSHNFNAMLGMSVQKNTSYIHSIRTEKISNESFGMAGLDKGSTPAVNSSKGENKLMSYFGRINYNYDSRYYITATMRADGSSKFARGNRWGYFPSGSLAWAFARESFIAENASWLSNGKLRFSYGQTGNNRIGNYDYMAHLITDDDLYKYPWNGQFVPGYVLSSMQNEKLKWETTEQLDLGLDLGFLDGRINLNMDYYIKTTKDLLLDADISASSGFSSATLNVGKLRNSGLEITLETTNIKTKDFSWNSSFNIAFNKNEIIALNSGQPYMTSYISWDNKYKTTPAYISKVGESAGKMYGFIYDGTYKYEDFNKTIDENGKEVYTLKEGIPYYVAGTQPGDPKYRDLTGEGEINDKDKTTIGNGQPKHIGGFTNNLVWKNFDLNIFFQWSYGNDILNANRMVFENPSAKQNTNMFAAYTNRWTPENPTSNIPRARAQGSNEYSSLYVEDGSFLKLKNISLGYNFEAKTLKPLHISSARVYLSAENIATISGYSGSDPEVSTRNSPLTPGFDWSPYPRAFSMSLGLNVTF

SEQ ID NO: 16211 - protein, 416 aa, Novosphingobium aromaticivorans
MAINTFLKHSFLVCLLAVNSYAFDWNIFKYNLGFNMFIMDHEGSTPYWVNTNTNLKTRLTPNFGIQFYTRGVEQSLTVGAYFFQNFHNYSTNFPYRWGPTMYYKARGKRFTFYGGIFPRKNLLGRYGLNIFAPYYWFIDPNARGFLLQFQNHYSPSKPYYGHAEFMLDWFGGNCYNTCKFGRNPYGNAMDRFQMNGSVAYNFFKDLLGIGGYFVLFHNEDKYLLNGADGMQFNEKKAIDNSAIYLLDRLYYNAYISTSLLDIAPFMEKLSAKFGMVSEASRLRNREKEVPFINSVGGQFDVEIQYKGFGIHNLFFFAKTPEMPFYNQYQYVEMYCTPSYCPTPIYRGVPFFQANMYNRFDFYYNWKNDFASVRINFVLNAMRGGFDRSLPWSESYQVYMTVAFDPYNLINKIARKK

SEQ ID NO: 16212 - protein, 400 aa, Novosphingobium aromaticivorans
MKSRYILGLFTLFVCLVTNAQQISDTSFGKGLINYTAKDSTFSVKFAPRIQTRFTSNWEYNGTEYDDPAYNFLVRRARLKFNGFAYSPKLKYKIELGLSNGDLAGANEYNKNTPRYIFDAVIMWNFHENFELWAGQTKLPGNVERIVSSGNMQLIDRSILNSNFNIDRDVGIQLHHTTELGGNFIMKEKLAISQGEGRNVTEGNEGGLQYTGRVEFFPFGSFESRGEFTQGDLKRESTPKLMFALVYDFNNDAVRTRSNSGTYMILDDGSLYQTNITTIFVDTMFKYKGFAFMGEYTSRNADKAAAINPDGSTTGDVVAVGNAFNAQASYLFDNNYELTTRYSTVDFDDIIGEDLQTQYTLGVSKYIVGHKLKVQADISYGTLDGTKDHIMLRTGFDLHF

SEQ ID NO: 16213 - protein, 264 aa, Novosphingobium aromaticivorans
MRPRAVSTAVDNISFQSFIPVLKMNCCIPFIQGGLTMKRFCRLLVLFGLVAFLLLATAPAASAQKPGPYIGVFGGLAIPDDLRWGWGDYYDDWGYDEDPDESWALGVKFGYIFPQLSYMAFELEYTCLGDQDYGQTWSYRRSNGDQVIDSYDGDFSAHNVMANLLFRYPYGRVHPYVGFGLGLSMGNITEKGTREVNGQLYDSYDIDEDDAAFATQFILGVNFEIAPNLSAELAYKYFYSEYDIINYDIEAEDHLFTLGLNVHF

SEQ ID NO: 16214 - protein, 1025 aa, Novosphingobium aromaticivorans
MGMKHSTRTHGQDALSLAVALALAAAVVPAGAAAQQATTSASQEATNLDSVQVTGYRYAIEKSLEQKRDANAVVEVITAEDVGKFPDKNVADALQRVPGVVITRSGGEGKSVSVRGLAPDLTLTQLNGNYVATSETNDEATRSFNYTLLPSNMLSSAELFKSPEARIDEGGIGGTVILHTRRPLDMESNSGFVTLEGTSSDTHHDIDPQASALYSWHSKDERFGVLVGVTQQKRTTRTMEASTEDYQWYGAGKARDAYGNVQQQDGIHYWWGKSGFNNQTGGNYSDFFMPTSVNFAVKEEKRERKGGQLTFQFKPVDNVTMTANYFRFELQGDYTQNMLKIPEWSMARFNGDGNWAGGRLLNGLDFDPSGNTVTGAQFEKLAGKTYYCSEDQAKAAGLKPGGWGPDDCTIPTPQLTGGYSKEKALSQTADLTIDWDISPLWKASFTGGRTWSEGGPSMNFRMSAKPRRKVGNDYLSGNQYSAWDLTGTPSATFSPDLQQQLMNGIAEVDTGSTDSSWKRTEVKQNYFQADVTKLFESGWLDSIQFGAKYRDGKVHRNTGNTYWVCPGRDPADYDNSRYQSGCDPTAGDAQPGFFLSNPISNIAGGFNANVFPGINYPAYIDYLNKTYGGSHNRTEEDFVYNVNEKIYSGYFQANFRTERLRGNVGVRVVRTKQFAQSSDSIEKFNDYFLDNASGAPMACTDPAAAAYPTYSCESGFVRLPHDLAQSKTYSLIGVDRTYTDVLPSFNIAWDITDTLVLRGAASKVIARPGYTDIAAPGALSYYSEEYVNDRRVAGGASTAGWVGQGSNKQLEPFKATQFDLGLEWYFQPGAVAGVSLFRKNVDNFTLPVVRDTPMVINGEAVNVQRYETQANGRDGVSQGVELYGQYTFDFGFGVQANYTYNDTNLASIVLDGQEIGSSPLVGSAKNQANVTVFYENEKFLARASFNRRGQVVGGLNNGLTVYTEPYDQLDLNVAYNLTPDWTLTASVINATKSEQRVHLGSDTKARLISNTYAGRQLYFGATWKF

SEQ ID NO: 16215 - protein, 1197 aa, Novosphingobium aromaticivorans
MFRTRILVVFLAALFAVTGLNAQVAGRLSGSIVDQTGAAIPGATVNLFIPGGKEPVVSGSANETGLFSFIAIRPDTYDIVVESKGFNKAVVRSVKVAPIQETGLPPIKLEVQSATTSVEVAADVQSVQLTNAEVSSTITSQQVQNLPVLGRQVSTLFQTQAGVTSGSNTTSVNGLRSSFSNVTLDGINIQDNFIRTNDLDYAPMRTTIDQIAEITVSTSNGSTAMGGGASQMVLSTRSGSNTFHGSAYWYNRNSALSANDWFNNQAGVNRNRVDLNQVGAALGGRIIRDKLFFYTNYEVYRNKTQTSTLRTVLTDAARNGNITYRDAAGNTFTKALSSIRNYTADPTIKAMIASLPAGNTSAAGDGLNTTGYRFNAQGNENRDQFVYKGDYYLNAKNSFTGTYNHISNPTLRPDTGAFYTTTPPVSNTIKDNLLSLSWRWTATPTLTNEVRGGFMRADTAFLDSNQYPTSIVSGLLFSSPVNTFLNQGRKVNTYSIQDNATWLKGKHELSFGFQSQLLSVSPFNDASILPTYTLGISGAFTNSLTAADLPGIRSSDLTAANNLYANLAGIISSAAQTFNVTSTTSGFVPGATNLRQLSYSTYAGYIQDKWKLRPNLTVNIGMRYEYWTPMDEKNSLYLAPRLENNDAKATVLDPNAVLDFIGKSSGRPMYNADKNNFAPNIGFAWDPFKQGKTSIRGGYMIAYVNDNLVTTVRNNVGTSSGLSSAASQNNLTAFLASAPAIPTPVYKVPRTLADNYALSKTSATGMPAPGLVTPYVQQWNFGIQQEVKGGAIVAARYIGNRGTNLLRVIDYNQININANGFLADFLRAQNNAALAQKSGLGYVGTYNANVAGSVPLTVFPLLGGGGNLTNATYQNYLLQGQVGELANQYMTAGTNGSVNFYPNPNVQGANVVTNGGESIYHAVQFEVTKRTRAGLQGQFSYTFGKSLSNTAGDSQTGLEPNLDNNNPQLEWARSPYDVRHAFKANYYYELPFGKGMKWSGNKVTNAVLGNWAVSGIWSYQAGAPYSVLSTYGTLNRAARSTATNTASVNGTTLGQLAPLMEGLYMTGSGPYFVSPSVIGSDGRGAAQAGTSPFSGQLFYNPTAGNVGNLQRRLFTGPWQWSWDMSVKKTFHIKERHSVALGADLINWMNHPTFYVPPSTGGDYGSTTNFNINSATFGKITSMNYNPRVIQLSLYYRF

SEQ ID NO: 16216 - protein, 779 aa, Novosphingobium aromaticivorans
MTNHLRIALLASVAFAAPVAAQETSPDADVRSVTDDVITVTARFREETVQDIGASVAGISGAEIRERGIQDIEDLARSIAGMANVKTRQNSNDIAIRGVRSAGSGYETSTVFSVFVDDVSVTGAGNLRDFSSVDLNRIEVIRGPQPTLFGEGAVGGVIRYFTNDPDLDGPRITGEAAGRYETITDGGTAYTVQNATSLVLVPGKVGLRLSGFHRNDDGFIDNPSEGEDVNDFETSGGRAVLLAQLSPRLEVRLSAFLSRDELGESTQIDPGSDPEDLTFSASPRSGSYTDDFDLYAGRVTYSFDAIDVTSITGYYERSTASALFSAGNSFGLAPFFPTIDTTAFNTSSSEFEQFSQEFRFVSDFSGPLNFTAGVYYRDREDVSGQFLTGDGFVTVTNPSSSNLATRLSSTQSEQYSAFAEFTFELTERLRLIGGVRYVNDTVTAILQQDDVVNLVPQFDGQGNLIPWTESNPIGFVSTLDLLTGAGFGTEFEFELEKFLPRAGVEFELSEDMLLYANIAQGARNGGIGNAIAALGASGGSQDVFFQNLTFDDDQVLSVDAGVKASWFDGDLITNLGVFHTTYEDTQIQVNTPANNTVNGPEQTILGLELETRLQVNDSLSTFLNLSVIDAEFDQGKLITSAPGGTYGQFDLRKGNAPANIPEYTLAAGYSFERPIGASGWSLNSNGSFQYVGQRFSNVQNFESAELDSLELLNLRIGVSNDRWGLHLYGTNLLNDVEAVSIGSNPLQQFVTADGALDAPIIAASVNRPRAVGLSLSLRY

SEQ ID NO: 16217 - protein, 1046 aa, Novosphingobium aromaticivorans
MMSSNRLKKKKMKAYITNRIYLMLFFCSITIMAQAQQKFEISGIVQDETGQPVPGVSVYVKDKTGIGTNTDMDGKFVLKVDRGDKVQFSFIGYTRHEYLALKTEKKLVIQLVPDVSALDEVVVEAYGSKTRKITTTGAVTSVDVATLQTPATSLANMLGGRVAGIISTQGSGEPGKNISDFWIRGIGTFGANASALVLIDGLEGSLNDVDPADIESFSVLKDASATAMYGVRGANGVVLVTTKRGKQEKLSFTARANATISWLKRLPEYCDGYNYAKLANEALVVRGDDPKYTNQELDIIKYGLDTDLYPDVNWQDEVLKRSYWQQTYYLSARGGGSIARYFISLNGSNETSAYQQDKSSKYFKGLAYNTFGLRANIDIDLTKTTKLYFGVNANKTIRNLPGAADTNLIWSACSKLTPVTIPVVYSNGMLPSANGVTDEMSPYVLLNHTGLKQEEEFTSTYTLSLDQDLGMLIKGLKLNIQGAYTNDNAFHETRYIIPELWSYDKRNATGELAGKRQTERITTQYSKWEMQYRKYFLQATMNWAHDLGHGHTLTALAHYEMSDQKRSTDANDTMSAIPVRYQGLSAKVGYNYNDTYIVDGNFGYTGSENFQPGRQFGFFPSISGAWVPSSYQWTKDKMPWLNYFKIRASYGLVGNDRITDKRFPYLTSINVNGSATTNWKYTKGGIWENSIGADNLEWEKAKKFDVGLEGKLFDKFEFVIDFFRDTRDGIFQERKQVPDFVGLVNMPFGNVGSMVSWGSDGNITFNQRINKDMEFTLRANFTYSTNKVNYYEEGDTKYEYTSATGRPNGYMKGYIALGLFKDQEEINNSPKQDFGSYLPGDIKYKDVNGDGVVNSDDQVPVSYQDYPRLMYGFGGEFRWKKLTLGVRFSGIGNTDYYKIWTWGSNNVGYIPFYDGKLGNVLTIAANPANRWIPADYDDPSIPASMRENPNAMFPRLSYGSNQNNAQASTFWKGNRKYLRLDEISLNYNCNCNLLKSIGINSIDLAVVANDLHTWDSVKLFDPELATSNGRAYPIPGRVSFQAIVHF

SEQ ID NO: 16218 - protein, 356 aa, Novosphingobium aromaticivorans
MKLITAPCRALLALPFCYAFSAAGEEARPAEHDDTKTPAITSTSSPSFRFYGELGVGGYMDLEGENKHKYSDGTYIEGGLEMKYGSWFGLIYGEGWTVQADHDGNAWVPDHSWGGFEGGINRFYGGYRTNDGTEIMLSLRQDSSLDDLQWWGDFTPDLGYVIPNTRDIMTALKVQNLSGNFRYSVTATPAGHHDESKAWLHFGKYDRYDDKYTYPAMMNGYIQYDLAEGITWMNGLEITDGTGQLYLTGLLTPNFAARAWHHTGRADGLDVPGSESGMMVSAMYEALKGVYLSTAYTYAKHRPDHADDETTSFMQFGIWYEYGGGRFATAFDSRFYMKNASNDPSDQIFLMQYFYW

SEQ ID NO: 16219 - protein, 653 aa, Novosphingobium aromaticivorans
MKSPFATAALTLIYGMIYSAQSCADITIDLSSLGVDDSVAYGVSADGRFIVGTEFTSGNQYAFKYSDATGMVNLGTLGGNQSHAKAVSADGKVVVGFAALSSNHTHAFKHTDATGMVDLGTLSGEGMSEATGVSADGAVVVGYSSATNSYYRAFKHTDAKGMIDLGTLKADNSGVSFATAVSANGSIVVGYANIDSSTGLKHAFKHTDASGMIDLGTLGGQTSLAFGISADGHVVVGTAQTATGDTQAFKHSDTTGMVGLGSWGGPSFAYGASADGRVVVGTAATATGDPHAFRHTDASGMVDLGTLGGGTSSATGVSADGNVVVGISLTGEGATHAALWKITETGSHLIDLDNTRTAMAKNANRAWGMLDLRSEQLARLMSQECQIDSGSFCIGVGPSYSRNGVAGQTSMSLTLGVRPTEHLRLGVTLDQDLDRQLPDNYTKAGSAAPAVALFAAVDETGHGLGWQGRVAAAYVSSKVDITREQLAYTEAGQGRSSLRGKSLSIEGAYGVMLNAMTLTPYLGLSQTQVSRQGYRENSGAVFAASYAKMGRTTTSLNLGVRGAKKLTRQLELSANLELTQDLRNKRDAFHAQMEYLGRYTYQAGKQHDARLGAGTGVSYALNEHSAVHTGVFWAQQPGGNDVTGIQTAFTYQF

SEQ ID NO: 16220 - protein, 154 aa, Novosphingobium aromaticivorans
MKKIASLSNVLAGALVLPSLFLAVLPAAANEVAAEVEKGFWDREKLTATCTAETLGNPSDGINRRALGWPAIHAANTPSGGGGYPLADTGTRLKVKPTEEISLTAAVFSGNDAQKRDRSCTDFSFDSPPVWFGEAAYSINQDKDSPGIPATFKL

SEQ ID NO: 16221 - protein, 367 aa, Novosphingobium aromaticivorans
MRLTYFASLIAAAAPAVAIAQTSVTLYGRIDGGVEYLNHIATPNGSATRWSAEGGDWGTSMFGLKGVEDLGGGMSTVFNLETAFQVMNGRTGGGRLWSRRAYVGLKSDTWGQLQAGRNLFIDSDGVWEFDPFVQQAFSSASLVRGRNWQQTSNNIEYHSPVIGGFDVQAQYAFGNQSRGFNYGAADDFGRSDGIMISYHSPVLDVRGIYDELRDNNGKFSNIFTASREYFVGANVKISKFKIQGAYTHYQAPDSPAGVADRADHYWLGATYAATPQWAMTAGGYYVKVGDGGGDASHDPSGHAIMYVLGTTYNLSKRTFLYGTVAYVRNGGNSNFSLLATPRDASPNTSPMTGESQTGAYVGMMHTF

SEQ ID NO: 16222 - protein, 237 aa, Novosphingobium aromaticivorans
MKKYLLSAAAVFALTAPAFAADLGPRTYTKAPPVYTPPEVVYNWTGFYIGGNVGGAFAGSNNIQSDAGRFMGGVQGGFDYQFAPNWVVGLEAQYSWMASNNTGVLFPLGSVATENTRGLGSVTGRLGYSWGPALLYAKGGYAFRDSSLGVNTAAGVQSAYTTSGNRNDGYTVGAGLEYMFAPSWSAKVEYQYYKFDNTSFTGGPADVVGTTFRNDDHTVKAGINYRFGWGGPAVAKY

SEQ ID NO: 16223 - protein, 724 aa, Novosphingobium aromaticivorans
MAQDNQSVGSSAPSSDVPLDTTQIAEITVEATHETSLVVPSEAKAKEEMEEVPGPTNFIPASSYRKGRVQGMRDALLNQPGLYIQEAWGEPNDYRLSIRGTGLNSPTWTLPGILVLQDGLPWTMADGQMLAFSNIDPLAMQYVQVWRGADALRFGAVDRGGAINFTSYTGYTAPKALALFEIGSYGFWQGQLASGQVMGKADVYASLSDVAVEGFRAHSAMNDLRLNVNLGYRISPSVENRVYFAYVNQREKLTSTLTLDQMFANPTFCSPSFSLMDLRRYFDLVRVADRAAVQVDPDTTLILGAVWDNTQLWHPIFQFLHASYNDFALPIQLTGKSTLFGLPETHIIGILPQGLFAAETVYAMHFPSPAQGAFLGSSNFIATNVPLYMQESLELTKKLWLIAGMQLDYSLRSAETYNQVPLGPHGPQAFQNNSSSRDYYGINPKLGLLYQPIKEVQFYTNFTRVFEPPNFYELIPAASIIPRGQSMFPLQAETGTGIDVGTRGSWKRIQWDVAFYQYWMDDQILLYYPAAVIAQISNPSAISSPFVAFPFNGSPTVLQGVETGFTFILGERLLPQFLGDYKEPDRLVLNVNFMYSNFRFANDPVYDHNRLPLFPVNYLQAQLLYQHPSGFYIGPNVESSVTPYPVDYADTLYVPSWAILGFRLGYVSAHGWSVYFDARNITNEIYAATATPVTNAMLSGGPSAQAVFYPGLLQAFYGGFQWSW

SEQ ID NO: 16224 - protein, 548 aa, Novosphingobium aromaticivorans
MNKQSALLPVTSAILGYNLLIVSPVSAQVDPINLPFADPPTASTFELPIEDANQPDSALAQITPVSELRDVSPRDWAYEALRSLVEKYRCLRGSSDQTFEGNRALTRYEFAATLNLCLSRIEGLITDANTNGITEEDLARVQRLQAEFATELETFITELDTLDARVVRLEDQTFSTTTILRGGINFNIAGAFGDRKAVPRSENLSEDLDETLTLSSRVSLSFDTSFTGRDRLRTRIQAGNVNNFGSSVTGTDMTRLIGATNTGNDVSIGTLFYEFPLGDRGIMAIAPAADFPTRIFPALNPVSSISNFGAESPIYSFAFGAGTVAYYQFTDELAAGVTYLTTSGSNPDEGLFNGQYTALGQVTFTPSDELSMALTYGRYYAPEPGSTVNITASKGSQLAQLPFGESTATSSNALGLQSTYKLNDQMILGGWLSYFQANAEGSPTVSGLSGSSGADADIWSWAVTLAVLDVGKLGSQLNFVVGMPPKVTHNDIVEREDEDTSLHFELSYTYPLSDRIFITPGLMMITNPEHNANNDTLWVGLMRTSFSF

SEQ ID NO: 16225 - protein, 464 aa, Novosphingobium aromaticivorans
MKINQSCVAVRVIVVFSVALFAMGTAKATDVFNLEGYGPVSRAMGGTGVAYDIGAAAMMTNPATLGLMEQGAYLDFGLDVINTDINIRNAATGESVSSGNHGNNNGPYFAPEAAFVYRAGKYAFGVGAFAGGGLGTQYGGSSFLSRTTTNGINTGFDNFSRLLVLRIPFAMSYDVTDKLTVGGSLDAVWTSLNLGMLLDASQIGTLAAQHRASGTLLPALASVPGLSGGYINSAHNGIVGGGADAWGIGGKLGLTYRLTPDTVFGLAYNFKTRVGDLGGHATLSAVSSVAGNIPLDGQITVHSFEMPAQFTAGISHRLNDHWSVSADYQRVFLASVFKDINVSFVQSGTGANLNLSLPQNYRDINVFGVGAEYRYNASLAFRAGFHYAQEAIPNNMLLAVIPAIPTTTLTGGVSYAFSQNSKIDLGISFALQKTLTNTSQPNTSVPIKVTHSQINAAVAWQKRF

SEQ ID NO: 16226 - protein, 970 aa, Novosphingobium aromaticivorans
MKEYKEFLCKLWMGKIVSILIHFRSFCFIFLYLYFKNILLRFPIWFIRKVNIFNIQRYRDWFLFLILCFNRFWSGLFIVGILFCHSTLFAQKSIRVEVVILDETGNHAISNTPVVFQEIGKYLITSGEGSIKVNFPAPGSYNLRIMTSEKVFKKNITVEHDGEKKFIFIRKPAPGEINVYGEKDLESLSRYTLQQEEIQRLPGAQNDALKAIQTLPGITAVPPIGLSSSSFNNLVNSVGNSNPYSNSERGFLVMRGGGTLANGYYLDGFPMSYPYHLGDQSSVLNNNIIKSFNVYSGAFPVQFGFATGGIIDIKTPDTVAKTSSVINLNTFLSDVYHQNKISENLYAIVSARKSYPNVTLLKLYPDGIPQDAKYADYEDYQAKFNWKPGTNHTFNVLLFGARDKQKYTKAQDDFENSKKEFFGLQGAASGRPPVGLDRLFRTSGFRYTYNNKSWLETSISISNNYFKEFFEVDFKNPLTAEQIFELQNVTTQNINFLENNTRINLIERHLTFRFGGQLRDKMIQLQGEDIKSSNSTFLDFFNSLLDSNRQFRALIEGDSIHTREIAAFAEMEFKIGGFSILPGYRHDYYDKAHEKKDSFRGRAEYEILKTATKFLAGTGEHYNAPLQIEQFSSRSGNPNLKMEHSIHSSGGIEQRITSDYLIKVEGFHNQYSNLVTPDSYVQDPYQPNNEKRDIINHPDDVQENPLIVRNMNYSNSRDGYSRGVELFLKANQGPGRRFFGWISYTNSVSKRNNHQPQLTDDEENQRTRDNRDHRLQYQIHEGGNYLNYYDDGKWELLVDNDKLLLYDYDRTHILNVVFAWKFGQSWQIGSKYTYLTNVPITPIVDSSKASGLASTGINLYNPTYSEYYNSGRWPDFHQLDIRIDRFMNYQWGYVNTYIELINFFGNRNQISQTYNNFGPYSRSAFTNPLTGFTTPSNPTPVYNSNYIESTAIGGKVKYYPFISIGMQIRF

SEQ ID NO: 16227 - protein, 812 aa, Novosphingobium aromaticivorans
MRLALTGTSALAALAIAMPAFAQDASDDTGTIAEIVVTAQKKEESLQKAGIAIDAVTGASLAQSGILKADDLGKSVPSIAISNGGGSNTSIFLRGVGNFTNSSYNDPAVTPSYDGVVMGRAAGAFSAAFYDLARVEVLKGPQGILYGRNATGGAVNVIPQRPELGRTSGGFNLSVGNYDAVAADAHINIATSENSALRLGATRQVHDGYNRDGTDDLDRSGLRAQFLIEPTDTVSVRLAADYTEIGGKGAGASYVGAFLPGESGFTFTPATGLDSSEGLGTDAANAFRTSQLGAPGFGFLSELNTDPKVDYKYWGVNAEVNVDTSIGKLTVIPAYRESDGYSYFNGPAFNTAYAKENDKQFSVETRLSGKTGMVDYVVGGFYFNEKIKAENQYNQEFVLPIQNYEHKTESWAAFGQLTAHIGDRLRLIGGARYTHDKKEMDGIINNFITFCGGIPPVTPPASFALGCAASDGLPRYANSTSTSDTIAWLVANGWIAAGSTDEANAQVFPVLSGAGVILKTYNPVVDSGTYSRVTWKVSAEYDVAPDSLLYATVETGYRAGGFQLAEGRSSYKPEYITAYSVGSKNRFLGNRLQVNLEAFWWKYRDQQITYFTVDSGGTLINSNENAGKLTIKGVDVDIIAKPLRHTTLTAKVQYLDSKYQDLKLITASPRNNIGCTSTPTGETLSDGETAVLSFDCSGKPGLYSPKWTANLGAEQVLPLGDTLELVGAVNTSWRSSQWGGFEYLAFQKIGAYWMTDLNLTLRDPEGGWSLGGFVHNVEGDRRVMRPQASPIGFAVANYTAPRTYGLRLSAEF

SEQ ID NO: 16228 - protein, 855 aa, Novosphingobium aromaticivorans
MNITNSTIHGDITSDLPFGWYSYDSSTDTYSGYEFNNGTTVAAHDWVDNDTFTLNISNSTIDDDYEALYFTDTYLDADGKTVKSNADQFVTALGVAVNLDVESAINITNNSHVAGIALTQGDTTNAKYTTGDHQWDNSIKVVDSTVTSGATEQLETSTGHFGHSAEPSDYDGSYTADDVALAFTDNAASDYRMVNNVEFDHSTLQGDVVFTSTFNANFGFTDVNKDGVYDSNAGWVADDQNVDHLNLTLNNSKWVGAAWSNVESIDPVNMYDVAANSLDPETTNTDAWGRVNSADSFQSSIFDVKLVNGSEWDTTKSSLIDTLTVDGASQVNVADSSLTSDSIVLTNGSSMNIGKQGSVDTDHLTIDSYSTVNLDTTAVNYGDTALYANTITVNNGGVLDVNVDQYDANPFQTEKLELTNGGVFDIHSSDYILNADLVNGHTNDTSKSNYGYCVIAMNSDGHLTVNGNSDLNSGDEADASSVNDNVVAATGNYKVRIDNATGTGAIADYKDKEIIYVNDANTNATFSAANKADLGAYTYQAEQKGNTVVLQQMDLTDYANMALSIPSANTNIWNLEQDTVGTRLTNSRHGLADNGGAWVSYFGGNFNGDNGTINYDQDVNGIMVGVDTKVDGNNAKWIIGAAAGFAKGDMNDRTGQVDQDSQSAYIYSSAHFANNIFVDGNLSYSHFNNDLNANMSDGTYVDGSTNSDAWGFGVKLGYDWKVGDAGYVTPYGSISGLFQSGDDYNLSNDMKVDGQSYDSMRYELGVDAGYTFTYSEDQALTPYFKLAYVYDDSNNDADVNGDSIDNGTEGSAVRVGLGTQFSFTKNFSAYTDANYLGGGDVDQDWSANVGVKYTW

SEQ ID NO: 16229 - protein, 991 aa, Novosphingobium aromaticivorans
MLPARHHRPPCRSIAPLSLAIAGVLLSVAVPAFAQESKDKATDLARIEVTGSNIRRTDVETASPVQVISKQDIQNMGARTLLQVLDNLPAARPAQQDARSLFTGSDGASQANLRGLGAQGTLVLLNGRRLSYYGAPAGFQTQFVNIDAIPAAAIERMEVLTDGASAVYGTDAVAGVINVITKRNFQGAEVSFTNDTSSRIDSYGERQASITAGFGDLAENRFNIYGAVNMYRRDAIPLSDFYDKRPDQYYVNNPNYLNNLRLGVGSKPGEFNPGTYFAFDPVTGRRVQEAAPGCRNVLTSEAAGPRCVWETWMNNEIDAGAKSERNTAYLNGTFLVGDSTEIFAEATYTDIDLRANGGTPRTYGTTTGNPTSWFSRNTGNTVNQFLYPFLGPNNEYNHASPQMKAMMGGVVGLNYLLQDAGPNYFGQRNTDKSYRVLAGARGNRGDWNWETAFASAGTHSTTYQTINVNTKGFEKAFGPYTIDPGTGRVIISDHPAYKFGEISEANAALIREAFPTFDIQSWTRLHTLDGKIEGPLFQLPAGEMRAAFGFNASRETFYTPGNADAANGLITQQGGSWFDGKRNTYALFAETVAPITDKLELDAAVRVDKYPNFSANVAPKIGFKYQAFDQLMLRGTYSTGFRAPSLAESGNGGVFAQLGGFRDELRCNETNAIANLLLKSQRPGDVDLGKNMLNVDCSRTVARMTQPNKDLKPEKAKIATLGFVYEPASWLSVSADYWFIYRNNEIVAPDYRRMEDIISMSRSPITDSDRANLAQLAAMCADPASGVSCPSVLPGYSAGNVASVVGQYKNRGKTLIDGFDIDARSRFSLGDWGNLNIGLAATIANRNRFYMDAENGWYYGDVVGYYNNPRLRATLNADWTYKQVTTSMFVNYVGGTKWATDQVDEVSNNKETCTGGYLALQKSKCDGAPSWWTANMSVTWRPDDAWNLSFTVKNLFNRLPFYDPNSFLGDSSDYATIFGRGYSVTIGYRFK

SEQ ID NO: 16230 - protein, 777 aa, Novosphingobium aromaticivorans
MASKKGGVVAESTIFRRTLVAVTVMRMFLAASDACAQAEPAQPGAVTSPPAVAAEGAAPGADRDRQGSAKGRASGAAITLNSVEVTANRRREPAREVPMKVDTLSSDALQKSGATKLSDYLSTQPGVGFDSGGGPGQGTISMRGVTAGKDVGPTVGVYVDDTPLGSNTVSGGGAALALDMGLLDLNHIEILFGPQGTLYGAGAMGGLLKYVTNQPDTESFFGTVGTSFSSTWHGGLNNTTNVVLNVPLKSDVAALRIAAFNNHDGGYVDATGAAAGTRINRSDTTGVRASLLVTPTRKLTFRFTATLQNINSNGQNYVDYGMDGRPAYGALTKLQDAPEPYHQSNQFYTANAEYDFGWARLNAISAYQSLRTSTTLDFTPFYAPILAAGGLDVSTVTPNSSVGTNKVTQELRLTSPGNRTLEWVAGLYYDHEHSTTLQAYRATAGGRSLGDLEKLGYTGSYQEFAAYGDVTYNPTSRIALTAGMRIAHNSQDYRQETSGLLVPTPLSAPGASSDTSKTYMFTASYKLTPKSNVYARVASGYRPGGPNSMAVSAVTGQLIAGNPTYKPDTLWNYEIGYKADLLDNRVSVALSAYDIEWHDIQQYGAVDGVAQLVNAGNARIKGLEASGVVRPTSALSFNASLAAIDAYLTKGAPSVGARAGDRLPNTAKFAASVGASWRFPLGPWSATASAAERFVGERHASFAGATGSPDFILPAYAVTDLQFGVDLRYASLSFFVRNLFNREGLLSANTSYVPLGGNVWASVIQPRTIGVQLSAPF

SEQ ID NO: 16231 - protein, 109 aa, Novosphingobium aromaticivorans
MKRFPLFLLFTLLTLSTVPAQADIIDDTIGNIQQAINDAYNPDRGRDYEDSRDDGWQREVSDDRRRQYDDRRRQFEDRRRQLDDRQRQLDQERRQLEDEERRMEDEYGR

SEQ ID NO: 16232 - protein, 790 aa, Novosphingobium aromaticivorans
MKMHLSRALCATTALATGLLMAGSAMAQSTGTAVVEELIVTGSMGPRNMDGVIVAESEPKSRASITQEFISRMAPGQTILDTINLLPAVNFTNNDAFGSAGGDVVLRGFDSQRIALLQDGVPLNDSGNYAIYPNQQLDSDLIERVTVNLGTTDVDSPTAAAAGGTINYITRRADDEFGVRTEVGLGSVNFQRYYATVETGRVGPWGTKAWISGLYTKNDIFRPHDATQDPEGKIEKKQFNFRIDQDLGEDSFVSLIGHWNQNRNSFINRISLANYRARVAPVNGFQAANENINPSNTGNLRALSSFKLNETLTLTVDPSFQYVLANGGGAGNWAETDLQLRGNSGAAGVDLNGDGDLNDTVRLYRPNTTNTRRYGVTSSLIWKFADNQNVRLAYTYDKANHRQTGDVGYIVDGKPEDVFGGKDGRGRPVLLPDGTNLRRRDRASVAYLNQIAVEYRGRFLEDRLLFNAGLRAPFFKRDLNNFCYQNNTFNAYCTTQVPTIVPGTDDGTGRPLVRFPASALNSNANNLYGQPREFTRKYDDVLPNVGVSYDLTDDLTIYASYAETLSAPRTDDLYDRISVDPGPESAKAYDAGFRFNRGGLMAQGAVWFNSFTNRIERVFDEASGIAFSTNVGDVELFGVDFQAGYDISEKLNVYGAASYIESEIQDDIVDGSTVLPTEGRSLYETPTWQGVFRVNYYPTEDLSFGWQTKYTGARWSNLVNTEKFPDYVLTDVDVRFKLDRFGMENTYLQANVRNLFDERYLGDMTSNLTGTGLGQPGYRRTFILTLHAEF

SEQ ID NO: 16233 - protein, 709 aa, Novosphingobium aromaticivorans
MDRKTHSLICLTAGLSLLPAAGAALAEDETAGAVRALQPLQVRALLLDEVADTPGAASVLTDLDFEALRPFTLHDAFDFVAGVRTIDDDALGLRSGIGVRGAPPRRSRKTLLLEDGSPISASNYLDPSAHYTPPMQRLERVEVLKGAGQLIHGPLNNHGIVNFRNKQATPTPETTVELAGGNQGTFKRHLMHRRTVDDVGVVLAYTGANSDGVFDTEEHQFDDFYASFDWDVNARHDLRTSILHFRERSDGYDESNLSPEDFAIDPRGKRRLGEGRKDNNISVNYWKWDLTHAFQASDRLSFSSKVFYSDLDRPRFRSRNPDDPRAERVMEGRDRRYEVFGGESRAAFTGMQTGAVTHTVEGGLRFEQHDFDDRRPVGRPGERLDEGNRGRLRAIAGEDGFTRDGRLITYKAEAYSGFLQNRMQAGDWTLTPGLRVESYRQEKSTRFRPGSDDEGVTESEWNTLYLPGISLLYQGLDQADLYAGVHRGYAPAPARSDEFPLVPEKGLNSQLGVRSRGLQGVSYDVAVFYNRIEDTLIRDDVDEFGDALFVNAVDSDVYGLDVELRVDSAPFTGSDYNFFGQVAWNYTEAEFTTGPLDGNRVPEIPRHAGSLTLGMDHLSGWEVSATVSHFGDFFSDIENTLEIAEDAGQVPSRTLLSARASYHTQVSGADATLWLQGRNLTDKLYISDVQDGLRPGAERTVIGGLTLRF

SEQ ID NO: 16234 - protein, 2578 aa, Novosphingobium aromaticivorans
MHSRLNSSIASNIISRDVLRLTSGISAISIPLLFGVLFSTHVNATDYTAPVTTSLQNGDTVTIVGNGNEVRALSSANGTTLTLPGNNTITATGPAAAGLYATGSGSVINATGVVVITTGSSNSFGVGAVSGGVINLYGARISTSGTGSHALKIGSAGSNVTTDKNTKISASGASAYAIQVYSGAVKQYDKTLPANALAGEISATGTDGAAFQVTGTGSRLIFKDIDFANDTKITLGNSSWTGIVASNGFMQFQGNSSASNSRFLVGTGTIGFAGNSTAQGSQFTLNGSSSILDLRSYTGTSDFNVASIDGATGARILIGSNTFVVDGSTSSTFSGTIDGTGRLVRGGSGTLTLSGTNTYSGGTFFNSGAIAVSKDASLGASTGGLNFNGGTLQLTDSFVSARSVTLGAQGGTVQTAANEINELSGGIVGSGKLIKTGAGTLVLSGSNTYSGGTVINGGTVSISADKNLGDATGTLAMNNNATLLLVDSFDNSRAVTLGSGGGTVQTVMGKSNAFAGAIDGSGPLTKSGDGTLTLSGTNTYSGGTFINGGVVSVGADSNLGASSGTLSFDGGTLHLTGSFNNSRAVTLGAGGGTIQTSLLHSNEFSGTIGGTGKLTKNGAGTLTLAGDNSYTGGTVVNAGVLSVSADKNLGDLSGGVQLNSGTLRLTGDVTSDRVVAFDAAGGTIDAAAGTNSTFSGLIDGLGSLTKTGAGTLVLSGSNDYLGGTVVEAGTLSISSNDNLGDAASNLTFNGGTLRVADSITTDRNVVLNANGGTIETTAGTSTSFTQGITGTGKLNKDGDGTLILTGNNVYAGGTHVSKGVLQIGAGSTVGQIGGNAQVDADAALAFDRSDDIIFADVISGEGALRHDGSGKLTLTGENSFTGGTTISAGTLQIGNGSTTGSIAGNVDNNGTLAFNRSNTLDFSGVISGTGLVQQNGAGSLTLSGDSSAFGGSTSVAAGTLLVDGSLGGTVSVASGASLGGGGTIGGNTTVADGATLAGSGAQTLTFDKNLSLGAASVVSVSYGTSAGSSPFLVKGDLALGGVINVTDFGHNGPGIYRVFSYANNLTGTIGLGSLPTNITDPSTVTLQTTDDAVNLINTVGLVLNFWDGQAAGHSLNGQANGGSGTWNKQNNNWTGLPDFQLNGPWSTGEFAIFQGASGIVTIDNSAGTISAAGMQFTTGGYEITGDDLTLASTAANAGDTPIIHVGDGSINDDTEVVTISTRILSTEGIDKTGLGTLVLTADNNYTGGTFVTGGILQLGDGTSGGKGGVEGEINLGSTAASAGTLAINRAGSVTIDNTITGSGHVVIDSPGEIEFNQTNSYLAGTFIKNGVLIVSSDDNLGDTNSDVQIEGGSTLRFKSAFSSSHNYVLGTGGGSIETTGTNINKILTAVTGVGSLTKTGTGTLVFSGDNDYVGVTTISDGTLQIGDGGGTGSVVGDITNNARLAFNRNNAYAYNGLISGTGSVVQAGTGTTTLTGQNTYAGGTVVSAGVLQVSSDKNLGASSGNLTIDGGTFANTAALTSARAVNVTANGGSIRTDATLTLTGAFDGSPASDWHKTGTGLLVFDSSATGDVGAGANVDAGKIVVEGSLDGSFAVNSGATLEISGTQGGDVNVNAGGTLMGSGQVGQNVVVADNGNLQGKYGQTLQIGGNLALDANSQVNVTLGMPSQTALYDVQGNVTLAGSLNITDGGGFGPGLYRLIDYQGNLTDNGMTIGTAPGGDPTRMWIDTDEANKQVNLMSSYGVRLNVWDGGNGAWNLVSDHSNDVWTDNADNIKGPYDQGSFAVFRGTPGTVTISNAAGNVTASGLNFATDGYVLAGDALDLDNTDQPIINVGDATDASKSMTATIAATLTGSKGINKTNYGTLVLTGANSYSGGTTVTGGVLQIGDGGNTGSIKGDVAVSSSAYGDGTLAFNRSDDTEFDGNITGDGKGGVVQKGTGTTTFTGDNTFSGGLTVENGGVKAGVAGHAFGTGTLKVKAGATADLGGFDTTVGGLAAFDASGTTGDGDIALGSGKLTVEQSFDSKFSGVISGAGDLTKSGTGTLTLNTAGTYTGATNVDGGTLKQGAAGVFNNASSGYTVGTDGTLDLGGFDTTLAALSNGGLITMGTQQTAGTTLSVTGNYTGTGGTVVINTVLGDDSSKTDRLKVGGDTSGTTNLKVNNRGGLGAQTVNGIEVVEVAGQSNGTFSLVSDYTTKDGQKAVVGGAYAYTLQQGAGSGNKDGNWYLTSQTTQEPPAPDCQQTNTCPVDPDNPRYSAGVPVYQGYAQNMQVLNKLPTLQERVGNRYLTSGNDNDASNTGSSTVDSRGIWARIEGAHNRLEPHSATGMKQDINSFIMQTGVDGQFYEDANGKLIAGITGQYGTAHGNSSSFFGDGYTDTSAWSLGATATWYGNDGFYVDTQGQLTWFDNDLNSDTANSGLADGAKAFGYALSAEVGQRIALDEHWSLTPQAQLMWSSLDADAFHDIWGNRVHMQDGDSLTARIGLAANYQDSWQGDDGRMVNTSVYGIANVYQEFLGGTRINVAGVNVDTDNDKTWAGIGAGGTYAWADSKYAIYGQGSINTSLNHSTDSYAVKGNIGFTIRW

SEQ ID NO: 16235 - protein, 655 aa, Novosphingobium aromaticivorans
MTKRTQRQRNTLVATAITTVLISSTLSADETTALPTLVITGTGTEKSLPESPIPIEVIDQQQIREQGATRLDDLLKSVPGLQLMDQHGQQGQTVMMQGMNPEHVLILIDGVPTRQTNSEFNVERIDLSRIQRVEIVPGNSSSLYGSSAMGGVINLITNDEKTPYLSSEIGATQTESDTTKGPTELNANVQTGYALGDGFAEQGLSLTRYSGVDINPDRYGANLASGYRWTLSGDYQWEDFQSNLTWMGGRLERPYLQIKANNEFKRIKTENSDELSASLRRSTTTSEQIIQVDGDRYDTRQAVVGADDYYDLTRQAISLAPRLSHQQTLFTDHHDLTLGLVASMEFLEQTKTEQGETTNEISRKHRSALEVFAQDDWYTTDSLETITGLRAQWDSDFGFFLSPKLALRWDLQNSHNMGTYLRASTGLGYRVPDLKERHYRFDHEQYGYELIGSPELEPETALGSQIELGGHFSVAAQKANWSVTAFRQDVRNLIDTELNEDIDNGIDTFQYTNLGQARIQGVETQMNLLLSLGSWNLNNRLSAQVLEARDTSNDQDLINRPDLSVQFSQKLSLPNWHDTVLSHQVRYVGEQILGGESRPVASPYLLVDLAAQFSITDHWRLHLSVDNLTNNHNNEQDDDARPVLGRTWSMAIRYQ

SEQ ID NO: 16236 - protein, 629 aa, Novosphingobium aromaticivorans
MPKSSLSSRRRHALFAGLTAASCLGLAVQAQAQSAGRDPLVDEIVVTATRTPTRIDRVGSSISVVTAADIARSQQSQVLDVLKRVPGISISRSGGVGATSNVRIRGSETSMVKVLVDGVEMNDSSGASRDFDFNALLSDDIERIEVLRGPQSALYGNDAMAGVINIITRQGDGPLTVRGLVEAGAYDTFRQNLSLSGRSGDVDYSLSGSNYKTDGFSRVGAGDEKDGSEMRSLRGRLGWRASEALRFDFSAGWDWLDTDFDPSASSDGPAFQEKETLFGHAGAFFTALDGRLETTLSVGASRTDRDFDEPQGWYRYSTFDSDQLSVDLMSSLKLRRADVATVGLAWDREKAETTTTSSRGVTTPGVDADVETWGVFGQYLAALTEELSVTLGARHDHNDQFGGDTTWRATAAYALSPVGTTLRASYGTARRAPSLYQLFDPTYGNRRLETEKSWGADAGIEQALFDGKVTAGVSVFRNSYRNLIAFTSSYVNIGRARTQGVETTLAVQPVSWLSLDANYTLLDTENRDNGRDLPRRPRHSFNLGADVTVTDAVTLGADLRHVTSQLDRASATSPRVDGYTVVNLLGRWELTDSLSLFGRVENLFDEDYQEVLNYNTPGRSAYIGIQAAF

SEQ ID NO: 16237 - protein, 346 aa, Novosphingobium aromaticivorans
MIKTAFFARLINEYDNLAPAYDLDNLGLFGQLQWDVTDKFLLSGGIRYDRFGFSVDDYVTFYDDDFNRFFDPGFDEAEATIEGGERTFDSTVFNVGTVYQMTPELSAFANFSQGFSVPRFLSFLGFPPTPSTFTIDGSIDDLQPQKVNQYELGFRGRWDTVQFSLAGFYNTSDLGARLVENDRGILTLQRAPERIYGVEASVDWQPSDRWQLGAVVGWNEGESDPNDDGDFQALNSFSIQPLKLTAYVQHETLPGWNNRLQLLYVGDRDRASETLDDRGRPVDPKAIEGYVVVDYISSVSLGGGTLQIGVQNLFDHQYSSVYSQALRASNLAESGRTLTASYRLSW

SEQ ID NO: 16238 - protein, 210 aa, Novosphingobium aromaticivorans
MIRFRHLTLAMLGALAFAPAAFAQDASTDSASGKRFAIVGGYALTQPTKNPQIAGTRTNLDGDGAPTLSASYFFNDNFAVELWGSADKFGHRINSSAGKLGSVDSQPVALSGQYHFRGADSIVRPFVGLGYYQANYTGEKLENGQRLGVDNAKGGIATAGVDLNINPTWFARADVRYMQGSKSDVKLNGLKVGEAELNPVTVGVGIGARF

SEQ ID NO: 16239 - protein, 344 aa, Novosphingobium aromaticivorans
MRASQYGLLVEAMMLTPCLAFAAPGPQDSTLTLSGLVDMGFSYLQGADNSRLTTRSGGQSASRITLSGSEGLGGGWMAAFRLQNVFNAGNGKSLIDGRLFNSVSWLSFSGPPGELRLGRQPVLGSQWGSFDEGFDGGWGGAGDSIIPTGHGDTGRAARMNQSVIYYSPALAGFKAAAGYSFRVGDGDTTETDSMGRPLKNPNDRVFTAGLQYAKNEWTAGLTLDGLIPEGQDRRRTRNWQTGVAYATDNFGWSVNYGLLVNPNRGPAKDRRRSSAFIAGAHYRMTPNGILRLAVQRSVGIELKSVALGYQYDLSKRSNLYVYAIQRSGGILSRRVIALGMRHRF

SEQ ID NO: 16240 - protein, 901 aa, Novosphingobium aromaticivorans
MKIKTAYSSLALACVTALGLSIASPVLAADGVIIGSVKDAAKARSYNGAKIKLIELGLVTEAGRDGTFRFPSIPKGTYTLEISYLGEDTVTQTIKVEDNDIARASVEFGSGETIDEILVRGQRSGQASAINQQRVSDRISSIVSADAIGQFPDQNAAESLQRLPGLSIERDQGEGRFVGIRGIDPNLNNVTINGLNIPSPESGVRSVALDVIPSELIQTLEVSKSVTPDMDGDAIGGSVAVKSVSAFDKARDTASVTVQASQNDLRDETSPKVSGTFTKKLSSKWGVAGAVSYFDRDFGSDNVESNGDDELEQRHYTITRERLGSALNIDFRPDFNNQYFLRTLYSEFSDDEYRQGNIFTFDGEDSEIERESKDRFESQSIFTVALGGEHQLDTWEANWQLGYAKSDEDEPDALYYIFKTENDSIDADLNTMRPTVSQNADAMDLSTYEVDEISFEDNYTKDTETSIKFDAARPINVGGYIGELKFGSKYRSREKDRDSSITIFDGDFDDLDAAQFGAASPDYSLDNFGPGLNRGVMRSYFNDNREGLEVDSLNSDVESRGATYVNEEDIFAAYIMGSVDIEKLHLVAGVRYERTDFSTSGMRVELVENEQTDVEEVVNTPWEAERDYDHWLPSVNARYTFSDKLQLRAAYTQTISRPKFEDVAAFQIIESKTEEDDGVFVTEREAEVGNPELQPYEAQNVDLSLEYYPGDVGVISAGLFYKNIDNFVVYADVAGTAGWEGFEEVIQPINGDSADLTGLELSWVKAFNNGFIVSANATFTDSEATTFLDGEKFETQLPNQSDRIGNLTIGYEANDFSVRLATTYKSENFEEIDGDMLRFEDDHVQMDFMARYYINDTMQVYFNGINLGDEPFYNYFDTRSQNAQYEEYGRTFELGFTWQLN

SEQ ID NO: 16241 - protein, 694 aa, Neorickettsia sennetsu
MIDRIEVVRGGGSALYGSSAIGGTVNVITKIPKRNDYSFGYTYQNIDGVSDQIISGNATVINEERNAGISFFVNNRNRNLYDANNDTFSELPQLKNNAFGTNLFFLPTDNQKIEINFSKMNEYRYGGEMTNKAAHLALQSEERTHDVYAGNIDYQINFNEGKSSLISYFASQYTGRKHYTGIYPDTPAEIQQHLENPPYGNSKTTTLQAGLQFNYKVDSFFRGNNVFTIGAEFVKDAVFDEIKAYNYNIDQVTENFGIFLQSDWEINNKVSVLTGLRIDKHNFVSKAIVSPRVSFLYNFIENTQFRATWGTGFRAPQAFDTDLHIAFAGGGISRVTIEFFGDEVDSIRTFDVETQLSKDKLKKVSIMPNVENKALQEKRESFLKYVSSKTIIFHKNLDLLTGKLNDFFTKATSSFQQLSTEIKRSEPAELFCDGNLILQQLKEYTTVAINQSETAHTQSNINFSIQPQPSFNKQFDVLIKNLNNYSKQGYTNYIFCANDKQAQRFHDIFDDNEQEVSYQTIVFPLHQGFIDTDKKIVCYTDHQIFERYHKFRLKNGYAKKQSITLKELNTLEIGDYVTHIDHGIGKFGGLQKIDVEENKTLQIIDNYNNALNNPDDTEAYQKAFEQMELHNAWDFETQYKQILSKLKFDNLEQKVSELSGGQRKRLALATLLINKPDVLILDEPTNHLDLEMIE

SEQ ID NO: 16242 - protein, 1059 aa, Ehrlichia chaffeensis
MNKKNFIKGTTLPVALFFTIATFAPAWGLQTASAAIEVVQQQSTIKGTVVDSQGEPIIGASVLAEGTSNGTITDIDGVFRINVRPGAKLKVSFIGYTDKKVVAKNDMKVILVEDVTALEEVEIVAYGTQKKVTMTGAIASVKGEELTRVSVGSVSNVLGGQMTGLTTVQYSGEPGADAAEIFIRGKATWENSSPLIQVDGVDRESMSDIDPNEIESISILKDASATAVFGIRGANGVILITTKRGKEGKAKISFTTSASVLMPTKMVEQASSYDYARFHNQMMSGDGKSALFSDGVIQKFADGSDPIRFPNIQWADYIMKSSTLQSQHNLNISGGTDKVRYFISAGAYTQGGLFSEFDLPYNLSYQYRRFNYRTNLDMDVTKTTTLSFNISGNVNNSDQPRTSQGSSGLIKNMYYATPFSSPGIIDGKLVNSSDETYSDGLKLPFTGGTGMGYYGNGFSQTSNNSLNVDVILDQKMDFLTKGLSFKVKGSYNSSFTVNKVGSGGSIATYTPVLMDDGSIAYRKFGENTDVKYSYTTGKARNWYMEASFNYNRTFGDHTVTALVLYNQQKEYYPKLYSDIPHGYVGLVGRVTYDWKSRYMAEFNVGYNGSENFASDLRFSYFPAGSIGWVMSEEKFFRPLKSVVSFLKLRASVGLVGNDNIGGSRFMYMADPYNVGLGDLANRVTASGGATNAWGYGFGTDNGTVSLGAREVAKNNPAVTWEKALKRNYGVDINFLDDRLKTTFEYYKERRNDILLRDGTAPGMLGFITPYSNLGSVDSWGWELSLKWNDKIGDNFRYWAGINLSYNQNEILEKKEAPQNNLYQYQKGHRIGSRSQYVFWRFYDEDTPALYEQTFNRPFPTHESILQNGDAVYVDLNGDRKIDANDASYDYGFTDDPEYMLGINLGFSWKNLEISTQWTGAWNVSRMISDVFRQPFYSSSNSEQGGLLAYHLDHTWTPENPSQSSEYPRATIDNAKNNYATSTLYEKDAKYLRLKTLQVAYNFHFPLMKKLGLNTCQLAFAGYNLWTITPYLWGDPEARATNAPSYPLSKTYTLSLKLGF

SEQ ID NO: 16243 - protein, 291 aa, Ehrlichia chaffeensis
MNKKNKFIIATALVYLLSLPSVSFSEVTNSSIKKHSGLYISGQYKPSVSVFSSFSIKETNTITKILIALKKDINSLEVNADASQGISHPGNFTIPYIAAFEDNAFNFNGAIGYITEGLRIEIEGSYEEFDAKNPGGYGLNDAFRYFALARDMESNKFQPKAQSSQKVFHTVMKSDGLSIISIMGNGWYDFSSDNLLVSPYICGGIGVDAIEFFDALHIKLACPSKLGITYQLSYNISLFAVGFYHQVIGNQFRNLNVQHVAELNDAPKVTSAVATLNVGYFGAEVGVRFIF

SEQ ID NO: 16244 - protein, 742 aa, Ehrlichia chaffeensis
MNNRIKSLALLVNLGIYGVAFPLSAAETATDDKNSAAEETMVVTAAEQNLQAPGVSTITADEIRKRPPARDVSEIIRTMPGVNLTGNSTSGQRGNNRQIDIRGMGPENTLILIDGKPVTSRNSVRLGWRGERDTRGDTSWVPPEMIERIEVIRGPAAARYGNGAAGGVVNIITKKTGDEWHGSWNTYMNAPEHKDEGSTKRTNFSLSGPLGGDFSFRLFGNLDKTQADAWDINQGHQSERTGIYADTLPAGREGVQNKNIDGLVRWEFAPMQSLEFEAGYSRQGNLYAGDTQNTNSNDLVKENYGKETNRLYRNTYSVTWNGAWDNGVTTSNWAQYERTRNSRKGEGLAGGTEGIFNSNQFTDIDLADVMLHSEVSIPFDYLVNQNLTLGSEWNQQRMKDNASNTQALSGGTIPGYDSTGRSPYSQAEIFSLFAENNMELTDTTMLTPALRFDHHSIVGNNWSPSLNLSQGLWDDFTLKMGIARAYKAPSLYQTNPNYILYSKGQGCYASKDGCYLQGNEDLKAETSINKEIGLEFKRDGWLAGVTWFRNDYRNKIEAGYAPVYQNNKGTDLYQWENVPKAVVEGLEGTLNVPVSETVNWTNNITYMLQSKNKETGDRLSIIPEYTLNSTLSWQVRDDVSLQSTFTWYGKQEPKKYNYKGQPVTGSEKNEVSPYSILGLSATWDVTKYVSLTGGVDNVFDKRHWRAGNAQTTGGATGTMYGAGAETYNESGRTWYLSVNTHF

SEQ ID NO: 16245 - protein, 1441 aa, Ehrlichia chaffeensis
MSKKILLSYTTTAAIILFNIHSNAYAISLFSGEGENKTAPTQESYENIYALDGGKIHGKDLKIIGPSTQEESIITDISGVEARKFGSMIELEGDTTIKNVSIGLLAKESGTIKMNDGSIQVKKVHIQTPIGIAAVSNGAIILNNVEIDASNQEQSIKTIDETGIGDGTGASLKSGGTLSMTGGSIKSNYLGITLEESSSDKNKLENVKINITNLANATKESIGIRVIKTSKVTLNQVTIRHARTSIHASDSSEITISGGLIQGNHTGINVEKESVITLKNDVEVLSNDHGLSANGLHSKITMQGGKLITAGLQPAVLAGSGGEINLINVVVHIDDLTDIVMHIDDNETQTQKLELERKEAPLTTQGLQAQYAQSKITMIRGSITTTGLNPAVLAGSGGQIDLTNVPMKVHNVGLQAQAEQSKIVMTRGSITTTGMNPAVLAGSGGEIDLNDVVIKTKDIALQAQDKQSKITMRGGKLIKTGPRAAIFVTCGGQIDLLDAQLHTDSNGLAVRGRESKITLKDSEVRANILLVGKPNDEDDNGEANVIADHSILEGGARNSERKPTQIIFSLINGTTWYLKANMQSHKIQKLDLIKKLHSEVFKLNLNNSTIVFRTPREDQYQTLHIGNKSPHLTNNNTTHKTVYNATGDAKIYFNTEWNNEVPKEQQKTDRLLIHGDVSGITTIHFRNLLKGKKTKEKNTGPVNTRGLSLVQVSGKAEENSFKLANGYTTIKGLPYKYTLNAYGPTSSRGKASIEQSFVGEEEDFWDFRLQNAILDAEETISPDTQETNFFNSEEITPLNTEETASLNDGETTPLYSKKAASPDAEETISSDTQETNFFNSEEITPLNTEETASLNDGETTPLYSKKAASPDAEETISSDTQETNFFNSEEITPLNTEETASLNDGETTPLYSKKAASPDAEETISPDTQETNFFDSEEITPLNTEETASLNDGETTPLYSKKAASPDAEETISSDTQETNFFNSEEITPLNTEETASLNDGETTPLYSKKAASPDAEETISPDTQETNFFDSEEITPLNTEETASLNDGETTPLYSKKAASPDAEETISSDTQETNFFDSEEITPLNTEETASLNDGETTPLYSKKAACLNAKGKVRALVPQVASYLVMPNALFSAGLAELNNQNILLENMRTTLFEAKDKKEDNKKSGIFLSSYGHKITLSSNRSPLHYGYGADVHYTAIQAGMTLAALEGQNSTTHFGLLGTYGQLSFTPKGMEGADKSTLDKWSLAAYGNIQHNDGIYVNALFSYGAFKGNITTALIGNTAKLDGSHTVSASATIGHKLETDAKGLVFEPQAQLLYQRLMLGTLSDIDGFNVNMGKPHQWLLRIGGRLTQTIPSDEKGYATSFYGKLNLMKAFSNKSTVQIGDTFYLDAMGDSVEGGLGVNAQLSQNFALHADINYQHKLQKAGVSGINFSAGMRYQF

SEQ ID NO: 16246 - protein, 635 aa, Ehrlichia chaffeensis
MYMSNITHPDGHKETLQSFESHLSSHRITPCAKAISALLLVLGSTGAWANNYNQPKLTQEQQSQLQAMQQRQLQAILWERERQSTLRDLQSQAARQAQYLDSPAHKNGISEIDTVRNLAIIIPELFIELPESINIITKHTELPESINIITKHTNATSQVIHEVISAVSPSEITALALATIIAVQAKAEAEKEILRRKQSTKDNVSSIANMVNKLLSNKTSTQDTPTQKNDNKDNKKVDNDSLSTEVDNALAEVGNLGQIIVSNPISNLLFAAEPEATETAQKALSSPESAVPAQVPKAAPKAVSKPPLNISHNPQAGSYLANQMAAQQMFITDNLQHRQRETRYIDPITGKEKVSSMWLNTTGAKSRFNSGNGQLQTKSHRYAIQLGGTLNEWSSGGDDKGILGITAGLGKSTSHSHSTSSQHKSDGSVNGYNLGLYSIWYADNQTQLGPYIDLLAQYGWFHNQVKAPAGITGANYKSYVFTTALESGYKFQLLEKADARLFIQPKAKVSWQRMSGVQDKGSAGAQVILEENNVVATQLGMRTSLELDIDTLSSNRTLQLSPSFEANWIHNGNNKGVWLESTNITPQGNNNIADLKLGIEANIDSNLQLWTHLGHQFGGHNYSDTQAMLGANYRF

SEQ ID NO: 16247 - protein, 282 aa, Anaplasma phagocytophilum
MNYRELLVGSLSAAAVCACSLLISGSSFAYSDNNDVSDISSVMNGSFYVSGSFSPSFPSISSFDISESGRGGSYVKGYNKNLSTLNVSDPTNFTQNDPSFKFAKSLLTSFEGATGYAIGGARVEVEVGYKKFETLTDNDYKHAESHNFVAVSRDMALTPDNFFVMKIDSIKDISVMLNACYDVMHTDLPVSPYMCAGLGASFIDISNHVTSKLAYRGKVGVSYKLTPEISLIAGGFYHGIFDEQYTGIPASNRVGIAGGASAKVKANIASYGFNIGARFAFN

SEQ ID NO: 16248 - protein, 824 aa, Xanthomonas axonopodis
MRERIAMSTLHTLRLHALACAVTTCLCAPLALAQDATPPAPATPPAADSAAVNLDSVFVTGTSTATTKLKSSVSVSTVGAEAIEQSAPRSTAEIFRNIPGIRSESSGGEGNANIAVRGLPVASGGAKFLQLQEDGLPVMEFGDIAFGNADIFLRSDFTMDRIEAIRGGSASTFTSNAPGGIINFISKTGDTEGGSVGVSRGLDYDNTRIDFNYGAPFAEHWQFNIGGFFRQGDGVRDAGYTTDKGGQLKANLTRLFENGYVRVYGKYLNDRAAGYLPVPTSVRGRDGSPDLGGFPGFDPGNDTLYSRNFRTDVGLDGNNQPRRTDLGDGMHPISRTIGAEAWFDLGNGWNLSDKFRIADNSGRFVSPFPAEVTDAAALASSIGGAGAQLVEAGGANAGQAYTGTAIRTHLFNVAINDLGNVTNDLSLSREFGGDGRTLNLRMGYYTSRQTIDMDWTWNSYVQSLGRDSRLLNVVDAAGVSRSQNGLYAYGTPFWGDCCITRSYDVRYDVNAPYVSLTFDSGKLSIDGSLRYDMGDARGNYSGTAIAQNLDVNGDGVIQPVEQRVATVDTANARPVDYDWNYLSYSLGGNYLINDDLGAFARVSRGARANADRLLFGVIRDDGSVTSDEAVNVVRQTEAGLKWRRDGLSLFATAFAARTQEQNFEVTSQRFFNRSYKAHGIELEASYRYEGFTVNGGVTWTDAEIARDQITPENTGNVPRRQADFVWQLTPSYRGDGYQFGVNLIGTTEAYTQDSNQLKMPGYTQVNLFGDYRITDALTVALNVNNLFNTFGLTEAEEATIPANGIIRARSIAGRTTSLSLRYDF

SEQ ID NO: 16249 - protein, 377 aa, Klebsiella pneumoniae
MKVKVLSLLVPALLVAGAANAAEIYNKDGNKLDLFGKVDGLHYFSDDKGSDGDQTYMRIGFKGETQVNDQLTGYGQWEYQIQGNQTEGSNDSWTRVAFAGLKFADAGSFDYGRNYGVTYDVTSWTDVLPEFGGDTYGADNFMQQRGNGYATYRNTDFFGLVDGPDFALQYQGQNGSVSGENTNGRSLLNQNGDGYGGSLTYAIGEGFSVGGAITTSKRTADQNNTADEHLYGNGDRATVYTGGLKYDANNIYLAAQYSQTYNATRFGTSNGNNKSTSYGFANKAQNFEVVAQYQFDFGLRPSVAYLQSKGKDISTGYGASYGDQDIVKYVDVGATYYFNKNMSTYVDYKINLLDKNDFTRDGINTDDIVALGLVYQF

SEQ ID NO: 16250 - protein, 664 aa, Anaeromyxobacter dehalogenans
MDSRPPLGRRARALALVFSAVAGVASGAAARADDPPTSADAGAPDPGAAPVELDELVIRVPGAEATRDPTGAVTVVEAGRYAGEAKAVAELVATAPGVAVSAYGGLGQLSTVSIRGSSASGVLVLLDGLPLNTAFGGGVDLSTLPRQWIERIEVLRGAEGAHYGAGALGGVVNVVTRGGEPGGWSAEASGGSFGTAAASAEAAAGGERWTLFGAAGAERSDGDFTYRRRPQSSLPGSPYQTFTRENNGSARAGGIAKLTARLGERRLDALLQLSGGRRELAGWPGTDTPDDWQRDARALLSVRLSGAGPAPGLTLGARLTGRADLLDTRIGSLSGGDPVHQRGGAAGTEAEAVLLHPHGALRAALAAEGEALRADGLGDTRTRAQLSATLSEDARLAAGRVRLSPAVRAERVGPFDGVSAKLGGSVRVVGPLSARASAGRTFRAPGFAELYLQLGGALPNASLRPETGLSADAALVAEGARGMASVGGHATRYEDLIVYQASALGRMKPFNTGRAQVAGLEVEAATTPAPRLLGLSLGAAYTYLRTETLRGEAAEVGQDLPFRPRHRLFARAAIAPGPAEAHLEAHHVGAQWRDARNADRVPEALLWNAGASVRLARRAGLRLGLEARNLLDDRTLTDPIGNPLPGRMVMITLRAGSTPGDLTP

SEQ ID NO: 16251 - protein, 808 aa, Anaeromyxobacter dehalogenans
MTRRTPLACAIHLALSGLILAPLPLSVLLPALATAQDRSGIRDYRIPAGPLGAALSQFATQAGVTLSFAAEQTRDLTSQGLHGAYGLEEGLAQLLAGSGWQAQRQENGSYVLVKMETGDDPDLVSLDIMRVEDNQLGTITEHTKSYTPGTIASATRLVLTPRETPQTVTVVTRQHMDDFNLTSLDKVIDHTPGVTRTSWDSFRSQYYARGFQITNFQYDGIPTLADSINYTGQTSSDMIQYDRIEVIKGASGLTTGAGGPGATLNLVRKKPTHEFSGHVTAEAGRWDNYRSELDISGPLNESGTFRGRIAGAFQDRQSYLDRFKEQTRAYYGILEYDLTPQTMLTFGGNSDERIPTANAYGGIPMFDSNNNEVHVSHSYNTGADWSRSEQFSHAFFTQLDHEFDNGWSGRAYYTYQRNAYDSKMGVIRGMPNVDNDNSSYVLMGYNRYRVRTQALEVYARGPFELFGRTHELAVGASGYKNDTEGKGSGASVRVPIDDFYEWDGDIQQISNLTGIRTKWGERVNQRAFYSSARFSLSDDLALILGGRVTNYKAGGDNHMRETGEVVPFAGITYDLSENYSVYASYTKIFQPQSARDKDNAVLDPDEGDSYEAGLKGEWFNGRLNASLAYYEIRQDNRAESVGWDDVRSQTIYEGKKAKTKGVELEVTGELAPGWNIQAGFTHQVIREDRTNDKLTTQAPENQFKIYTNYRLPGTLNKLTVGGGASYQGTTWQNADYLDPPRQLRQEAFWLVNLMSKYQFTDDISATLNINNLFDKHYYTGYGDKFYPNVAVKTYGDPRNMMLTTRWDF

SEQ ID NO: 16252 - protein, 422 aa, Anaeromyxobacter dehalogenans
MPSAIRITSPLLLALASTTVLADGDLMTRSTMTGDWGGLRHQLEEDGIKVTGDYSGETAYNAHGGLHRSARYSQNLKFGVQFDLSKLYGLDNGGKVQLTINDRRGNSASEDLVGNRLPIQENYGGLYTRLTELSYERTLFTPALNVKLGYMAMGNDLGGLDSGILCNFMNAGFCGHPLNMSGGSGWTNYPNAHLGVRVKYDLSPSWQLRVAAFNVDPESNGNSSRAWHLGPKHTTGTVVPVELVYKLQGELPGEYKLGYYYDSSDVKRIGSDDEVSGRGGHYLLIDQAVWNDAGLPGRSLHAFGQYSASSKAASPFTKWYGAGVVLYKPFEGRPRDTVALGYGRAVPNPRSRDVLEDAAFNAGQQFPDIDSAEQLIELSYGYQATPWLNLRPDVQYIIEPGAFSGQDIDNALVVGLQVKATF

SEQ ID NO: 16253 - protein, 344 aa, Anaeromyxobacter dehalogenans
MRPLVSAALFACLVAARPAAAEPPAITIYGKMDVGYAHVQGANGAVPHQTPTDLVESGQLSGSRLGFKATEDLGNGISALFLVETGVSLDTGSSTSAQFWGRQAYAGLTGAWGKVTVGRHQTPGYYVQCDVDPFEIGTVGNIENLLKRQSRTDNSVQYVTPTFAGLELTALWAQNRAGPETEGNGDDTPGFSGGLRWKYGPVFAAVAYYQDKSKVTDVITRIGNAGATWDLGVVKLHASGGFYRLSDDTAQQTSALAGVTVPVPGIGGTVRASYSQMWEDAADAAGASKVALGYLRPLAKKTDVYLVFAHIENERNGTKTFDITDAIAKAGGVDGVSAGLRYAF

SEQ ID NO: 16254 - protein, 1064 aa, Anaeromyxobacter dehalogenans
MRKTFLEKCINLRLCRVALVLLFLVPAISSLQANPSQNKTISGVVTSATDSEPLIGVSVQVRETATGGITDIDGRYSVSAQQGQTLVFSYIGYQSQEIKVGTSSVINVVLKEDTEMLDEVVVVGYGVQKKKLVTGATVQVKGDEIAKMNTTNPLQAMQGQTPGVSIASTSGQPGADMKVSIRGLGTVGNSAPLYLIDGVGGDISTLNPADIESIDVLKDAASAAIYGSAGANGVVLITTKQGREGKAQISFDAYYGIQNVARKANMLNAKEYMAIMDEQALNSGLSAYDWSQYQSIYDANGNVYDTDWVDTMFKDNATTESYTLGVTGGSATSTYALSLGYMSQEGIVGGSDVSNYSRYNFRVNSEHKLFKDILKVGEQVSFVYKMNNGISVGNQYNNTLRGAFGTSPIAPVYSDNNLYDSPYNDTSTSDWNKGDGNPYGLMMTDSNNENKTATFSGNVYAELQPVKNLKIKSVFGVVYGSSEYRSFKPLYKFSQYIYNEERTTVSQNANHSLGMTWTNTASYDWTMGEHSFNALLGMEAYRYEGTYIEAKNGMLKEGFDDWEHAFVGNGTASDSTNGLGASGNPHTESRKVSYFGRLGWNWKETYMVNATLRADGSSNFAKGNRFGYFPSVSAGWTITNEKFMESTQNWLDFLKIRASWGQVGNANIDAFQYLAPIKSTNTHYLFGSGYGDSDAAAQLGTNWGAYPSRLANADIKWETSQQTNIGLDARFLNSRLGVNFDFYIKDTKDWLVVAPILATAGAGAPYINGGGVKNTGVELNLTWNDQIGKDFSYNIGINGAYNKNKVGEIPNDDGIIHGSTNQLYDNTPEFYRAENGKPIGYFYGFKTAGIFQNNQEIEDWIKAGNGVLQADVQPGDVKFVDINHDGRVNELDKTDLGNGIPDFTMGFNLGFNWKGLDFSVVANGAFGQQIVQSYRNHTSKQANYTTAILGRWTGEGTSNRIPRVTDQNLNWQFSDLYVQDGDYLRISNITLGYDFAKLLRCKVISQCRIYAQVQNAFTFTKYDGMDPEIGYGPEGDNGQGWVSGVDLGYYPRPRTVLFGVNLKF

SEQ ID NO: 16255 - protein, 265 aa, Anaeromyxobacter dehalogenans
MTLRSLLRASFLLALVAAAPAARAGGFSTTNVQLLQGWNFDKAIDTSFAGKLKDGTKTTLTLNHFSTWEYGDNFAFFDLSRGRFEADDTQWTDAYVEWHPRLFVNQLLGQKEPLFGVIRNWGFAGEVNQGAGFYAYMGGLGLDFAVPAGWVLGLNAYYRYDNFNRHGWQVSPFWTVPFTVGKVPFLFTGFIDVNGLKDEGGFYTGSDNGVEIWSQPQLLVDALAPFGGKAGKLYVGVEWWLHYYSLGSFEETSSAPQAMVQWTVF

SEQ ID NO: 16256 - protein, 377 aa, Anaeromyxobacter dehalogenans
MTLTPFLIALSLAQTTPAADPAAAAAQPAPAPVKAAPTLAGALANAPKPTFWGFVNAQYSRTEGLNGADDTSTFELRRARIGARGKVHELVGYSILFDGADSKLKDGYVSLLALPGVEVRMGQWKTPFGYEQYESDTKLLWVNTSYVVGALARGPDARDLGAGLLVQTPKVGPVSAEVLGSFVNGAGPNKKDDLETKNFWGRAGLTLKQGTITLKAGGSYGTGQQVQGTGGNGAFDGVGTPVDDTYFYFHTYGVDATLDTPWLFAAAELIQSERDQSRYATAAAVTTVTRSSRTARGWYAGAYGKTPWNLGPIFRAERFDADRTAPGGRLERYTIGAYVDVIPVNARLILNHELDQGQTGAAGRTGDRTTLFAQVIF

SEQ ID NO: 16257 - protein, 748 aa, Anaeromyxobacter dehalogenans
MSARGSVFEAGSNAALGVSLAASLGSFASGAAAQEADTVELSTIDIAGIRAVGQANTLNESTGLSRLPGRVQDTPQAITVVPGEVIRQQQATTLEQALRNVPGITVSAGEGNGGLNGDQFRIRGFQAKNDIYLDGLRDFGVYVRDSFNISDVVVIKGPSSETFGLGTVGGAINIVSKRASLADFTEVEGAFGSGPLGRSTLDVNRRIDETTAVRLNAMVHRQDVADRDNIKSDRWGAAASLGFGLGTDTTWFLNYAHQYTDRTPDFGVPTILLPGTSRAVPATELGLRRSTAYARASDMDRANADLLTSLMKWQVNDWLTVTNDSRIAFYTRDFSSTAPVCRTSSCVLGFLQGGNPFVGYSAGGGLSFLQDAWGAQNVTTAVARFETGALRHEVVAGIDYFYQADERQGLTITRPNQQIRTPLFDNAGFSFARNPLGRRESTGSNIGVFGSDRIWFAPQLSILAGIRYDDYTARYRTSAAAAGVPAGEFGAWRESRTGFASPKVALILEPNKDVTVYASWSHATTPAGAFVTQSTNIELPSSIVSQKPERTNLYEVGTKMSFLDGRLGFSAAAFRVEKTNSIDVDPVTGALILGSLDAYDARLVNGFELGLTGSLTEHWHVQFGYTHLDGRITASGDPVIGNRTPFTPENAVSAFTTYNLAPALQLPGRFLIGGGVFWDDGYFPGADNITRIPGSFSLDGLISYEHDGYRVAVNVYNLTDALNYGAAFSSRAVPLSGRTVLVSLGTRF

SEQ ID NO: 16258 - protein, 725 aa, Anaeromyxobacter dehalogenans
MSLNPEPRFRRKTLITAMMCATLPGLAVAQGSEPKALEALDVTASRGQVASETTESYISGASTTSMKMELSHREVPQAVTVITREQMDDFAQNDINDVLEGTTGVTVESVETDRTYYTSRGFDINNFQYDGVGMPAVYDNVQGELDTAFFDRVEVVRGANGLMTGSGSPAATVNFIRKRPTADTNASVAVTGGSWDKKRIVGDVSGAVSESGAVRGRVVAGYEDKGSYLDRYNNEKQMFYGVLEADLTDTTLLTLGHAVQTSDTDSPLWGALPLFYSDGSATDFARSTSTASDWSYWDNTQHNSFVELRQELAGGWRATGTVFRLENESESELFYQYGTPDRQTGEGLKAYPSQYDLDVEQWVVDAYATGPFQLADRTHELVLGASWSRSETVDESRYGRGIGNPLPPLNEWDGNYPKPAFDNGVGGSDWTDRETSTYAAARWSLTDQLTAITGLRLTWLDNKGESYGATKESSYDAVKTPYAGLIYDINDDHSVYASYTEIFTPQTEVDINRDRLDPIDGVNYELGLKSEFQNDRVNTTIALFQTEQKNVAEAEGVFSGTNDSYYTAVDGLTSQGVEAEIVGDLTDRIQLFAGYTYVDIEDKDGKGAKSFVPEHLAQLRATWKVPGVEGLKLGGKVRWQSEITQEQGVATTGPNAGETIVTEQDSYAVLDLMASYDFARHWNATLNVNNVTDEKYIESLKKFGASAQGFYGEPANASLTVSWVY

SEQ ID NO: 16259 - protein, 728 aa, Anaeromyxobacter dehalogenans
MKRMKGVTILLLSAATVTSGAGYAGNEGKGAYELGMIQVTAPVDEGSEFGDYGGSTISNTQTETYNKPTLDKAIDLVPGVNAGNTGSQRNETNIYVHGFDRLQVPLSIDGVRIYLPADNRLDFSRFLTDDIAQIQIAKGYASVLDGPGALGGAINLVSKKPVKALEGEWRSQAEFGNTGVFDGFKNYGRVGSKQDQYYFQASGTWRKVEGWELPSSFTPTAVEDGGRRNFSDSNDWSVNLKAGWTPNPTDEYSINFIKQNGKKNAPYNVEPTASPRYWSWPSWNVQILSAATKTEIGDDAYVKTRTFWETFDNAIDMWDNAAQTQRYSTSAARSIYQDWAVGNTVEVGKEFGSFDTLKVATHVRRDSHSEWNELFTDRFGLNATTTPKSSSCNTSVTSSAVCFNEPTQTSVEDTYSVATENTVHITPSFDWVQGASYDWRHLSKANDYVLGQYSKGAYYEPSWINYKLFDDSAFNWQSAAIWRYSDTAKLFMNISDRTRFPTLFERYSSRFGTGASNPQLLPERAVNYQLGWTNAFAPKSQVSVLVYYADVRDMIQSVATGRTFVDPVSGRASTITQNQNVGNGYRYGIDFAVDYAVSATLVLGGNASYIHNVLTHPTDPTIQQTGIPTVKGMLYASYSPIESVTLTPNLLFADDRWSQKNQVIAQKSVSSYVKTGSYMLANFAADYRMRENLTWSGGVRNIFDQEYSLAWGYPEAGRTYYVSMKATF

SEQ ID NO: 16260 - protein, 795 aa, Rhodopseudomonas palustris
MRLEIHRPRARRALLAATSLVAVVALPMLASAQDRSDTVEELIVTATKRDATILDVPFSINAQTEADIQKSGAVTLEDLSRNVAGLTIQNLGPGQSQVSVRGVSAGQVVRDQPGVKEQVGVYLDESVISLSLFTPDIDLFDLNRVETLRGPQGTLFGSGSVGGTIRYITNQPVIGDYKGTVEANLNTLKGGDVGGYVKGAVNIPVSDKVALRAVGYDTEYGGFVDALGEGGTKKNNVNDGYRRGGRLSLLFKPTDDIKITPRVVYQKIHAGGFNRQEAFNLFANPYTTTRPAITLGERQQYLLLDESFDDKTFLADLTAAFAFDGVELTSVTSYIDRKIDVNRDASALTGSVSVDLGFPAAAVTLPSKLVDTTDLEQFTQEVRLGSRTDSPFQWVVGAFYSKVDRVYNQRLPTPGYDAYTDATLGAGTSAQVANGFPANSPYNASLPYNIKQKAVFGEASYEIDKLTVTAGGRYYDFKENRRFTSGGLFANGDDQTDKTSSDGFTPRLLVSYKANPGLTFNAQASKGFRLGGVNDPLNIPLCTPQDAAIFGGFQSYDDETLWNYEGGVKSRFGGVTFNGAVFYTDIKNLQTTLDAGSCSSRVVFNVPKAHTKGIEGELTAHPAPGLQLGVSGSLLEAEFDSTVRDGAGAVIGGIREGNRLPSVPKFQISINATYTRTLTAAMDGYVTASFQHVGNRYTQASDQENNPRAFVSGLPFGGATGTQATVLDLQLPSYDLVNLSAGLQMDSGLDVIAYVNNVFDENPLLSFDRERGGRARLGYAIGQPRVIGLTVRQSF

SEQ ID NO: 16261 - protein, 731 aa, Rhodopseudomonas palustris
MPSRRTPRRARTLRPWRTSLPALITLCVASGTHASAAERGDAVPAASASASASTPATLAARDLPAISVSASATADPTVGYQPRTTRIAGGDNRSIKEIPQSVAVVSSSVMQDQQARSLDDVLGNISGVTQTNTLGGTRDAFIKRGFGSNNDGSVLVDGVRTPVLHSYLATIDRVEVLKGPASLLYGMQDPGGVINLVTRKPEDTFGGSISASRTSHGGSSATFDLTGPLGKPGQVAGGTLAFRLTGQYDTSRYWRSFGRQRDALIAPALSWHDANTSIDVSYQYVDYTTPFDRGTVLVNGQLDDALRYRRYEEAWSQSTGIQETLRARVEHRFSDAWRVRATYGWGRDRYDQTITRATAFNSTTGALTRSSDANLGRNDSDQIATLGLLGNVTLAGMNHAIYIGGEYERQRSFRGDTIRGKATKGFNLYDPVYDLLAPGGTPNPKQSDSRSVVHAYSTIVQDSVKLTDRLTAVGGLRWENWQQESGMGRPFVFADRSRGTVWLPQFGLAYALTPALTAYANVSRSFKPNVATNVAAPLAPEYGRVLEAGLKFSLKPAITGTLAVYQIDKRNVAVAVGDLTSTIGTARSRGIELDVAGQITRHLSVIGSYAYTNANDRDSNTPLVNVARHTGSLFAVVDTTIANLPGRWRFGGGARLVGARPGDTANSFTLPGYVTVDAFAAYETTIGKFPTRFQLNVKNLLDKTYYPSSNNNLIIAVGEPRLVTLTTTVSF

SEQ ID NO: 16262 - protein, 395 aa, Rhodopseudomonas palustris
MKKILVASTALVAAGMITAGSAAASEKIKLNLGGYSKWWVVGAWQDDSFEDGTNTGTDGQGSANSVDVKGENEVWFGGSTTLDNGLKVGIDMQLRAGGTTDTVGGDTIDESYVWVEGGFGKVIVGTENNGTYLLHVTAPDAAGNWNEGGVMMGNLAIAKPSNVTTLPNGNTTAIITDGDADKITYVAPAFYGLTLGASYVPSASEDNQNVFNGTTGQTAAAASEIYGVGALYANTFGGVGVKVSAGWVTYDIAQGTDRSQELAFGTQLSYAGFTLGGSYRDVSQNASGGVNSVANPTTATGYGWDVGLQYATGPYAVSLAYFNSKVNGSTTAVTGVGEDEITAYQLSGKYNMGAGVDLLASVGHIEYDDETAKTATADANHNEGWTVMTGLSLQF

SEQ ID NO: 16263 - protein, 228 aa, Rhodopseudomonas palustris
MKKFLLGTVALVAFAVPAAAADLGARTYTKAPAYAPAPIYNWTGFYIGGHIGGAFVGDDSIATGVTRNNDGTFLGGVQGGYDYQFAPNWVFGIEAQYSWLDSGTDPVLVGAYSFSDKQKGLGSVTGRIGYTWGPALLYAKGGYAFADYDTTVTLGGVGAAVSSKSDGYTVGGGLEYLFAPSWSAKVEYQYYDFGNVDFGTFSVKNDEHVVKAGLNYRFNWGGPVVAKY

SEQ ID NO: 16264 - protein, 916 aa, Rhodopseudomonas palustris
MKKSTYLWMLPLLFAWPQQMTAQHPLSLPADSITIDSLLETVEKNTPYRVFSTISAPFKVLVKGKASPLQQLKEALEPTPYKLSVSGNNLFVLKEQELITLLPAKLTGEPEKGESYYGDVYTYLSGEPEKASSENKVYNVGDVRIKQPPRKAVLKGQVTNFKTGEPMIGINLILKDPWIATTTDVKGNFTLELPTGHKQIDIKGLNIKDTRRQIMLYSDGTLDIELEETTHMLDEVTITSGRIQNVKSTQLGAETLRPTQLKNIPMALGEVDILKMVQALPGVKTVGEASSGFNVRGGATDQNLILLNDGTIYNPNHLFGFFAAFNSDMVKEAEIYKSSIPAQYGGRISSILDITGKEANKEKFTGSAGIGLVTSKLNLEIPIIKDRTSVLLSGRTTYSDWIMKQLPEKSGYKNGTAGFYDLATIVAHKFNDKHSLNVYGYYSHDRFAFNSNEKYGYNNLNASARWRAIFNEKLIGYFSAGYDHYDYNNRETVNASAAYKLSFDINQYFVKADFTNILADKHTLNFGFKSMLYHINSGTYEPEGSESFVKKDVLQKDKALETAFYLGDEWEITPKLSVNAGIRYSLFSALGPRSYYQYASGMLPHESTITDTITAGAGKFMKTYHGPEFRLSARYAFTDNFSVKAGFNSMRQYIHKLSNTVIMSPTDTWKLSDVNIKPQRGWQAAAGLYLNSPSGIWEYSVEGYYKRMSDYLDYRGGAKLLMNHHIETDVINTQGHAYGVELQVKKQVGKLNGWMSYTYSRTFLRQNDKRIEKPVNNGDWYPTEYDKPHDFKFVGNYKFTHRYSMSINVDYSTGRPTTIPAGQYYDESTQSMRVYYTERNSYRIPDYFRTDISFNIEPSHHLTLLTHSSISIGVYNVTGRKNVYSIYYMPEEGQIKGYQMSIFGVPIPFITYNIKF

SEQ ID NO: 16265 - protein, 207 aa, Rhodopseudomonas palustris
MRKFAMAAATILAAGASTAQAADMGYYGSRTPYTVNQPLNAFSWAGPYLGGNLGYSFGNVTNSITKPSGFNGGVQGGYNWQSGNIVFGLEGDIQFSTADDTFAPYKFSNPWFGTARGRVGYAMNDLLIYATGGFAFGQLKGERLLSTESHSSAGWTVGAGAEFAFAPKLSAKVEYLYGSLSTNNFFITGAPNGYNFGVVRAGINYHF

SEQ ID NO: 16266 - protein, 229 aa, Rhodopseudomonas palustris
MTKFLTAVSALALAAAFNLVSANADAADLATRPIYKAPVVAESSPWMIRLRALGVVPRDSGYVDQIAGSSLKTSDAIVPELDITYFFTKNIAAELILGVTRHSVSGAGTLTGIDVGKAWLLPPTLTLQYHFTDFGAFKPYVGAGVNYTFFFSQSAACCTVIDSHLKDAFAPAVQIGFDYMIDQHWGINVDVKKLWLRPEWSGTLANGTPITGKVNLDPWLIGTGITYRF

SEQ ID NO: 16267 - protein, 815 aa, Rhodopseudomonas palustris
MPTAHAVSPLARALGSLGANKMSRLGLALLLASAQAVAQEYEFNVPAQRLNAALQALGRQAGLQVLYNPSDLSGLRSRSVSGKLELEQAISQVLDGANGIGFELQGKTLILRLQDSSSVISLDSMVVSGLALNPTTENSGSYASPAVSIGKGNKSIKEIPQSVTVVTQKRMQDQNMSTVSDVLANAPGVTSIPMFGTGEQYYSRGFFIENFQYDGVPLERQSYARGSDFSGQTAIFDRVEILRGAQGLLEGGGNPSGSVNFVRKRPTAENQVRLTAKAGSWDHYGTQADISGPIDEQGRLRGRLVLDYDTKNSFVDHVGDDRQTIYAALDYDLTEATRLGFGFSRERIDANIDVNGLPNYTDGSMPHFSRSTFLGGDWSYWDKIQETFYFDIAHQFNEDWSLNATVVNAREKNDYKYLLMAGSINPDNTSTLRGDAYVFDFFSEHWGGDVYVNGRTKVADRQLNLTFGANYSDLDSSDTFGWRQRYVPNWDIFNSPVNTNKPSDDDIYSVRRSDDAYASIQKGVYGMGQYYLTDDLSVVLGTRISSYQKAYTSNGPWGYSKAVAKESAKAIPYAGIIYDLNPEWSAYASFTKIFLPQSVRTASGSILGPKSGKSVETGLKGILNDGRLNATFALFRMEQDNIPIQDANLPDDVQEANCGGTCYHGGGKAISRGFETELSGELFDNVQVYAAYTLNLLRYQGEVPSEADDVGASVNTPKHIFRSWVDYRLPGNWSRVSVGGGVNAQSRSAGFGYYGREQSGFAVWNSRLAYRFTEELTGAMNVNNIFDRRYFKSVDYGHNYFGDPRNVLFTLTYSY

SEQ ID NO: 16268 - protein, 824 aa, Rhodopseudomonas palustris
MSLPAMAQHSAPQTYQIAAMSLTEALARYADQAGISVLYEPAAVAGLDSPGLTGRYTPEQALSRLLAGTSLVASRQGDNTYVLRPAGSVSQLAPVKVETVGPRPEPAWTTITTRAALDSVMAYDWTDVGKRIEPGVTFNRQNNSINIRGLDQDRVLTRIDGIRLPYLDDGARGVKGGLETVDFNTLSRLDIVRGSDSTKGGSGALGGIAELRTLDPSDLLRPERDFGALAKLDYDSADSSRGANAALAGRIDDNTTWLIQAGARGGHALGNRADVGAYGPRRSEPTPETFSQQNFLAKLQQKVDGGHRFGLTGEYFKREGKLDNMYDQGPGTNYLYGENSTKKTTKRERVSLDYQYNAPTPGGLIDSATAALYWQRVTLDNDLSARRGVDARANIRPGDPFRYGFPSGAYGRSNSIQESLFGVTGEISRRFDGAIAQRVTLGGEWMGSRTQQYSDGYDNCPTIAPNLPAPFGPRACDLLHSNQADMPRVKGSQFAFWGQDEFSFDDGRYTLTPSLRYDHYEQKPQSSAGYDSNPNSKGILPPASSGGRFSPKLLGTWKAQEQVTLYAQYAYGYRAPSASELYTNYGGAGTYLRLGNPNLKPETSKGWELGSRLGNEDLGGALSLFDNRYQNFIDKNIPITAASAQWQPGWAGQYPLGVTGTVNRARVRIYGAEASAHWKFAPNWRTWGSVAWAVGKDQSTGQYLNSVPSLKTVLGVGYARDQWGVDAMLTAARKHDKVQNPSATPAAPYPDFQAPGYGVVDLMAYWRPAAVKGVQVQLGVFNLFDKKYWESINVPTAGGTAIPRPVDWYTEPGRSVRLSLTYQY

SEQ ID NO: 16269 - protein, 743 aa, Rhodopseudomonas palustris
MSSAQRPALSRLRVNPVVAACALIGAAPFAQAQDAASGTLAPVVVTGKGFEQRAFDTPYSVGTVDEEALRNAGPMINLSEAMARVPGLTVANRNNYAQDLQINSRGYGARSTFGVRGMRLYSDGIPATMPDGQGQVSHFDLAGAQRVEVLRGPFSALYGNSSGGVIALVSQPVRERYGELGADIGRFGLRQGRVTVQAPLGDEPGRGFDLRFGASYLDYDGFRPQSSARRTLANLRLGWTGERDTVVVSVNHVDQPADDPLGLNRAQFDADPRQTATVATQFNTRKTAQQEQIGATWRHRFADLGALSESAVTAYFGQRSVTQWQSIPVLTQRNPTPPPNTDRHPGGVIDFDRDYQGLDGRLIWRWTLDGDRSAQFVAGAALERSTEDRRGYENFLGDPLAPTALGVTGNQRRDEKNTVKTTDVYAQGELEFVKDWVATLGVRSGRVRFEAEDHYVSGLNGDDSGSLKYSYTNPVAAVQWRGLPDWNFYVSAGEGFESPTFGELAYRPDGGSGFNNGLKAQTSKQIELGAKWRNDARGLAADFAVFEARTDDEIGVATNAGGRSTFQNVGSTTRRGVELGAGWSITPNWRTALALTWLSATYDDAFVTCTAVPCNGANPGNQATVPAGNRIAGTSPRSAFAELAWRPFGTSTTELAAELRAQDEVAVNDRNTDFAGTWATWALRATQSWKLAEGSRIDALVRVDNLFDREYAGSVIVNDGNGRFFEPGMPRNWLLSVKWRQAF

SEQ ID NO: 16270 - protein, 643 aa, Rhodopseudomonas palustris
MSYERIDQQVLQSRQADSVNAALRYDPSITSESRGTTTLFDEYNIRGFKTYSNFYDGMRLAYDGFWNLTPQVDVYATEAVEVVKGPASSLYGYASPGGLVNQIAKTPSSQEAHELKIRVGNQDLKEVATDHTGAVTDTLNYRLVALARKKEGQMQTTKEERIMINPSLQWQPNDKVSVIANMFYQDDPHMLPSTPLHSVGTLYNSSYGKLDSDAYAGDVWANYRKKVWMPSLTTNWDIKDNLQFKNVIRYTDAKGKQRNIYNRGLVEDTDNLLIRAAYTTDEEMTNFTTDNQLAYQFNSGDVSHNLLLGAEYQTTDSKALYKDAGAAGTPLLDMSHPDYHLVNPETLPLDNYIETADIKQKQLGLYLQDEIQWKDLTVVAGLRHDDFDSNNHKVAAGVASTVNNKAKKTSGRLAAIYNLDNGFSPYLSYSESFEPVVGSNFITGEAFEPTTADQIEIGVKYLSADSKTKATLAAYDITKNNVVVSDYVNYRNQTQTGEITSKGFEVSGSRKVNDWMDLSVGYGFTDAEISEDDINPQYVGNTPEQVAKHKATLWSTFYPTDKIMLNTGVRYQQGMQVDRENSDELPSVTLVDIGGSYQLNDRWRIEANISNLFDKTYVGSCYDKANCWMGPERQMSLSATAKF

SEQ ID NO: 16271 - protein, 811 aa, Rhodopseudomonas palustris
MKSVFTPLTLAPALLAGYLLIPLAMAAEADAALDTVIVTGSRGSDVRTVTSSPAPIDVIDSKQLEQTGESSLRGALQKTLPSFSQRPSGTSNDSVARPYSLRGLNGSNVLVLVNGKRRHNSAVINLDSTAAYGTNPVDLDMIPISAIDHVEILRDGASAQYGSDAIAGVINIILKQRDNGGSVSTQYGQYYKGDGDNLRQTLNQGLALGDNGGFFNYALDAKSVQTATRSREATGNLYFAGDPRNDSADRHVQKNGLPKIKAINLSYNAELPVNDALTLYSFSTFSKRDARGGQNYRRPNSTNIIPEIYPDGTAPFYTLEETDYQAAAGGRGELGEWHWDLSSTFGRDKGQAGADETLNASLGPTSPTRFDTYTNYFDQWTNNLDLTRAFEVGLAKPLQVSWGLEHRHERYKTESDDPLSYINGGYIYPSGPLAGQPGAVGAQGAITLTPEDEGQLSRNSYASYLDLGLNPTDKLWLGMAARFEKYDDSSGNTRSGKLSARYDFTSTFAVRGTLSNGFRAPSLSQSVYAQTSNQYTLVNGVAQFVEAKTVRVDSPLAQALGAEDLSPEKSRNISIGFTWQPLPQASLTLDAYQIEIRDRIALTGFLYGNGVDQVLLDNGYRPGYRVKYFTNAADTTTRGVDLVADYRVDYGRYGRAKYGVGFNYNKTEIDDIKETPASLRAAGNNLELFDRVAQGYLTVANPKTKLILSANWQIERFTINAALTRYDKVIARDANPDYDVTYGAKWLTDLEVAYALTDNFDIAVGANNLFDVRADNNGYPAGDINGFPKFGSISPFDPYGGFWYTRIAYNF

SEQ ID NO: 16272 - protein, 711 aa, Rhodopseudomonas palustris
MSRRMRIKLHPICAAVAGTFVFQPMAAWSQATPTAAAQLPEVTVKADVSRELGAGYNPPNALSATKTEAPLRDVPQTVNVVTAEVMRDQHATSMQDALKNVPGVSFSHGDGQRDQVSIRGFTAIADQFVDGIRDDALYFRDLSNVDRVEVVKGPAAVLYGRGSAGGLINRVTKKPGIDVTDFALSYGMWADRRAEADVGRVFADGAAAFRITGAVEKANSYRSQQFLDRKAIAPSLELRVAPETTVLFQADYLEDRRVTDFGIPAYQGRPVDVPASRYYGAANARDADYSQSRVFSGTATINHRFNQNWSIRNATRYYHYSLDRNNTLTSAVNEAARTLTMNHGNVRREEHGWFNQTDLTQKATFLGMEHEILYGMEIGQQNKDQVNNTKPVLGANGRPAVFDLFNPVLMTLPLKAPGNPTTSNLGVFDTLAFYTQDMIKFSEQWKALVGVRYDNFQQETRNRIAGQRDLSRTDTAWSPRAGLVWQPSKAQSYYVSWSKSFQPSGEAFALAANNADLAPETTNNTEVGAKYDWLNGKASTTISVFRLERSNIKVANATNTALLPIGEQRTDGIEISGAAELGGGWRMLAGYAYLDATITKSTAALQGKRATITPRHSGNAWVTKDLGHGFGVGAGLNLVGARYADPLNTVTLPGYVTADAMAWYRRGAFEAQLNVYNLFDKGYIVSAHGTSSNLNMPGAPRSVMATLRYRM

SEQ ID NO: 16273 - protein, 492 aa, Rhodopseudomonas palustris
MGLWLSCPPIHWMPACAHPLPPIPMSRSCPPAAPQRLRPSFARRFAVPFAALLVAGGLALPWAAQAQEATGPGQEAVSDVESPFAIHGQTTYIWQRKPSFGAGYSGENSLTPDRAKSYSFTATLDLGLRLWQGAEFHFNPEVAQGVPFSELHGVGGPSNGELAKTASTNPKFYRARAFIRQTWGLGGGEEKLEADFNQFARTVDKQRVVLTAGNFSVLDVFDQNPYGSDPRTQFMNWSFLTHGSFDYAADARGYNWGASVEYIGDGWSARFGRFLQPLESNGQELDTRMFEHYGDVLELEKRYQIGGRPGQARLLLWRNKAKMGAFNDAIAFGLANNVTPDVADVRREHAKVGVGLAFLQEVNDSLGLFLRANWSDDKTETYAFTEIGRQVAWGGTLKGTAWGRPKDEVGLGMAINMLGSNHRNYLAAGGLGAFLGDGALNYGPEQVFEIYYSFAVWKTLSLSPDFQYMRNPGYNRDRGPAKFIGIRAHAEF

SEQ ID NO: 16274 - protein, 756 aa, Rhodopseudomonas palustris
MNLTTHKLNSLALSISMALMLPSTVLAQQEDDQSNKNENNYIEQIVVTGSASGTAVRKVEASYATTLISAADIKKLAPKSTADLFKAIPGVWAESSGGVSGANVFVRGFPGGGDAPFLTLQVQGVPIFPPSTLSFLENSSLFRIDETIDIVDALRGGPASVVSSGQPGLTTNFLLKEGSDETEGSIKYSTSDYDLQRVDAVVSGKLAEDLYFMFGGYVQQSPGIRDAGFNSEKGNQFTLNITKVLDNGKINFFTRTTDDHGAWYLPTPLVDGVDNSYTQLGTLNRQATIQYGPEGTSESVDFGEGRGFKGTVTGGSVNLEFGEGWTFVDRFAHLSGDADTFGLVPNGNPTLLSSVADNGVSATGAVTGDVYDGDTLVQQIGRWVVRKDIESFTNDVAVTKQTDKYKASLGLYVANFSSDDWWSIGNQSYHVIRPSGENLTGIDCNDNQDSCDWNYDLNATGDGTTKAIYAAFEYKLTDTLTADVGVRDENHTIDYTVDEGLDGMITKAVQYDESDVAFTAGVNWQFQRERGVFLRYSEGSKMPYFDDLRENFNSFSSGEDLITDVTQIELGYKLAEANYTVYATGFYNEVQGDRFQAVPGAPVQTLTNEAYGVEIDANYFADNGFSISLNSTIQETEITESPTNKGNEAQRQPGWQVRLTPSYDFEFEDFFATLYGTISMVDDRFANNENTVVLDGYEKYDVGVIVQGDSGLTFELAVQNITDEDALTEGDPRNPSAPNGRYILPRTATFSVSYAF

SEQ ID NO: 16275 - protein, 794 aa, Rhodopseudomonas palustris
MLGICPLALHSQTYSVSGFVKDTGGTPLPYANILLLNADSVRVNGTSSDESGYFSIDGIAPDLYLFQPQYFGYSARPVPVEVRSDLRLGALILSEDAEQLDEVVVTRKRPVIERQADRVVFKVENTVLSSGSTWDILRNAPGVIAGPESLEVRGQPATIYLNGRKVQLGQDEVLELLRGLSGDMILSVEVIPLPPASFEASDGPVLNIRTRQNILPGYKGSVRGEYTQAVFPKYSLGTSQFFKTEKFGLLASYSIAPRKELKVSDSYINFIDAGNAVFANWETRMDRITRSQAQQGNLILDFTPSDRDELNLTANLLYSPDQEHAYTLGTEMRNGQGSPDSTLVTRSVLDEDRLNASVELNYRRSLGEKGASLKANAHYTYYELDRVQEGNSRYFDPSGAFLRDFFFATDADQQIDIYTGQLDLDVPIGKGNLETGVRGSFIESRNAIDYLDVNMEPPFDIAVTDRFSYDEEVYAAYASLYQEWSAWSLRLGLRAEQTQVRARSETLDEINNQDYLEWFPTLYLGRALGEKHSMALTYNRRLTRPNYQDLNPFRFFLNENDYNEGNPNLVPNFSHNFNLNLSLDNTYFIDLYYRDNGRYISTLSFQDNENQTLLQIKQNTLGSISYGLDFTVSKALLDWWQVYAYNSLFYEEETLLAVLSEQETYTNRVSGYYGYLNNSLTLSGDGTLTGDVSLLYLSGFLHGSFKRSETIALSAGLRQSLWQGRASLSLVAEDLLGRANATYTSRYANQDNAFYSRPETRFIRLGFTYNFGNYRLQSRRADLRNTERDRIVED

SEQ ID NO: 16276 - protein, 691 aa, Rhodopseudomonas palustris
MRISTDEERKVGLQLDTQGSTGSRLGLTPRETPASVSVVNRQQIEQRGAANTQDILASVPGMNAASSPGVPGFVSYRGFSGAQITQLFNGISVQYDSIAARPVDSWIYDRVEAVGGPSSFLYGAGAVGGSINYITKLPSRTESFNEGRVSYGSYDSTETSFGLNHALNEGGGPRHYARLDLSHTTSNGYVDREQRDAWTTAFSLLTDFNDQLSHTLAYEYQDERVDSPYWGTPALNPLGGKMEVDKSRRFENYNVRDGRYEQRVQWLRSIIDYQVDDRTSLRNTLYHYNADREYRNLETYAYNSDNSQVVRSGILLQRHAQELNGNRFELLHHNTLFGLDSQWSAGIDYSHNVMSNFPRSVSGSLPGVDPGDFDPGSFWDLPGMQRGFDKNRRNQVDTWALFLENRLQLSERLSLLSGLRHDQIDLQVTNYRAVTEANPAFFQRTYRPTTGRLGLVYELTPAANVYVQYSTAADPPAGILTTASYGQVRDFDLSTGNQWEVGSKFDFLDGRGSATLAAYRIERKNLSTTDPSNPGSSQPVGQQSSRGVELAASLRVTPRLLAEGNFAYVDAQYDEFYENVGGRPVSRKGNRPTNTPDKIGNLWLTYDLAPSWQVGSDARYVSSMYANAANSRYAPAYTIFGAFVGYQVNADTRITGRVRNLTDQVYARTTAPSQLYLGAPRTFELALQTRF

SEQ ID NO: 16277 - protein, 241 aa, Rhodopseudomonas palustris
MKKFLLGSVALIALGAAPAMAADLAARPYAKAPPIIAAVYDWSGFYIGANGGWGTSRKSWDFYTVGGLAAEGSHDASGATAGGQIGYNWQAGSWVFGLEAQGNWADFKGSNVTLLGGLFDNQSRIDAFGLFTGRVGYAWNNALLYAKGGAAVVNDKYDFIRRADGFVTGTASETRWGAAVGAGFEYGFTPNWSFAVEYDHLFLDKKDVTFTNTAVERIKQDADIVTARINYRWGGPVVARY

SEQ ID NO: 16278 - protein, 432 aa, Rhodopseudomonas palustris
MQDQGAPRAASNSIDGTLNLSSSLGKTVHLPAPATTIFVADPTIADYQAASNTTIFVFGKKSGRTSLFALDDKGEALAALRIVVTQPIEELRAMLMDQVGDSSIQVSYTPRGAILSGTAPNAEVADTAKRVTEQYLGDGAQVVNNIKVAGSLQVNLSVRVAEVSRSAMKALGVNLSAFGQIDNFRVGLLSGGGTGSGAAQGGGTAGIGFNNGAVNIGAVLDALAKEHIASVLAEPNLTAMSGETASFLAGGEFPIPVLQENKQVSVEFRHFGVSLEFVPTVLNNNRINIHVKPEVSELSSQGAVQINGISVPAVSTRRADTVVELASGQSFAIGGLIRRNVNNNVSAFPWLGEMPILGALFRSSSFQKEESELIILVTPYIVKPGSSPNQMSAPTDRMAPALDDPPADPPRGRAAARTGAPGAKRGRGFIIQ

SEQ ID NO: 16279 - protein, 777 aa, Rhodopseudomonas palustris
MKFRTMRPAAILLAGTAGLAFAAPAAAQSSQDIDSDTELSEDASPAGDGTIVVTARRRVERLTDVPIAVTAFSGEELIRGGTLELTEVADEVPNLTLEVSRGTNTTLTAFIRGVGQQDPVAGFEAGVGLYVDDVYLNRPQAAVLDVYDVERIEVLRGPQGTLYGRNTIGGAIKYVTANLPDETRVKVRGTYGSYDQADLVVSASTPISDGLRVGVSGARLSRGGFGENLNLGTENYNKDVWAARGTMEFDSGPLFVRLSGDYVKDNSEARQGGRLLPGAFSGAPVLDSPYDTRAGLDVVDQEVEAYGGALQIAYELTDALTLKSITGYREDASTTPIDFDSLPAADLDVPAIYENNQFSQELQLLIEGDRLSGVLGAYYLDANAYTAFDVALFTTGALPAVGLPGLNAQTLGDVDTETWSIFGDLTYDLTDKVSLSLGGRYTWDTRNSRILRTTFINGFSDLFDGEGIPIAVTSDFEGEASFKEFTPRASIAFKPNVDHTLYFSYSKGFKGGGFDPRGQSTAAPDLDGDGDIDYNDQYEFLSFDPETVDSYELGWKASLLDNRLTIALAGFVGQYEDVQIPGSIGFDSDGDGVNDSFIGVTSNAASADINGLEFEGNALVGRDFAGPGSRVSFNWSLGYLDAGFNEYIDNFGNDVASERVIQNTPEFTVHTGFDIGIPVAGGMLDFLGSITMRSDTSQFELPGPLDQKAYELVDLGLVYTDDSDRFAIGVHAKNVFDQRYIVAGYDFVTGTVLGLEGNLTGFYGDPRRVFVTGEVKF

SEQ ID NO: 16280 - protein, 1000 aa, Rhodopseudomonas palustris
MQRFDPYRMHLSVLAVAIAACSPGVQAQSVATSSDSARLASSMRPAGASSNESQRPVETASAFEKLSGLATAASPSDAPNSDAPSRDATAADIAKTGVQTLDAMQVTGVRRANAAAVESKRAATNITDVISATDVRALPDSTIVEALRRVPGLSVLPATDNEHPRDEAATPVLRGLGPSYNNVTIDGLTIASPGTPNGTLGSITRGVRLDLLPASMVSELQVVKTFTPDLDPNATGGAINLKTRSAFENGGKPFFSAEAALGHANDVGKPRDQDDPGYRVNATGSRTFGSEQQYGLTVSANYQTLSSYTETHMTTDTVHYGFYDNSGVLQTGDNLGNGWAVPQQDKYWYVQDQRDRYGLTGKFEMRPSAALEAYAMAGYYYFKDDMERNEVIIDPRNRGQVFNQTATSGSYPGGDIEVGYSNQIVTTRTKVAQLGTIWRPTDRQQLSARGAWSDATYDEPIRMIKYATGITRPAPVPVGQTGSGVTINATPNYAFNYDTSGLDQRFGVSPQAYDDLDNYSLSYWRPDYKRTASDRILTGRLDYGFNQGESDQGIGFAAGVSYTTDKPSYEIYRVEYQPNTTAPAFGLADVVGTGRAPMRYAGLNLLSIDPNKANRVLAATPLSAFNSTDQQAFSNQDNFTHTEKIFGSYGLVSYRSDRLNAQAGVHFDSTKLDTVGRQRQLDAATNHYVYVDNPTSADYDYLLPSAVMTYHLTDALDLRAGASRTLGRPPYDAYAARTSIGFVNTTDAGNPNAQGVTVTIGNPDIKPRVSNNLDLSLEWRLPGDFDAFASAAVFDKHIQDEIFTLSRTDSFTFDGTTYANALISTPANAAKARIRGVEFNGIVNTLGPVAPWLSGVGFSANLALLDGSLDVPYSVGSGSSLTQRERTLDNLVGQPDYTANATLFYNTGGLELRAAYNRQGKALRAVVSNIAWQDLYWSPRSQLDFTATYAVSKQLSLIGQVSNITHSRITSVTGPGQNLLKDSYSVPTTYWVGLRFTPTL

SEQ ID NO: 16281 - protein, 446 aa, Rhodopseudomonas palustris
MKKFLLICAATLIVSNSTFAGDYLTNTNQHAAFLRMAARGASIDVDGVYSNPAGLAFLQKDGFHLSLTGQSAYQTREIAATTGLWTLDGKETTQNYKGTASAPFIPSFHGVYKDGNWAVSASFAITGGGGKASFDNGLPMFNSLAIGGIYKNEQLAGLIGKPVTPNMYDINTAMDGKQYIYGVQLGLSYRINDWLSVYAGGRMNYVKSGYEGYLKAQLKQDFGGTQLMNLALDCEQTGWGVTPIIGADVKLGKWNLAAKYEIKTNLNIENKTNTLDAPGVPEEVLKPYADGEQTPSDIPAFLSVAAGYEILHNLRASVEYHFFDDKHAGMLNDRQKTLKHGTHEYLAGIEWDIIKELTISGGFQKTNYGLSNDFQTDTSFYCSSYSLGFGARVNFNESWSIDVAYFWTNYDDYTKTTESYNNTGVKGTDVYSRTNKIFGLSLNYHF

SEQ ID NO: 16282 - protein, 383 aa, Rhodopseudomonas palustris
MGRMTYVKALMCLLFPSAALVARAQHPVAGDLKCKLTGRMLMDGGVYLKNDNLFGNGTEFNDLRLGVKATYQNWSMKMEVGYVGNKVSIKDAFAAYTSGKHIIQVGQFYEPFTLDMLCSTYDLRFHQSPGIVLALTNGRRMGTSYTYNGKHYYASGGFFTDSDLGNVKNISQGYAIDGRLVYRPVNEEGKLLHIGAAVVYRTPDSALPGDEDENTFIYKSPGVSTIDNRNLIYAKVDHAKYQLKQGVELMIAHQRFFLQGEYIRTMVKREQNFTNYTGHGGYVQCSWLLTGRQYGYDEALACPGRPVGRALELCGRFNILDMNNEEAGVWGGAQKDFSLGVNYYMNKHIGMKLAYSWVMPGKHIKEISDKNFSVVQLRFQMIL

SEQ ID NO: 16283 - protein, 775 aa, Rhodopseudomonas palustris
MNGAELVKHWSRFAIRCRKFMNTHSGSGLPATGVRRSRLRREAWVLAPFLFIFGSAGLRVGSAEAAEDVVELDKITVYGEEDEVSPETEDLPEEQLEEKKAQTMDTASLFKDVPGVSLYTGGGVSSLPAIHGMADDRVKILVNGMNITSACSNHMNPALSYVAPASVGKASIMAGVTPVSQGGDSIGGTISVDPAAPSFAKAGQMAYTGKLGGMFRSNSDTFGNNFSGSIASEDFAFDYGGSWAKGNNYMAGNGGPTVLPTRYLTTNMNLRASTKLDKGFFSADVTGQHIPYQGFPNQRMDVAENDGLLGGFSYENDFDWGKLDARVYYHSTWHLMDMLSERKAGRMPMKADGSDLGYRVRAHLPVDDVHTVRVGSEYFQQGLQDWWPGQGMHMPQDFLSINDGQRNRLGTFAEWEAAWNKEWLTQLGVRNDMVWMNTGRVQGYDNGAFYSFWATPFNAANRSRVDHNFDATATTAFTPDANSRYELGLSRKQRSPNLYERYAWAGPNSMITWFGDGNSYLGNLDLKPEAAYTATFTANWHDERQQVWSVSLTPYYTRVNDYIYGQKVAQYSNGFHGMQFVNLSHADMYGGDFSARYAFLPESPAGSFAAKVVAAYVRGVGNDGQRSMGCPYVGTSLAGLCNNNQQFWPVNGFLAPTSVNLYHMMPLNATVSLEHSIPAGSAVVDSAISVNLVDSKTAVAQSYAEPTTPGYVLLNLRTSYQREHLRVDVGADNLLNKLYYHPLGGVDIVESIKAQDVVRLPAIGRSVYVSLNLEF

SEQ ID NO: 16284 - protein, 992 aa, Rhodopseudomonas palustris
MDVNVHQLNVLAAGVFLAFAANLPGGAQAAYQETGRPGDAASWRSAEYLQDWGLDRMQANQAYAAGLTGSGVKIGALDSGFDAAHAEASSLRFHPVIASGSYQDGSGFQVSGVLNANNDTHGTHVTGTMGAARDGNGMHGVAFNAQVYVGNTNGNDSMLFGPGPDPRYFQAVYGALADAGVRVINNSWGSQPKDVSYQTLQGLHAAYAQHFGQDTWLDAAAQVSRQGVINVFSAGNSGYANASVRSALPYFQPELEGHWLAVSGLDKNNQQKYNQCGIAKYWCLATPGAAITSTVPGGGYATYNGTSMAAPHATGALALVMERYPYLDNQQALQVLLTTARQLDGSLTQAPGSLVGWGVPDLGRALHGPGQLLGEFKVNLEAGQGDVWSNGISDQARAQRQVEDAAEHQAWQQTLKDRGWEQGPGAQASQQELTDYAIGMARDVAAAQRLYQGSLVKSGAGWLLLSGDSSYRGPTTVDGGLLVVNGSLASAVTVNSGASLGGSGQVAALTATRGARVAPGNSIGTLNVAGDVSFQPGSTYAVELTPTASDRIVAGGRAHLEGAQLSLSLEHNANLLSAGQVRGLVGRQFDILQAAGGIDGQFALVQPNYLFLGAVVDYSASGVQLGLVRSAATFASVAASPNQRAVATAVEQLGTADPVYESLLLSASPASAQGALQQLSGEIYPALEQTLLNQGRDLREAFGQRLQRPGPNAGEGEASFWIKGLGGQARTDGDSGHSSYQGKGSGVLLGLDRDLDADTRIGLAAGYSDTSLRMGGASHSSAQIDSYHLGAYAGRDLGDLRLSLGASHSWHSAQVRRDLQYAEASAKQKARIDGRSSQLFSEAAYRLQLPALTLEPFANLAYLHLQRDAFHEKGDAAALRAGDDSAEALLGSLGARGLKRLSLSRGQPLELSSSLAWQHRLGHDTSSQHLAFASGGPSFAVDSASASRDAALLGLQARLGVTAQLDLSLDYQGQLGNAEQFHNVGLNLDWRF

SEQ ID NO: 16285 - protein, 702 aa, Rhodopseudomonas palustris
MAQLGSGEVLASDITVASGSTVTTKQTLTDVGDTGTVESGGTIDVTNQDGLVLDNDDQTATNNGTITVTKTTTGTPNLAGIGSNEDDATVHNNGSITTTGSRAFGIAGDGNDFTVTNSGIITTTGKESDAIFSLGTDSEITNSGTISTTGEAAYGINAEGDRPTVLNSGAITTTGDDAYAIDTDEDDAKITNTGTITTSGEDADGFDSDGDDVTLINTGVMTMSGRLADGIDNDGDRAAITNSGTITVSGEDANPIESNGDDVSISNSGTLRNTGTISGTDDDVGHGIAVDGDNVTITNSGRIYSTNGSSIYVDGSDATISLNEGTILQGALTFTDPTTATLNYAAGRTAILTFNGLPATLTTAGLASSTNGNTVTILNPEDFRLDTVGQTFNAMTRAVTGSIEQQMDLNRLSGTSFVATNGPAPDQENSTSIWVTPLGGVLSRQGSDSFDHAFGGLSAGAEKTFTEGLTAGIAGGFTLGRTTSDGDIHSASSYSIHAGGYLSRSWQATFAQFGLLGGYLKSDEEVTVLNNMVVGGLQDLSIDYDYVYVTPSARLGHAFALSEGTLTPSARVRYSGLWQTGSATEDVTGLSVSSRSLHVLELRAQATYDHAPIIQNGGTLYLGAKAGIDGIFTLNDSVDGTLQGAALNLSVDSDDAVLRGFAAADAVWQVNDGTRFLAGIEGGYDSADTLSASVRLAARISF

SEQ ID NO: 16286 - protein, 170 aa, Rhodopseudomonas palustris
MLPIFSSMLSDSGSGLIAFLPYGFNTDLLINWIDYDKRASQKSGRTLDANTLKRASRHIFRKSSGLVIGIDIGGSTWFSNNSLAPNILALFPSSHTIFQLSGKFGVRLNIDKYSFDENGNETYLGGSSVELGVKVPAFKVNYYSDNYGDKLDYKRVVSVYLNYTYTFKGR

SEQ ID NO: 16287 - protein, 710 aa, Rhodopseudomonas palustris
MVCQYRAIWGAPLVGACLLSLFPLAVQAEETSEANVIPAVEVNADVREGEGYITEGKTATAGKLDVAVEKTPYAITVVNEEFIKDTGAKNIQDALVYSSGVYSGAFGFDTRGDFVKVRGLDASFYKDGLRSLYGSYNSVRPNIYALEQVEVLKGPSSVLYGQAELGGIVNTVSKLPKAQQQGEIWAQVGSYDRKQLAADVTGPMSEDGKLLYRMVALKRESGTQVDYVDDNGFLFAPSFTWLPTDNTTISLLINTQENNGGISAQFLPAEGTLLPGVKGDIPVSTFVGEPSWDRYDRRLNEATLFVDQRLNDHWNMALTARHSSSETETREHWAAIGAGVASDGTTNRTIHMADRETSISNFDARMEGNFGFAGTYHNLAIGVDYQDALWEEGNYESTLGSPINIYDPVYGNVDYSALTPEDRNDNAIRQTGVYLIDHMEIGNVVVSGALRHDESTNKVYVVNGNNTESDDSETTGRLGLMYQFDFGLSPYVSYSEAFVPNLGVNSNTQSGLEATTGEQQEAGFKYLNDSGDLSVTAAYFYIEETNRVVQGSSPNTVDQVGAKSEGWEMEVKKRLGNLELLASYTDQRVVDDQSGERLPYLADRLASAWGKYELENGLRFGAGVRYVGDNVGFDYVGSTDGVGANPKVPSVTLYDAMLGYAVSDWDFSLNVRNLTDKEYVSWCRGQLGPTVFDCGYGETRSVTADARYRF

SEQ ID NO: 16288 - protein, 950 aa, Rhodopseudomonas palustris
MSSILDRVETSRSSTLPIAAPNVGAPPRILRRHQYMSVHGGIPMSRSKIALLVGAAQLVMAALAPVAQAHAADQAQAAAADNAEVDAVVVTGFRKSLGVAREAKKTSAIVTDVIVAEDMAKFPDLNLAESLQRLPGVAINREGGEGRRVSLRGLGPDFTRVQLNGMEVLGNVDSPMDSRGQTSRDRAFDFNIFASELFSKVDVRKSFSAEQDEGGMAGTVGLYTAKPFDYAGTKGALSLQAGTNSATKDTQPRGAAMIAKNWDDKFGLLASVAYSKRKTEEQGYNTYGAGTQRALAANVVNLNPVDAAKAMNGELIFQRGNRLSVWGSDQERLGVTAAAQWRPVETVTLTLDALHGKFTNDRTEIHLATRATLGSTILGGPTPHSGNLVSAPPVLRAIQYDKHNSIIYADVDNTVFATETRRQEAKNTFDQLVLTGEWQVSDKLRVDGHIGQETSDYDIPISDKFYTEAFGGLITDYRGDSGKNTYKWNTTDANNYRAHEIDFSATYQTTELKNAEFNAAYDFSDGLTLKGGLSYRGFKNEGYSQTNDDVNRTAWERGTLDNRLDGVTKVFTQHDDQSWIIVDWDKALAKYGVTRTLGAPRSIYAVEEDTTAGYLQLDWKTQLMGLPVRGNTGLRAYDTELTSSGVLAVRGVNTPTVAKKTYSGVLPSLNAVVEVSDRFQIRVAAAQNINRPALGAYAMNGSVSVDGTTVTVSTGNPNLEPYTSDEFDLVAEWYFGGVGMLTAGLFHKNIDGLIASQTTTNVSYASTGLAEGLYPGVTATTNVASYTRQVNLRNAKLTGLELSAQSDFFFLPGVLKNMGAVANLTLIDSKTINTVNGKPQETDIFGLSDVNANATLYYETAKYGGRVSANYRSDYLIDSGAFNATTYVDASAFYQLTPRVRLSLDAINLTDEREEQVNSFNNGFGETGAKRLWNFTTSGRTVFVGANIQF

SEQ ID NO: 16289 - protein, 358 aa, Rhodopseudomonas palustris
MRKLALAAALATSALATPALARDNSWYVGVDAGVLLVEDQDLTFDAVPPGGAAVPSIDYHKGYDFDANIGYDFGGFRLEAEAAYKRAKIDFDKTGGGFGGAASALSFMLNGLLDFGPDDGLQGFVGGGVGVSRGKLASDIVNDSDTGFAWQAIAGVRYPVTNNVDVSLKYRFFNQDDIKLIPAYQSIYGQAGSNAETKLRTHSLLLGLTYNFGAPEEAAPPPPPPPPPPPPPPPPPPPPVAECQPGPYIVFFEWDKSDITPDAATILDNAVSAYSSCGSAQVMLAGHADKSGSASYNVGLSQRRADSVKAYLASKGIPDGVMTTEAFGESRPRVETADGVREVQNRRVEITYGPGAGM

SEQ ID NO: 16290 - protein, 958 aa, Rhodopseudomonas palustris
MNIVLKSDTEQLEEVMVVAYGTAKKSSFTGSAAVVKNDKIEKMQTSDVTKALAGAVSGVQITTASGAPGSGTSIRVRGLGSINASSEPLIVVDGSPFDGDLSMINSQDVESMTVLKDAAANALYGARGANGVVLITTKRGKIGKATITVDAKWGSNSRGVPEYDVMRDPATYYTTYWRELKGMYEANGEANPGQLASNALITDSGSGLSYNVTTVGNNEVVLPDGTFNPNARIKYADNWEKEMFHSGLRQEYNVNMNGANEKTSYYLSFGYLDDEGYIVKSGFTRYSARLRLEHQFNKNIKMGGNFAYVNTSTVATSATEEQDQTAGTNMFYVSRTMAPIYPIYKRDENGNFMYDSHGRIVYDYGDTPGMQRPVSGNSNALGSQSLDDRKNGKDYFSGNMFAEISFLKDFKFTFRAGIENDNTRQMVFQNGEYGQFTAQNGIATHYSTRNMTINLQELLTWERTFGEHSVNVLLGHETYQNKYDYLYGSKNNFALWGSTSLNHAVSNPQAGSYVTEYTTEGFLGRVEYNYKDRYYFSGSYRRDASSVFHPDYRWGNFWSVGASWRLKEENFLKDVEWLDNLKFKVSYGSQGNDYLLLNGVRNRYAYMDQFSVSNNNGQPAITQTYKGNDKLKWETNYNFNTGIEFSVLNGRLSGGFEFFSRYAKDLLFNRPLAASTGSNSYPDNIGDMRNTGFEVELSGDIIRTSKINWNISVNATTYKNKILTLPEEKRESGIWNGIFKMVEGGSYYDYYIKEWAGVDPEDGKAMWYKDVTDKNGNTTKETTKTYSEATDYKAGCALPDLYGGISTSLNAYGFDFSIALTYQLGGQGYDYTYATLMNSAQGAGTNYHNDILNAWTPENKYTDVPKLNAKESNNNSTSTRFLTSTSYLSLQNISVGYTLPKNWIAKLGCESLRVYFVADNVALLSARKGYDPRTNWNGESNYNYSALRSISGGITMKF

SEQ ID NO: 16291 - protein, 368 aa, Rhodopseudomonas palustris
MQKALLHSSFFLPLLFLSFCIAEENGAYASVGFEYSISHAVEHNNPFLNQERIQIISNVQNKIYKLNQVKNEITNMPNTFNYINNALKNHAKLTPTEKQAEQYYLQSTLEGIEKIVALSGGVASQPKLVQALEKMQEPITNPLELAENLKNLELQFSQSQNRMLSSLSSQIAQISNSLNALDPTSYSKNVSSMYGVSLSVGYKHFFTKKKNQGLRYYLFYDYGYTNFGFVGNGFDGLGKMNNHLYGLGIDYLFNFIDNAKKHSSVGFYAGFALAGSSWVGSGLGMWVSQTDFINNYLINYQAKMHTSFFQIPLNFGVRVNVNRHNGFEMGLKIPLAVNSFYETHGKGLNTSLFFKRLVAFNVSYVYSF

SEQ ID NO: 16292 - protein, 824 aa, Rhodopseudomonas palustris
MIHPCSPRNDRLRHAVRAAVFGLGLGSALALPAQVAAAPASQHRQIDWSIPAGPLAPALDQLARQGGLSLSFDANSLQGKTTQGVQGRHEPAQALTLVLMGSDVQAQQEGDNSFLLIPALDAGGALQLGTTSISSDRLGETTEHSGSYTTGAVTIGKTAQSIRNTPQSVTVVTRQRIDDQNITNLTNLLEQTPGVVVNLTDSERVQYYSRGYAIDAIQYDGATVVQGSGGGSFIQSDSAIIDRAEILRGATGMIRGAGNPSGTVNLVRKRPTHEFQGEGSVTLGSWDTQRYVADISGPLTETGNVRGRVIAVHDDKDHFQDSRQERKEVFYGVLAFDLNDSTTLTTGLEWTKLDATGAWGNLPADYDGSPLPFGRSTYLGADWNRWDRSNLQTFAELEHRFDNDWSLKLMAQRTHFELDDHGFKQTYFTRASGAANPSNNPYLMNYQVTEGDGGESLQNNLSATLNGPFELLGRTHDLMLGVERIRNDSYASATNFVSSGVFDIREWDPKTSLAEPDINITAHPVRTRTTQEAAYATWRISLADPLTAIIGARANWYDYEQENNVKSNGKFSVDNKIVPYAALIYDLNDNFSSYASYTEIFNPQTATDVSGSVLEPTTGEAYETGIKGEFYEGRLNTSLAFFRIYQVGNALDDLSGPNPCPPNYTSGYCKVAAGKNRSQGFELEISGEVLPGWNVTGGYTYNTTKQLKDTISNTGNAIRTTDPKRMLRLFTSYRLPGELQAWTVGGGVQAQSDIYNRSGSAEASQAGYAVYNAMVNYRFNEHYSLQLNANNIFDKKYYRQVAPTPTGYYWGDPRNVSVTLRGSF

SEQ ID NO: 16293 - protein, 778 aa, Rhodopseudomonas palustris
MVGLNSRICALLLSVSVIALAASPSAAQTAVLSPQSKKQKPVTLDQVAKPALQMPATDPLDAYAQAGPSTQSLDAITVVSTKNEERAIDALAPASAITVDQIQRLQPNRLQDIFVATPGVSFQDRGDDPSTAINIRGLQDFGRVGVVVDGARQNYQRSGHNAQGSLFLDPEMIGGVDVVRGPSANIYGSGAIGGVVSFRTKDIDDVLRAGERWGVDMTGSYGSNNSRGLGSVFGGIRVDPTVDVFGGALYRTQGNYKDGAGTEIGNTGNDLAGGLLKLTVRPAEGHEVKIGGLFQDYNYNIGQFNRGPVLTAAQRALYQGSSVYDSNVRNSTGTLSWKYSRPDDMLFDWNISLYGNRTDNDQTKTYHNSTSGSAYCGTGNYGNNISGCIGDKRGYRLDTIGIDANNTTRFDYGDWRTAVTYGFDAFNDKVTTSDSRGNSNITTPSGERTVSGGFVQLKNNYASWLEVISAARFDHYELNSQTNSASGSRLSPKITVGVTPLAGLTPYLSYAEGYRAPSITETLIAGSHATGGGPALFACADGATGLFCLIPNTGLRPEVGKNKEVGINLKYNDVFIAGDSFRGKINAFRNDIDNYIDLVGSPPQASRLGAAYGLYSKNYQYQNIPHARIDGVELETSYDAGLWFVGVSASALRGTNPDTGIGLAAVPSRKVVTSGGVRLLDRQLTIAAQWASYAGNSNLPTGYLPATSYDLVNLNVSYRPTSDVTVNFSIDNLLNNYYRPYAIPGSSSDGTTQNDVLFSSPGPGIVYKGGIKVHFGGA

SEQ ID NO: 16294 - protein, 747 aa, Rhodopseudomonas palustris
MSPSPRRFGGRSLLSVVAALPLAMPGPAQAQEPSAQLEEIAVQGGPGTGLPPNAPADAIGAEAAAALRTPSLSQASPVGLNLRTPSRSASRLGLTPLQTPASLDIISGETIRLRGQTSVLEAVSQDGTGITAFGSPGSGVGFFTARGFAGQNSIQTLFDGTRLYVGANTVTFPFDTWNVERIEVLRGPASVLYGDGAIGGIVNIVSKKPLFTPLNVARFGLGEDGIARAAVDSTGPIGESLAYRLNVSGNRADGWITPEGDFRNLAVSGALTLQATPDLAFTLSHDLGYQEPTRYWGTPLVNGRIPDSIRFNNYNVRDSKIAWTDNWTQLRTEWHPSADVSVRNTAYRLQSRRHWRDVEQYRFNPSRGLVDRSDYLEIYHSQEQIGNRFDATFRHSLFGFANTVSAGFDVNHVSFRHTNNFTFSETPTSVPLNGYDPGFFPPEGRASPAYATRTNQASVFAEDRLFLTDRLSFLTGVRFDAPNLTRQDLRSGATFERSFRALGYRFALLYEPTPDTSLYVQYATATDPVNSLITLSQSLAGFELSTGRQVEVGAKGLAFGGAVEWTLAGYRIVKDNLISAVPGQPTVSTQVGQQSSLGAEAALSWLPAPGWRIDANLALLHAQYDDFTQNVGGVAVSYAGNQPINVPEQVANLWVNWAFARDWEGRVGLQHVGEVFSDFGNTARRPAYTLVNLGLDHQVTASSRLSLRVFNLFDKIYAVDGSAVNGFGTAWLLGRPRSLEVAYTIAW

SEQ ID NO: 16295 - protein, 486 aa, Synechococcus sp.
MPVITLPLSPRCRAYVLAVLTAIAFWGTGLPSALAQSETSKSAFTPTDEAVSFPLGGAGQIPIGPLVTSLYGNPHLLGDWGGIQPWLMKRGIFVNVGVNEEFMGNITGGRTRDHVLAGQVAGEVDIDWRKLAGIPDFWTHMLVVNGHGNNFSHTLGDYVANPEQIYGARGNVVAHLVSLYADKSFLHDRIILSFGWMPTGSFFNFDYLACSFMNVAICGNFAPGKYVPGGRDWPSGNLGGIVRFRPTERTYIMAGAFGVTQAGYNGGISGWSWGQKMSGVSTQVELGWAPSFGQDDLLGHYKIGAYYDNSRYPNLYEDINGNSFQATGLPRRYESGQWSSWLMFDQMLVRNGKGVANGLIAIGGLGYAQGNIVAMRDHEWIGLLESGTPWNRPMDQAGIMFQNIDMSHTLRLQQQSSAALGVPFLSNQWGTVYGVQNWERVYEAFYSVHLLRATALQFDFQYLQHPGATTTFGGAAVVGGQFTTNF

SEQ ID NO: 16296 - protein, 806 aa, Synechococcus sp.
MRMMQFTPKFPSTLVRSRLGLAVASSLMLAAMGTANAVDVGPGQTVTITPGSAFEGQNLSVHGGTANVLGARMGALDSFSAGGTQQTIINADGAGFTSTTGNFVRSSTAVFRNSVLSATTGPALGLARSGAVDGNGRPYPRVSLIDSSLTSTRIGLQVLAGGYADVDGSTISGGTYGVSVGAGSVSLRNGSTVNGVTAGILILSSPTIEENLADWGVMVDGSHIEASNGSAILFGAHLPSVSRPDTLLIQNGATLVGSNGVIISTRDNAHFDVTARTSTLKGDITIADTATGTLRFLDGLDLTGRILGPADVIVDQGGRWTLSGDSNTGNLTLGAGSNIFLGAAGTAAYPQLTVNGNYAGNGGTLHFNTVLAGDDAASSRVHVTGNTSGTTQVTVNNIAGAGAQTVNGIPLMQVDGASNGHLALQGRAIGGMYEYFLRKGTPGATNGNWYLTSAYTGNPCDINPALPECQGTGPVDPVDPVDPVDPVDPVDPVNPVDPVPVLRPEPGAYLANQAAAVQMFQLRRHDRGEPGFDRARIGTWVRAGRDQLQANVAGQVDARTHINTLQLGSDVWRWGDGRGQVGVMLGTGEATTQAVSTLSGYGTRGKVKGKSAGVYLGWVQDAQSSAGLYVDGWLQAARFDNEVQGEGIARETYDSRTRSASLEAGYAWAIRSSEASTLYLQPQAQLAWTDYDGDSLVENNGTTVEDGRGGGLNSRLGVRLFGQGTLQGNRVQPFLAANWLRGERDEAMRFNSESLSAKTPENRYEVQAGAQLQLGQRWSAWGDLRVQRGDSGYRNHGAQVGLRAAW

SEQ ID NO: 16297 - protein, 713 aa, Synechococcus sp.
MNPIAFSFPGRSGRAALHPLACAVLLLAASGTRAQTAADAASAAPRARLPEVTVTGNPLGADTVVVPAAQLSGDDLTLRTESTLGQTLDGMPGVSSTYFGPNASRPIIRGLDGDRIRVLQNSGATLDASALSFDHAVPTEALTTERIEVLRGPAALLYGGSAVGGVVNVIDNRIPREPLNGVDGKAEASAATGNGERAGAAMVEGGNDRFALHADVFDRNTDDVRVPIDLACSKPGSPGLARRICNSASHTRGGAVGGTAFFDQGYLGLSASTYRSDYGTVAEDDVTIGMRSNRYALDGLWRLGAGPLQSVRVQASHTHYRHTEYEGGEPGTTFRNGGNDLRVEARHAPIGRLQGVIGLQAEATRFSAEGKEAFAPRSRSRSTALFLYEELGMDWGKLTFGARAERDTVESFGSPEVDRFAVGKHDFHPHSAAVGALFNLTPAWQLTSNLSYTQRAPKDYELFANGPHVATGAWETGDPGLGLEKATSVDVGAAWKSGPNRFAATAFLSQFSNYIGLAPTGLLRSEEGDVVPAGTDGALPEYRYQGVRARFHGLEASGSVRLVGESGVVAPASRLLGDGSTLDLQLRGDIVRATNRDTGQPLPRIAPLRLGSTLLWASGPWRAGLGFDYLAAQDRVPDDGTRATGAYTLWNASLGYRTQWQFGGTRSTALWYARLDNITDKLAYSPTSILTTTAFPKAPLPGRSLKVGVKVDF

SEQ ID NO: 16298 - protein, 1285 aa, Synechococcus sp.
MRVSVSSLAILCALRLALPHQASAQTVVVTSPLTGASNFNAGGADGTSGAGGTGTGVGGGTGGSSSGNNAAGGSVGGSSAGYGGTGFGGGGGGGAGGQIGNQGNGAGGGGGLDGSVSNGSAGGGAGGGVGTTVTAGSWTNNSSVSGAYGGNGGNGAPVMNSGGGGGGGAGVYASGSGSGSVTLINNAGAAIRGGFGGEYAGFGVNTTGIGGGGGGGTGVAGSNFTLTNAGTIAGGGGGYGYTGGSGGNGVGGTNFNLSNSGNVTGGNGYNGSLGGTGVAGSGFTLTNSGTIAGGLGGGSGGSGVAGSGFTLTNSGTITGGNGNYFTPTPTGGNGGTGVTGSGFSLTNTATVTGGNGSSGFDFDSGNGGNGGSGVAGSSFTLANSGAITGGNGGDGGDGGDGGDGGNDSYGQDSHNSNGNGGHGGGGVTGSGFTLTNTGTITGGDGGSGDGDGKGIDGSGGVGVTSTGGSTIVTSGQISGGVSAAGVQADAVDLSGGGNTLKLESGYGFTGNVVSTSGTTNGGDTLELGGTANGTFNLSQIVTTTPTSWTGTVQYSGFDRFLVTDSAVWTLTGSTNAVSIAASMQINNGATLQFDNGAAGISLAGTFTDNGILTIGGSAAAASLAGTGTANLAGILTLTNAADRFSGTIQGTGGLTIAGGNETLTGANTYSGGTTIEAGTLTVGSNTALGTGVLDMAQGTALAFGTNGLTLGNAIVLNGDPTVEIDSGTDTLAGTISDGATPGDLVKTGAGTLVLAGNSTYSGGTEVAAGTLQVDGAIASPVTVDTAGTLAGAGTIGTTTVSGTLAPGDAGVGTLHVNGNLTMAAGSTYQVDVTPAAALGHVAVTGAATLQGGTVAVTAGAGNWTTTRYTILTAGGGVTGQFAGVLTNLAFLTPTLAYDSDDVFLSLRRNTLDFAGVATTRNEVAAGNGLSGTTSGALYDALVQTDAATARHALNSLSGELHASARTALVQDSYYVRDAAVERLRGVECAPGAASGMKTAAGGKPTDGACQPDRASVWMQDYGSFGHNGGNGNAAGMGHSVGGFVLGADAPVLGWQVGGLVGYGHSSFDSGAVSSYGHSSNVSLGLYAGTHWGRLALRTGATYSWNMLSTTRNVGFTGFSNRLNTDYDGGTAQAFGDLGYRLDAGPAMIEPFANVAYVNLHTNGYIEHGGPAALAGRAMDTGVTYSTFGARFAGTVRVGGVALTPNATLGYRHAFGLTTPTTREAFLAGGNAFDVAGVPLSTDAAVLKAGLQAKLTDRLNVGLSYVGQYGDHSTDSGLTGNVKVTF

SEQ ID NO: 16299 - protein, 790 aa, Synechococcus sp.
MPAISQERGSNHARFATGTAFGHGAGMRLFRSTDFAQNGSRQDQPEASEAADQSLDIVVTARKRSERISNVPMTITAASGEQLAMRGINDVADLAKVTTALTATTTYSSTPVYTIRGIGFYDNSLAISPAVSVYTDQIPLPFSIMTEGASLDVARVEVLKGPQGTLFGQNSTGGAINYVANKPTDHFSAGGKIGYGRFNAINANAYVSGPLSDTLGVRVSGALDRRSPWQQSLSRPGDELGRRRFATGRLLLDWKPTDALQFELSVNGWIDRSDTQAAQFLDVRPTVPVPPGYAPPLAALGGLTSAPDKARRADWTPGRDYGRHDDFHQFALRGEWDVNDAVKLTSITSYSELKRRARTDPDGAAYPNSDISQIGKIKSFFQELRLEGPSADGPLKWMVGVNYAKDRSRDYTAANNIGTNSLIAGVFFIDGAGMVNNQNVETKAAFGSLDYKITSTLTAQGSIRYTDSRNRHAGCGTDLGNGLLAAVFSGLTGVAIQPGQCVMLVPGPSGAPVPSLTPVKGSLDEDNVSWKAGLSWKPTNATLLYASVTRGYKSGVFSTLPALSLAQLVPVKQESILAYEVGLKQQLLDNRADITLAAFHYDYDDKQLLGYIAVPPFGNLPGIVSIPKSRVNGIEGSLTWRPATGLTLSGGAAYIASKVTRSAIKYDADSNLVDVKGEAFPFTPKYQLTGDAQYEFPVSQELSAFVGANARYQSSSAASFGGNPAYRLPGYTLLDLRAGIFPGDNRWRFEVWAHNVTDKFYATNIIHVVDTRVRHVGMPATYGASISFKI

SEQ ID NO: 16300 - protein, 695 aa, Synechococcus sp.
MRTSIQLTSRLLTTTTLTALLAGLTAVPAAAQSGLAIEEIVVTAQKREERLQDVPVSVTAFSADAIEDAGVRTPQDFIALTPNIGIVQSFTVGNSFVTVRGISQINNSDPSVAVVVDGVPQANQKQLTQQLFDIERIEVLKGPQGALYGRNSIGGAINIITRQPGNDFEGYTEAGYAEGNTRTLSAAAGGAIVADRLFFRAAGSYADSDGQITNGFLDEKADFYEDRTGRAQLRWIASDSVTVDLRGSISDTEGGAVLYSQFPTLGFSNNENVKPDENLLGRSERDMGDLSLKLDWDFGAATLTSISAYSKVKENYRGDLDFSRVQSIGQGQDLEVEMWSQELRLTSPDDQPLRWIGGAYILQTDRDLRTTVFLDTNSTLAGLQPLFIFGDESNDNLAYAFFGQASYDVTDRFELSGALRYDSDEREQTDLLRNNAVRSKTFSEWQPKVTAKYEWTPSLMTYATFSTGFRSGGYNAPTVNPSIFQKEVSTNYEVGFKSQLMDNRLILNGSAFYTKLDDAQIFRVDLTAGAQIIDNVKEAELTGFELEFQARLAEGWDAFGGVGVTDSEIKDFDGTRAYRGNQLPNNTKAKINGGTQYSFPITDALSGLLRADVEYRGKQYFHADNIDYRDPVTLVNLRAGLETERWSLTAYVKNLTNKQFFTEYADGFWSGSATGQDLGQLSPPRQFGVTGRVRF

SEQ ID NO: 16301 - protein, 1010 aa, Synechococcus sp.
MKVTTVVAMKIATGLAMGGISLSSYASSREQVGNIQIKDQIDTIKQRDQKGADDQYDRDESNIYISKEAAERYKGTNPADILNHGVGVYSGDARNSGALDPNVRGIQGQGRVPVTVDGTEQAITVWRGYNGANNRNYVDPNMISSITVIKSPMLDRDIRTSIGGGVAVKTLSIDDIVPSDEHFAVDLKLETRTNSTKPRINQLHLGSDYRDDPELMDSLVNHYNDSLSLVMFRDPETSVEPDQPGSSNFFNLKDSAMRVALGLRQEKFNLLFAYSHRNQGNYFSGRHGAHYFREPIITRDNQYSEKTLDPNIPFVANVYLPTKEVGNTSSNIETFLQKMNLQLSESQSVSLGYVHTKSHYGEIMPSQIRFHDLAGEIPQWPLANLSLGSFSVNYGFKPSDQPFFDFQLSYWLTKMDLNSNTAGALPRQAMEYDWSTDMTYRNPFVNGKLVDGIKLSQLNDRQGISLSNKTQLMPSFDVTLIGNFMNEKIHSHDDIYDPNAEVPKYHVFRAIPREGKRQEYSGAIRLDWRPTNWLHVNAGIQYQNYWSRDLLRERRLKAKDSRFAVHQIEKAMNFEYTRPFTEEEASKVKGYVDSKGRTFDGYDKIGLWPDSTIGVSRIEWFVAEALSLPKHSLKKAEHYSTIHEEYEGFRITGFDYIKWRVDEDGKLTAENNPFYNGEIDLSEEVIDPISQKKVKAIIAYRAPNKEWDYISVDENQKYKNPGKRINSAWSPSIGGSVYLSDNDRVFARYAETVRMPSIFEDTIGFSGEGDSAIRTHPFKPERSHTFEIGYVRNLQSWLKSENAADFRINYYHNMIENAFDRDGNLVFAQMDQHRTAGLEVLARYDNGRFFGDLGIDFRLKNEVCDDASMARLDPLNKYKGSICTEGGFPHGYLRTQLQPKYSIHTNLGMRFFNESLEVGGRIRYHAKTENKDEAQMASKFGPSYSPLNNNPMSWNAVFVTDAYVTYQVNKNLLVELLASNVLNEYYIDPLTRSMMPAPGRSLRLSVTSHF

SEQ ID NO: 16302 - protein, 726 aa, Rhizobium etli
MARVFLNVSNNVSRIYRDSLFVTTAIVLIGIAASPASAQSASADAGATALEPIVIQGASSDSKTDRTSVAAKNSSAATKVNTPLVETPRSVSVTTEKEIEQRGAQSIIEAVRYSAGVTTGPNGFDPRFDQIYIRGFNVTTVGDYRDSLRQPYINYGMFRTDPYQLQRVEVIKGPVSVLYGSGSPGGLVNKISKLPTEEPIREVGISYSTKDRAQAMFDFGGPISEDNDDFLYRIVGLARRGDTNFDIADDRYFLAPSFTWKPDEGTTFTVYGLAQADETDSNVGAITTLDGRILDIRQSDPDYDYQKVKQQQVGYQFEHEFDNGLTFRQNLRYSHLDLRARYLGVSSWTGTVAHRNASSIRDEMNVFQVDNQLEAKFDTGPLAHTMLFGLDYTNLQSNWGYGIGAVNSAFDFDIANPTYGVSGATPAYNFIVADADMRQVGVYAMDQIEAGNWRFNLGGRQTWVNQTRDTTYPSFGSNESEDVNKNAFSWQAGALYLFDNGIAPFVSYATSFDPVTNRSTSGKILEPTEGEQYELGVKYQPPGTDILLSAVAYHIVEQNKPVLVNPVTLAYDSLGEVTGKGIELEARAAVADGLDLIAAYTYNHSEVTGGNNEGNTPAVTPSHVASLWANYTFQETNPFNGLSVGAGVRYVSENWTDTANTSKNPSSFYIDASAAYDFGAVDKKYEGLTAAFNIRNIADERDTVCNEGFCYLGQGRNMTGTLKYRW

SEQ ID NO: 16303 - protein, 278 aa, Rhizobium etli
MKRSLSGIFAALLIATNAYSADLAPAEPIPEQPPEVTVTEATGWYLRGDVGYAFTDLRGARYFQGSNATEVDFDDADLDDAWTVGGGVGYQINSYLRTDLTFDYLTQADFKGSTVGQCGFPLVDCTSSDRSSLTAYTLLANAYVDLGTYGYVTPYVGAGIGGSYVKWKNLRNVACADDGSFCDDQVTHGGKGNWRFTYALMAGASIDVTCNIKADVGYRYLHIDGGNMFGYAENGGPGRDKGLTAHEARVGARYLFGGCAQASYEPPPEIPLQQPIYK

SEQ ID NO: 16304 - protein, 752 aa, Rhizobium etli
MIVRHWRSVLLVCTAVAAAFPVSQSLAQSAPATTPQATADDSTVLQKIVVKGKRAAPGSVADTPLASEVTAKQLQEKQVTNYSDIGRRVDAGVNYSRADAGFNLRGLSGARILTTIDGIPIPYISNSSRQGAFAPANANGGGDTFDFDSLSSLDIVRGADSSKGGSGMLGGAVVLNTLEPEDVIPESRDWGAIVKSTYNSEDRSLSGSAAAAKQIGGTSILFQGGYRKGHERDNMGDNDSYGALRTEANPADFDQNNLLFKLRQELEGGHRIGLTAERFRWDLKTDLRHLQGGTSPRNFMSDNYDGRELRDRDRVSLDYDYEAQSSDAFFSSARATLYWLDLKKEAGSRGRTTANVAYGRNNQIENETWGFSGTATKDFEYSGLDHSVRIGLDVGVSSWSQYSWALCPTSTTCPALNNQAEVPNVDSQTLGLIVEDKIEIGNTGFALTPGFRFDWFNYDPSTGGGFANNTGLTRFGDLRDRTEAAMSPKILATYDLTPDVELYMQLAVGFRAPTVDELYSRFYNPTGRYAQLGNPDLEPEIGRGIEVGANFDTGDVTGRIALFHTRYQNFIETVTSVDATGFTEFNYTNVAAATISGIEASAAKTFNNGINLHASLAYAYGRNEETTQRLRSVAPFKAIIGGGWSNETFGFDLSSTLSAGMLTDHLNTPVTNTADTTFDAPGYAIVDLTGWWTPEQLPGLRVQAGLYNIFDQEYFNALAVRDVNLSSATASQPRDWYSEPGRTFKVSLTKTF

SEQ ID NO: 16305 - protein, 207 aa, Rhizobium etli
MKLTIATAFLALVATTAFAADVVQDVPTAPVAAAPVFTWSGPYFGIDGGAGWLNGDFSAGGASADEDFNGGVFGAFAGYNFQFDNIVVGIEGNIEHNWNEEDALGADVGTDWAGAVRGRVGYAFDKALIYGAAGWAATRGYVDAPGFDKETETFNGYTVGAGVDFAITNNIFARGEYRYNDYGEKDILGVDVDLDQHELKFGIGVKF

SEQ ID NO: 16306 - protein, 611 aa, Rhizobium etli
MRGYDSRGVKIMVDNVTHDFNSGLFDATLIDPSLISKAYVHKGSSSVQHGSGAMGGVISLKTLSASEVLEPKQRLGGRLFSGINRNDHGYYAGGTLLGRSDSVDALFSYSQRKKYLMSSIKSVPFDNQEKIHNWMFKTVWMANPAYHVGLQLREYRNDGLSLRQPALINTQKNMFKNTPTERHAHQRDILINQIFKPENRFQWEAEWDFYYTDLSLNQLDLVKAQKKPTEYGNERRNQYTYGSKFSNHFTLPVSNWAFSRIQSGIEHYQQAQTSNEYAISYPPTELSNTSGWLNNDFTFAHIPVTLSAGTRFTQYHVNREGFAKNKHTNWSSRVAISATPTHWLSLHSSYAEGYRTPRMAELYNNSLHFSTPFSGSSIFKTSPDLKPETNKTAEAGLKLSFDDFVVTGDTLSFGSTYFHTKARNYIAMNSQYKRKIGPDLYYVWFPETIYYINVPSATITGFDSFVHYQSQWFDLSFNHNLTTAKEDLENHALSSIRPESLIIKFNAPVSNTGINVGWSGEFAARTKITGDSTHKLPDRKNSKDLDRYRREIFQQAGYGIHDFYINYQADQFVKGLNTTLTLKNAFDKEYVSSIGVPQEGRNVYWNVNYRW

SEQ ID NO: 16307 - protein, 280 aa, Rhizobium etli
GQFIQHWATAEAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPATYTVDSSGVVTPVPAVVGKPGSDVYYAGLNYKNGGFAGNYAFKYAKHANVGRDAFNLFLLGRIGEDDEAKGTDPLKNHQVHRLTGGYEEGGLNLALAAQLDLSENGDKTKNSTTEIAATASYRFGNAVPRISYAHGFDFIERGKKANIPATINHRDENKFPHK

SEQ ID NO: 16308 - protein, 415 aa, Rhizobium etli
MASRMFSKGVTSLILLSSLASPSFAGGLERGGYNIDQLFDTSPFSFQSGITYVTPQRKLKDVRDTNTSIFTGGGNLNSRPDSADETANYTIPYIGFKAGFGDAVDCLVDYSVPFGGHSNPGSNWAGANNNIETEIKTRNYGGTCSYRFDVGAGQLRFIGGAFYQEVEGFKERLVSTVPIGLGIGTGIGRLDIDDSGWGWRAGLAYEIPEYAMRASLVYNSRVKYDNLTGTVDLRQVPVVPLYGGLVTPVSGSAEAPDSLELKLQSGIAPDWLAFGSVKWTNWSVLQSVAFCPTNGLPCPAGGLTSLDLFYRDGWTISGGIGHKFNEQWAAAVSLTWDRGTSQGYGSQTDSWTLGLGAAYTPTEHIEWRVAGALGILTSGESGTFVYNGRTYGNDVSYSFGNDLVTALSTSLKIKF

SEQ ID NO: 16309 - protein, 852 aa, Rhizobium etli
MRVKTLAQAIAAIGLLGSGFAHAADDNQLERVTITGSNIKRSIKQEKALPVTILKTEDLAKQGLTTVEQVVNSIAANQSTQGSSSAVGASSGGGSFASLRGLGNQYTLVLLDGRRMANQAIDGTSADLNAIPLSVIDRVEVLLDGASAIYGTDAIGGVMNFITKKSMKGFSIGGSFANPQHGGGDEKRVNASYGIGDLAKDGFNVYGAVDYLKQDMIMASQRGFASTITPQTDTVPSVNAWPGSYYDSVKKKYVQPSAPNCRPPYSQFVNGRCREYFPLYPSIVPEVEQISGVFKATKRIGDDHELSLQYTRTETITTAQNAPLPTAGDVTRANLTDPSQRDQLYVRAVPLGNRETEANSVTQRLMLNLEGLVAGWDYRAGIGRSENLIKENLTSGYISKSKMQSAIDSGALDPFDLSSNNLAAWRSVSMTGQTKEAKSTIDMADAKVSKELFDLPAGKLGVALGAEVRHESLSTIYNKSVTRDALSTGQDKTEDSMGSRSAYAFYGEADIPVLKTLDVQLAARYDHYSDTESSLNPKVAFKFQPDPKVMFRGSASTGFRAPSLYNIYRPNQLQLTGKPFKDTGACVNGAPLPGTNGDACTEMQRNKRIAGNKNLQPEKSSSLSFGMVIEPTKDFTASADLWWTMIKDQISVLDESLIINNPALYADRYVRDANGNLSYLVDDYSNLGNLSASGVDLRLSWILPKTSFGVFTAGLDGTYLAKYEYQREKNGDYFSNLGTFKDGGPTFRWQHNLTLNWMYGPWSAILSQNYKSGYTDENPKKENHLVKPYSTWNLSASYAWNKQLTFTAGVKNLFDQEPPFSNQQTRTTQMNYDPRLVDPTGRSFFLKGAYKM

SEQ ID NO: 16310 - protein, 697 aa, Bordetella avium
MPKIFHSNNKRRILPIVNFLLVGGILPGSALAQNAPEDESVGLEQMVVTATRTETPISQLTRSVTVVTNQEIQQQAGLARNLGDVLAKTVPGLGPSSEALSSFSQTLRGRDFLVLIDGIPQSTPLRSSSRDLNTIDVDAIERIEVIRGGTAAYGFGAAGGLINIITKKPAKEALAGYSQASVRVSTEHLDDSAAWQTTQRVSGTKDNIDYLASGTFIQRNGYFDADGDRIPPDPLGNQGGLADTNEYNILGKFGFNFDQDRQRLQFFVNHFNIKQDTDFTFAFGDPNQGIKTPAVPGSFNAADPGTTNTLASMHYINRDLLGSHVKLNAYYGDLTARFSKFPGFAQTEIQSQKYGTRLTIDTPLAVRDYDFSLIWGIDFLRDETVQAGIDGPTVVPNMQENALAGFLELELPLSDLGLLRGGFRYEHISVDIDDIVNRGGTLVRGDTLNYGKPLFNASAVFYLTDEIEAFGSFSQSFSVADIGRAIRDANSSITSAGQLESNAQKVNSYEIGLRGGRGPLQASAAGFYSTSNNGTTFNQDLSIVKQPERIWGAEGTLAYRFNSQWNTGGTVTWVAGEVDLNDDDDYEEDLPNTRVPPVKLTGFLEYSPWRWWDNRMQVLYVGDRSPDSTQFGGGEVDDYTIVDLISRFKVGPGYLGVAVKNLLNNDYFPLVSQAGRLPYAFSTGPGRTVRISYALNW

SEQ ID NO: 16311 - protein, 711 aa, Bordetella avium
MQAVFRPQRRPLSVFLALALSALSAPALAADAEADAPQDRAATTLDQVVVTGSRIPRASLEGPSPVTVINAEQIDKQGFRSAFDALAALSQNTGVVQGEDYGNTFTPAANVLNLRGLGPNHTLVLINGRRQADYPLAYEGSVNVVNLANIPSALIERIEVLGGGASAVYGSDAVAGVVNFILKKKFEGTQLNVRVGGTEQGGGQNQRLQVVSGHSSDRFDAVYGVELSHRQAIWGDQRDFMDSLLDNPTGAAINPTQVGFRRNARTNNYIDPGAACGGLSGLYHGSTFRANNPRQGWYCGSNEAAPAFWTVQTQKKNADAYGLLTWHLSDRTELFADVQLGIASIENNTRAPSWTSDNNYFLNQASGLNEIWYRRIAPEEIGSAHANNNRFLERSWAFSVGARGALGDSDWNYELAYNHGRNENRTKRRQFLAGINEFFLGPRLGTTAAGIGIYNPDPARLYAPLTPADYQRLTGFYEGVNAAWIQNLSFSVNGNLFDLPAGSVGFAGVIEAGTQGYNNRPDPRLGDGTFWNTSAGSRSSGDRDRYAIGAELSIPIFSTLTASAAARYDEFRFAGRKSGKATWNAGLEYRPTDTLLLRATAATSFRAPDMNYIFAAETRGYNPGMTDYWRCRTAGQAYDDCDFSGLAIDYTSTGNTNLKPENGKSYGLGVVWSPSEHFDLSVDYYSVRLEDEVTNLSSSRILREEADCRLA

SEQ ID NO: 16312 - protein, 182 aa, Bordetella avium
MTQYFRSLAFFLLPVPATAMACDGWPSWARGACQRVDQIWNEGGNDLYLTGYSWHNRAMYSSDKIRSFNELAWGGGLGKSIYDEDGDWQGLYAMAFLDSHSDIEPIAGYGFQKIGRIGADTRLGIGYTVFLTSRSDIMSRVPFPGILPLVSAGYRDATLYATYIPGGKGNGNVLFMFGRWEF

SEQ ID NO: 16313 - protein, 702 aa, Bordetella avium
MSLNWKLARLVAALTLLPAPGAAEEPAAEPRTEVLLEEIVVKSRREPRADGLEVREVRETPARDLGEALEQALGVGKVRKAGIASDVVLRGLKRDDVNVLVDGTRTHGACPSRMDPPAFHLDWAEVDGVEVRRGPFDVSQPGGLGGVVDVRTRGARPGPGAEVNVGAGSFGAAESSAVASYGGGRASLLLGGAFKRSDPYLAGDGRNITEIIPATSTGRYRDTSDHQTAYDVRSGWAKVGLVPAEGQQLELAYTRQEADDVLYPYLLMDGIRDDTDRVNATWRAGAIGPLASARAQLYWTRVAHDMDDRDRCSSAADPAACAGGLAEAWSMRTEARTRTLGAKLEASLGGGDAALDARLGADLVVRNWDNETIRVRRAMPGQPYVGEASIPDVTQTTGGVYAELRRALAPSLRATAGARLDVAESYAGVDRRDFYATWRPGSSPERSRTDLLLAGNVQLDWEAARGLTLFAGYGHGTRLPDPQERYMALAGLMGKPAWVGDPSLRPTRSDELDAGLRFTADRLLAKAQVFHAWLADEITLVPLALPGGATAKTYAGVSARRVGGEASARLALPLRLYAGAAVAYVWARNETAGTPLAEIPPLRASASLRWDDGRFFAEAEEQWAARQDRVDPALGERPTAAWFITNLRAGAEWRGLKAFVGVRNLLDKTYAEHLSYLRDPFAAGVKVPEPGRTLYANVQYAF

SEQ ID NO: 16314 - protein, 393 aa, Bordetella avium
MKKTLLALTVLASFAQAAHADSSVTMYGIVDAPLEFVTNQASGAPSLAANGLPVPKPGGNRWSLNSSGGLSNSRWGFKGNEDLGGGLSAFFQLENGFGLTTGQLQQGGRMFGRMAFVGLKSSDWGAISLGRQYTSLLEVMATLGPINLATMYEPVTIETGSNYRQDSMIKYVGTFGKVMVEGHYSFSAAQVLYNGLPVANGGNGQIPGHFHDNTAWGIGATYTDGPMLLAFGVDQIFPSMATTGTGDNWTGTKIAVGGSYMVTSDLKLMGGYSYGRTTDQNGIVVYRGDYFWAGAQYAFTPLIRSGLGLYYNRLSTMKTSATAADGRIGNPWEVSFFTSYFLSKRTDVYLVTSYARNAALDMDSTANSNIDAYFLKQGAKEQLGVTIGIRHRF

SEQ ID NO: 16315 - protein, 984 aa, Bordetella avium
VQREEAPIENIPPGGAPDNGEEAANPAPLDREVILRSANWNGTRPMQPLENYRKPEHASFGVSPLQPKPTQAHYLNRIDLKPAQDAGLTGQGVRVAVIDNGIKNNPDVELKVDWAASRDYTSTGAEQAYDKDRQGEHATGVAQVLAAKADPTLVVEEGLVFRGNNKHYLGGVAPNATLVSANISTGPNSLTLSRAAMIAAWRDMSARGIKLFNNSLGTDAGNATVQTMNEYRKAYTEASPANKPKTIIGAVLQGVEQGGLFIIATGNGILGAGQSDPAAEAMLPVIEPKLRQGLIAVAAVEANGDIATWADRCGQAADWCLTAPGKAYIISTTADGTRKAEVQRGSSYAAPQVTGAAALLLEKYPWMTNDNLRTTLLTTAADRGEIGVDGVYGWGVLDVGRAVEGPAQFPFGDFRAKLNDPGKRYIFGNDISGDGGLQVSGQGTLVLAGVNSYTGATVIDGGILDVMNTITSPVQINPGGMLTGKGQTGSVTNNGAVYSAGAGLHVNGDYKQTAQGTLLASLGSLMTVSGDATLAGRLHIQGVNNGYVPKKSESVPLLTARQVEGRFDSFTHEDTLLLKGMLSYTQTSANIDLEQVETVLAARNLPEPDARQAPILAAAHNVDRVMDELDKAVAPDAPLGVRSLPSPAVQELLAGTAALQAIADPEQLRRSLYSLSGAVYANAAALQSLAQDQTLDSFGKQLSSKPQGGFAQYQHQQIRWRPSGLDGRQGNNAVTLGLSHRLNQDWNIAAALNTADRRWQEDFQAPTHDRSRGTTIGLMLGLRQALGEDGYVKYLAGLNSYSNRVDRHIWFDDNGDAVGANAKGHSLQAAAILGTQWKISTDSQITPEIGVMINHTRQQGFTESGGRGYGLRARPRQVTLPSLIGRLNATHHTAIGSVPLRLDASVQVHHDLRNRDFRTNGGFATMPISQAKSGQWNLARTRWGMGLGIQAAATESLSLGLAYQGEWSQNWTTHGVVANLRYTF

SEQ ID NO: 16316 - protein, 398 aa, Bordetella avium
YGERIINDQSKRKNIQFSYENFSQTPFWDHIKLSYSSQKITNKARSDEYCHQSTCNGVSNPQGLHLVEENGVYKIVDKDNKEFTGTYDGGLTLKNHKNKDVSNDVDTEAGKLDSVLINCEKLNCENKKFRIYQTKDENWNDSYKYDDREITIKKLPNGKKYGEISLKEGTERFLGELKKEIARFLFPKSSGYSEDSVNDRDLNTNTQQIKLDLDKEFSLWHTQHQLKYGGLYEKTLKSMVNHQYNTAANVQWWADYFFCNKLANGKHTPAPDYSAHRCSLMNTDKGKDSYLIPVTTKNNVLYFGDNIQLTSWLGLDLNYRYDHVKYLPSYDEKIPVPNGLITGLFKKFGPKDYVYGPAYRKPRDHTDCTYNSDCYKKNFQDNLALLLRRADYKHHSYN

SEQ ID NO: 16317 - protein, 380 aa, Bordetella avium
MKKTLLAAALLAGFAGVAQAETSVTLYGIIDTGIGYNKVKGAGFDGSRVGMINGVQNGSRWGLRGTEDLGDGLQAVFQLESGFNSGNGNHAQDGRLFGRQATIGLQSDSWGRLDFGRQTNIASKYFGSIDPFGAGFGQANIGMGLSAMNTVRWDNMVMYQTPSYSGFQFGVGYSFSVDDNTTDDDRVGFRTADNVRGITTGLRYVNGPLNVALSYDQLNASNAQAQDEVDATPRSYGIGASYDFEVVKVALAYARTTDGWFGGQGINGIGAVDSDADGVDDQFPLSSNRFADGFKSNSYMVGLTAPIGGASKLFGSWQMVDPSNDKLTGGEEKMNVFSLGYTYDLSKRTNLYAYGSYAKNYAFIDDVKSTAVGVGIRHRF

SEQ ID NO: 16318 - protein, 201 aa, Bordetella avium
VIKNSKYIPTNGNTIGYTFKGIDGLVLGANYLLAQERNYDDGEVGPQAISNGVQVGAKYDANNIVAKIAYGRTNYKYDVNKDKQQVNGALASLGYRFSDLGLLVSLDSGYAKTKNHKDKHEKRYFVSPGFQYELMEDTNLYGNFKYERNSVDQGKKEREQAVLFGIDHKLHKQVLTYIEGAYARTRTTTVGSGSSASEVKT

SEQ ID NO: 16319 - protein, 969 aa, Bordetella avium
MRRAPSSTRARRWRLAAVPLLAGALLQAPAARADGEGQADEADLHFDLGRDLYKQGQFQTALEHFLASNRLVPNRNVVFNIALTYEELGRFADAHRYYDDALEGEADPEVVAEVQAALQRIAPRVAVLQIVTSPPGARIYVDRKDLGARGTAPRRLAMSEGRYRILVELAGYEPVAVDDVPVKLGQSKEVLIVLRRIVGTVRVDVRGASEATVHVDHDGAPPACTAPCDLDLPPGRHVLHFSRPGFEAAPQPLTVAAHETVPITATLSPLTGSILVRADEPDALVEIDGRPMGFTPSVIQGVPVGRRRVRVSLRGFAPVERTIDVTAGQQAELRDVTLAPLREVSSASRVLERLEDAPASISVIEQHELRAFGYPTIAEALRGTRGIYLSNDHVVYSAGIRGLGEPLDYGNRLLVLSDGHSTNDNVLNAAFVGSDARDDLHDVDHIEVVRGPGSLLYGTGALSGIVNLVPRGRDEPTSAHASAGTYYDGVGHARAGFHYNASRDAGVQASVSGARSDGFDVPVALRDPGEGPRVQIAERAETFRAGGTSGRAWYGPFTAQWMYHAREQLVPIGYVGTRLNDLGTSYEDAHMMAEVRFEPRLTPDLQLMARAHVNRFVWHGAYAFDEGTVFEQQHGTWLGGELRAAWTPLPWLRVTGGGEVQEHAEATLSSVLADGRAHTKPVPYRFGAGYLILDSSPAPWVRLSWGARLDVYSTFAPIVVPRAAVILRPAPGGVLKIMGGRAFRAPSISEQFYTDGKTQVPAVDPARGLVLKPESIASAEIEYSQRLGDDWTALGAVHASKLSDRITSAEDIPGVPGVVRYVNSRRDAFVAGCDVELRREWRQGWMLAATYGYQRGELRRGERLINAPEHLASFRGVVPVVERLAAAGLRINLEAPRRIGRSSADETAGAIVADLTVSGELQRFHSRYVIGIYNAMDARYDYPAAESYLSATSRQNGRTFLAEITVSYP

SEQ ID NO: 16320 - protein, 471 aa, Bordetella avium
MPRASLSPENDKETLVRGNYVRVAVALCAAACGTPAGATDVFNLEGFGPVSRAMGGTGAAFDIGPAAMMANPATLGLMAEGNHLHLGLDMVTTDIKATNTATGETARSGNHGNNNGPYFAPEAAFVYRHDNIALGAGIFAEAGLGTQYGGSSFLSRTSNGVQTGLDQFSRLLVLRIPFAVAYRPTDKLTLGASLDAVWTSLNLGTLLDVTQIGTLASQRRVSGSLVPTLLSVPGLSGGYLGFSNSAPVGGGADAWGIGGKLGLTYDITPDTRVGLAYNAKTRVGDLRGQATLAAVSTVAGNIPLSGEVRVRDFQMPAQFTVGISHQFNERLSASADYQRVFWSSVMRDINVTFTRGGANLDLSLPQNYRDTNVFGLGVAYRFDSAWTVRGGFHYAQEAIPNGMLLAVVPAIPTTTLSGGATYAFGKDDAIDFALSVVLPKTVGNASQPNTAVPLTVRHSQLNAVLAYRKRF

SEQ ID NO: 16321 - protein, 749 aa, Bordetella avium
MRASLSAPFLRPWRAARLSCLLLAGTAFPVLAADPVPATATATAPKTKPAAKTASAAAQVTPDEEIVVRARKRDQMQVSSGGQLGALGNKKGLDVPFNIRSYNSSLILNQQSQTLGEVLENDPSVRTTFGYGNFSEMFVIRGFAVDGDDVSINGLYGITPRQLVSPELYDQVQVLNGASAFLNGAAPSGSAIGGNINLLFKHATNAPLTRITGDYTSSAMGGGSIDVGRRFGEDKAFGVRLNVAGKSGEDSVTDEYRHSTTLGADFDWHDRDNRTRITMDIDYENQGVNGGRPAIFLGSDVTSVPRPAAPSHNFGQRWAYNDLNYVFGMLNVEHDLTKNVTLYGAFGALTSNEKGNYSNPTVTDAATGSGTAGAMYVPYDQTNESTRAGVRAHFRTGPVRHEINAGGSGLWEDSAAAYAMALTPGTTNIYNTPQFAAPAETFAGGGVNDPQTISRTRLYSLFFSDTMSFFHDRVALTGGFRYQNMLINGYNYSTTGQGAMSSHYDQDAITPVVGLVIHPTRRTSLYFNRIEGLSQGPTATGNVQNVGEIFPPYKSTQYEVGAKYDTGRFSAALAVYEISQPNAYSVAVGNTGEFAFREDGLQRNRGIELTLNGEILPGLRFNGGGTVIQADLRHTAGGLQDGNTAIGVPNYTINGNLEYDLPFLKGATVVGRVVNTGKQWVNTANTLHIPVWTRFDLAGRYTFVTHHTPVTLRFGVDNLANTRYGSSAFNGYLMQGMPRTFKFSFTTDL

SEQ ID NO: 16322 - protein, 298 aa, Bordetella avium
MKKLPLSIAVSSIALAAAGVQAAETVYENEGLSLSVGADAAWVVEKSNTVDSDVQLSKDAADVNFKIASELNDDVTLFGYFSLDSGVLGDNYVGATYGATTLTVGKHATAADAFGIGKDQWFGFGNVIAKSSGDDVIKVAYEKDGISVAAATEYAATDAEDSLYDLYASVDLEGVSVAGFVQSTSISGADDTLFGASAAYSLDALTVGAEYSYSTETEVSALEVAGSYAATDKLTVAAGYGMELADANDEAPWGVYANASYDLTANASTFAEVAQYGGDGYADTQDDLGFAAGLSLSF

SEQ ID NO: 16323 - protein, 1064 aa, Bordetella avium
MILTSNINQGAGGLYFEGNFTVSPKNNETWQGAGVHISDGSTVTWKVNGVANDRLSKIGKGTLLVQAKGENQGSVSVGDGKVILDQQADDQGKKQAFSEIGLVSGRGTVQLNADNQFNPDKLYFGFRGGRLDLNGHSLSFHRIQNTDEGAMIVNHNQDKESTVTITGNKDITTTGNNNNLDSKKEIAYNGWFGEKDATKTNGRLNLNYQPEEADRTLLLSGGTNLNGNITQTNGKLFFSGRPTPHAYNHLGSGWSKMEGIPQGEIVWDNDWIDRTFKAENFHIQGGQAVVSRNVAKVEGDWHLSNHAQAVFGVAPHQSHTICTRSDWTGLTSCTEKTITDDKVIASLSKTDIRGNVSLADHAHLNLTGLATLNGNLSAGGDTHYTVTRNATQNGNLSLVGNAQATFNQATLNGNTSASDNASFNLSNNAVQNGSLTLSDNAKANVSHSALNGNVSLADKAVFHFENSRFTGKISGGKDTALHLKDSEWTLPSGTELGNLNLDNATITLNSAYRHDAAGAQTGSAADAPRRRSRRSLLSVTPPTSAESRFNTLTVNGKLNGQGTFRFMSELFGYRSGKLKLAESSEGTYTLAVNNTGNEPVSLEQLTVVEGKDNTPLSENLNFTLQNEHVDAGAWRYQLIRKDGEFRLHNPVKEQELSDKLGKAGETEAALTAKQAQLAAKQQAEKDNAQSLDALIAAGRNATEKAESVAEPARQAGGENAGIMQAEEEKKRVQADKDTALAKQREAETRPATTAFPRARRARRDLPQPQPQPQPQPQRDLISRYANSGLSEFSATLNSVFAVQDELDRVFAEDRRNAVWTSGIRDTKHYRSQDFRAYRQQTDLRQIGMQKNLGSGRVGILFSHNRTENTFDDGIGNSARLAHGAVFGQYGIGRFDIGISAGAGFSSGSLSDGIRGKIRRRVLHYGIQARYRAGFGGFGIEPHIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 16324 - protein, 366 aa, Bordetella avium
MKRVPMRSAVLTLAACCIAGEAAAQSSVTVYGRINTALEYSSASTATDGTHLGGTGRLTNNRSVFGLRGEEDLGGTLKAIWQIESNVSLDTGQGQIAGRNDRIGLQGKAGTFFMGHWQTPYTVSTMGYDPYYPTTAGYMALIGNGSASSSDNVQDTSSFDRRQKNIIVYQTPSFAGFSGSAAWGINEEKLTVPRNPGLYSFSAAYDNGPLNVALAYEIHQNYQVKGRNDDAMKAGVSYRFPSTTVALLYERLHYRTATGDLTRNGYYASLVQKLGPGSVKLGFALASNGTGNATETVGFFRSGADTGATQVTIGYDYPLSKRTTLFAYYSRIDNKKNAIYDFAINELGVSAGADPQTFALGMRHFF

SEQ ID NO: 16325 - protein, 716 aa, Bordetella avium
MSNSRYSRAALLASTTLSLALISAAVSAQEAADPESDTSTLLDEIVVSAGTDKVAIDTPQAVTVVTQDAIDEGVVGTASELFGKVPGVNAAGGDSIFGQNFNIRGFGPESTGSGQEGRVLVRVDGATKYYESYRFGGFFGEPELYKRVEVLRGPASSILYGTGLIGGTVSFTTKDASDYLEEGDTAALRLKGTYSSNQEGFSTTAIAAVKAAEDLELLFAGNFRDFQSLVDGNGDEHFLADRGTPSGLAKATYYVGGNRDRVLRASYEHTHFDGETSTTPGGTPFDPSSRTERVVEGITAKVSYEHSDDANPWLDLNFNASYSKQRNSDDEFINADMSYTYYEARLENTLEYNFAGYENYFLHGIDGKFQERRREDLDNTSVNTHPEGDETTIGLFAQNETLFNKNLSLTTAFRGEWKQMKAIGSTLEDSDGDPRAILPDDVNGFSFAASIAPRYEFNNGFAVFASYAYGERQPTIDEEYSWFEHVHQTINPGTVTTIVQGNLENERSHSLEIGFSQRLDDLLSEGDTFSYKLTAYNNYISNIIERGTTVIDIVPGRSGPTDVTIAPWENGSNGRVYGVEIEASYDAQFVFADAGLNLTRSSGVANTHPVADRIAPDELYLTVGGKLPEYDLRFGWDGRFVDAVDRPTSGATRSTKGFAEHDLFVTWKPTEGLFKGLEATARVDNVFDKHYENYLVTSTPAKGRDFKLSLARTLKF

SEQ ID NO: 16326 - protein, 996 aa, Bordetella avium
VKKSDVTGALTKVSEKQIKERPVQNALQAMQGKAPGVDITTNSRPGELGDVRIRGNRSITADNDPLYVIDGIPMVAGSIADINPNDVESMEILKDASATAIYGSRGANGVVLITTKKGKVGKVSINYDGTVTFSKIHSMTDWMDSGELIDWKRQAYINTGAYSGTYGNAPDPNIDGDLLFSDNGGGVSNYPYLNQYFQKAWEYNADGSYKMRPATDYEKEVLGYADQVPVYNSANIPTTPWTDYVTRTAITHNHQISLSAGSEKSNLYISLAYLDQESPMKDQDFKRYTANINGEIQATNFLKVGMGMNASHSIKNYGIINNTSNSTYKDSYGYAVAKMPFAPAYDEEGKPLNVDGGPSQYNPMLDVYQATNETRYYSVMFNSYGEIDFGKIWSPVEGLKWRTNLGTQYRNSRYGSYYGNDFSNPLKHSAYAANTAFNQQGQNLSWTLENLIYYNKIFKNIHSVGLTLMQSAEYSRAEGLEVRAYNCTFPTALWYSVGNSDLTMDSPGSSFSEQKRASYMARMNYGLMDKYLLTVTGRWDGASMLAVGNKWDFFPSAALAWKMNEENFMKDVKWINQLKVRVGYGVTGNASIKPYQTSGTMTASGAGKFFGVGNITQVTIGAKASVLPNLDLGWEKTASTNIGVDFGFLNNRISGSVEYYVAKTSDLLLAKSLPLMTGYTSITTNIGKTQNKGLEITLSTTNIQTKDFTWKTDFTFSTNKEEIVELAGGKVDDTANKWFIGKPKDEIWTLKYDRLWQNTPEDLRTLELYEKISKTVMQPGMAKVVDQPLIEVPEGTEGAKTVTLNSGERVTYMDNGFGTINTEDNKFLGSFQPKWIGGFTTTFIYKNWQLNSFVYARMGNMYYGLLQTYGRRVEKDVWSTENPNGKFPQPRSGGVTTTDYSAYMNYTKGNMVAIRNIALSYTFPEKWLKKLGAASCQIYGQVLNPFIFGGELVKSGINPDDTTGWSEKTNDTNFIGGQTNNTILTRSYVIGLRLGF

SEQ ID NO: 16327 - protein, 324 aa, Bordetella avium
VSQYAMASAQDDSKGFVEDSTFGINTRMLYFSRDFRNEPAGGYKINNDTGKSRVNETGLGFNALFQSGYTQGTIGVGVDVIGLLGVKLDSGKGRSGTGLFPTGADGRAQDDYSKGGGAVKFRISDTVLKIGDQYTTAPVFASDDSRLLPELPQGISITSNEIKGLKLEGGHFTSSVAQAQTYRDSLGLTKTDFIGGVYALTPEVSASLYYAKTEDYWKKTYANLNWTHALSNDQSLAVDFNIYSTKSDGAGLQRAEKDGTTKLDNRAYSLQGAYTIQAHTFTLAYQKVSGDGDYGYGVDGGGTVFLANSIARSDFNAEDREILA

SEQ ID NO: 16328 - protein, 703 aa, Bordetella avium
MSLVLGVGLGCSSPALWAETESPAELEVLTVTAEAERAEGPVQGYRANRSASATRTDTRIEDIPQAISVVPRQVLDDLDSSRIERALDFAGGVSRQNNFGGLTMFEYNVRGFTTSEFYRDGFSANRGYMNAPDSATIERVEILKGPASSLYGRGDPGGTVNLVTKKPQAERFARFHASAGSWDRYRSTLDLNTPLDDEGDLLYRMNLAVEDSKGFRDHAEGQRVLVAPSFSWQLNPDTSLLVEAEVVRNRQVFDRGTVAPHNHLGSLPRSRFFGEPDDGKIDNDNETLQATLRHHFNEQWSLRLASHYKHGHLDGYASENSSLAADGYTLRREYRYRDFEWHDSITQLDLLGDLHTGSIRHQLLMGLEYERYHNDELILRSIPSRNPYAIDIRRPVYGQPKPPFGRDDRNHEEVDAMALNLQDQIEFSEKWRGLLGVRFDRYRQDMNATRLNNGNFRDTSSQQTQRATTPRIGVLYQATAEIGLFANASKSFKPNGGTDVAGKAFDPEEGRGYEAGVKLDLLDGRLGMTLAAFHLKKKNVLTADPDNPGYQQTAGEARSQGFDLQFSGQLTDQVRLIGAYAYIDAEVTKDENLARGSRLLNVPKHSGSLMGVYEFPDGWLRGADAGAAVNYVGERAGDSNGGFELPAYTTVDLLAHYPLASNATLGVNFNNIFDRRYYERSYNNVWVAPGEPRNLSMSLTLNY

SEQ ID NO: 16329 - protein, 797 aa, Bordetella avium
MSARDVWGSISLAGLVAAGWAPAPMAHAQQAANSSGKPAAETVLPGVTVDAPRPRPVDGRAPSARPTSAQTARSAPRRPPASSPAAALSSATTGPTATTPLNGNATPASGSRLGLTAREIPATVEVIGAETLRERGYHTTVDAVKGATGVSAGDAPNDVGFAMRGFQGNQINVLYNGINIGPTGFTALTMETFNLDRVEFLKGPSSLSSGQGAVGGTINFVTKAPHTGPVESETFIGFDQRGTFRSGFGSGGSTTVRGLDYRFDISRTREVGFIDDTEFKNVHVSGQLNYRLSDSFRTFVAAEFKDYKAKPYEGTPLVPVAFSGANATSGIVSGTKVSDYNGTNLGAVTIDGRTLSTNYNVIDGHKTIKESWVRSGFEWDLNNAVTLRSQIYNYNASRDWYNNEVSAFNAGTNLVDRERFFVHHNHNIVGNVTDVTWNGSIFGLSNRMVASVESSHTDFTRPGAANFPGESVPLVGFDRGTYGLLTTQLQTATIDSVAINLEDRLKLTDSFALVGGLRYNPFTLDRNWIRNGAERPGFPYSKSWQPVTGRIGYTWEALPGTTFYSQYATASDISADSIFLLSPTQNLTLSDSRSYETGVKQLVWNGRAEWTFSAFDIERNNVYSAQAGQQLNLAGKVKSQGIELAAAVRPTTETRLWGNVAYVRARYADYDLANGGSFSGNTPPNIPAVIVNGGGSYRFLNPGWWPVELGFSVRHVGDRWSTDANTVKLLAYTTADLFAFIDLPKVPLFATATSTRLAFRVRNVTDKRYAAWSDPFYPDQIFLGAPRTYEVEASFKF

SEQ ID NO: 16330 - protein, 467 aa, Bordetella avium
MRFTRYTTPFFSLLLSGCVVGPNYAPPEMPLPAKFSEGGVTSNGDVTVVAWWTAFNDPMLTSYVEQGISQNLDVQQAIERIDLAAANVTIAEASALPDLTLSGSHTVSGQKGKLRKQTYTSNTSTGELSLSWLLDFGVYKRNTESAEAALDAAYASVDMAKLAFINDIISSYVDARYYQRRLALSQANLKSRRETFELTKSKFAAGAVARMDVVRAEGLVQSTLAEIPSLDANFRISAHRIATLLGKPAGSMVEEIAKGSNQPAFRADVNVGIPADIIRNRPDIRKAERDLADSTAQIGVAEAKLFPSITLSGSISPSGGINERGVYGNLTPWSFGPKLKLPILDGGGLRADVDSAKSKATVSYLKWKSRVLNAIEQVENALVAMQREGRTVRALKREVEIAQETLRLSTSSYKDGASSLLDLLEAQRSLSVTQASLARAVQEWAKLYAVLNIAIGSGYNPVAKAGL

SEQ ID NO: 16331 - protein, 975 aa, Bordetella avium
MSNRFNKAALLTGTIMAGAMVATPVYAQDGDDEAALQSGADANRDDGLIVVTGSRIAQRNVETAAPIAVVQDEEFKLSGTVNVENVVNTLPQVVPGFTSNSNNPGTGTATLNLRGLGSTRTMVLVNGRRWMFYDTAQIVDLNTIPSFLLDSVDVVTGGASAVYGSDALAGVVNFRLKDVEGIEVGGQYSLTQEGDGARYNIYGAIGTSFDDGRGSATVFAEYFNRKPIFQGDRDFSFFALGGETSRVPQQQFGSSTLPNGVIRYFGNGTRTGTDFAANRAVVFDDVAGDFRTRTGDLYNYAPVNYLQIPQERYLIGGYADYEFADGHEAYMEVSFVNNRVAQELAATPVTGTFNVDLGVIQPFLTPSDFAQLQQLDRTETGTGASAPNNNQLALFLQRRTIETGPRNSLDERNAFRVLGGVRGSLTDWLNYDAYYMYARTRNANVQEGNISRSAFQRGLDGTDPAINIFGLNTLTPAMVNQISIRAQNGDISTLEVANAALSGFIGDLGFGGGDIGFAAGVEYREVASQFIPDTALASGDVIGFNAGSPTEGGYNVREFFAELNVPVFETDGGTRLELTGAGRYSDYSLNAIGGVWTYAGGAELALVDGIVLRGQYQRAVRAPNVGELFGGQAIGFPGATDPCGTAAATPGSALGNICVANGVPAANLGSSQIQLNTQIPALFGGNPLLQEETSDSFTAGIVLQPSFIPGLTITADYFDIEVEDAISTISLQQSFDLCFNQVQNPAATACQPFFAFGPIRNAGGAITTANPPVLGPQNVANLGVSGVDLQVNYTTTIPFSLLTDTGEQTVNLNFLGTWTESASFEAFPGANVVECAGEFGQTCGEPTPSFKWTSRLSFVDGPLTTSIRWRHLSGVEDDDDTVDYAAFNGVERIPAYDLIDLTFSFDVNEQVTVAFGVNNLFDELPQAPVFTAGSVVVQNQNDGTRLGDNQEQANTYPSTYDVLGRDFFVSANFRF

SEQ ID NO: 16332 - protein, 538 aa, Bordetella avium
VQKKPTFTPQGEVKVEVGNNQHQSVGFDIADEANDAGTIRYRLVGLMTSQDGELDGTNNERFYLAPSVEFDISDRTMLTVLATYLRDDGVPTNPFFPAAGTLIGSNFGKIDPSTNLGQPNYDKYERTQFSLGYLLEHDINDTWSFSQNLNYGSNELYLRSSYAFSNNDPAKEELAQGIVFRDGKNQSITFDNNAVGNWMTDNAEHTVLVGMDLQFHKTDGDEQDNYAFGTINPWNPVYGNFTPLDPANNVKREIEKSQASLYSQYQLKLHEQWIGNVGARYDWVKTENSGKGATVDQSESRDDGQLSLSAGVMYLANNGLSPYANYSQSFEVISTIDAATNELYKPLEGEQVEVGVKYEPSFMDGFINLAWFDITQKNALVTNPSTWIATQTGEVTSQGIELESTAQLTDDLKLMASYTYTKAKTDESFGQGKKQAALIPEHQASAWVDYSAYSLIPGLNIGTGVRYVGESKDNPKSSNLTVPSVTLWDASITYDITSQWQAQLNVNNILDKEFVSGCDYWCYYGQSRSVMLNANYRW

SEQ ID NO: 16333 - protein, 1096 aa, Bordetella avium
MRPLKISGQALLLAAASTMPFTAYAQSTPDGDEAGDGEENRIVVTGSRIAVDPNIGSPAPVISVDAEALTQAGTPDVVDVLRDIPALSTSTTAEGSIDGVFAEAVGQSILNLRGLGANRTLVLVNGRRHVSGVAGEQAVDINSIPTALIERVETLTGGASSIYGADAVTGVVNFVLRDDFEGLQANVQSGISDQGDSWRINGDVTWGVNFDDGRGNFVISGEYAYGEELQFGDRAFSRNNGIFDDQANPALRFQTGELNATDTPNFIANGSVIGGLIPTSADGFTPTAAEQALIARSVNAPRRFIAFDPRFSLSSAGGIVAPGDIGLSDGPDINGNGTPDCLESAVGFNSTFNAGAFGLAGGCAVINNDGSLSVYQDGLITGLFNQFGGDGIPNNFDVNSLIPETERWSVNANLTYEISNAATFFFEGKYVSNSAEFQAQPNTFYDLLTIRADNPFITPDLQQYVAPLFFGDGVEEGLYLTRDPADLGPNRNRNEFETYRFVAGFRGDTSDYFSYEVSANYGKFNQTTLDANRVIMDRFFAAIDVVTGPGGSPICRSDIDPTAPATTPFGIPAGDPGFFTFNPGDGQCRPANVLGGVGAISQEAIDFITTTVVNEFELEQLVFSAIFTGNTGAFLELPGGPIGFAFGLEYREEESTSEFDPLVRGVIPVTTPDATEGALLRDLGFSQNSLVFDPASVISNAGGQYDVYDIFTEVRLPFLANVPGAELLELSGSARFSSYSTVGDTFTWNVSGLYAPTQDILFRGTYSEAVRAPNINELFNPAQGAFFRPVDPCDVGNLVTAPDAALRQANCTAFFNQIGFDPTFGTGTYSYVDPLTARFSGSISGNPNLEEETATTWTVGAQITPRFLPGFVLSVDYYNIEIEDAINPVGSQDIVDNCVDSASIENAFCGLIDRNPATGGFTFLRQSSLNFARQETAGVEAVMQYQFGVGPLDFTLNASGTWVDKLNNFFDPSDPTLVDPELGELQRPEWAGRASLTADYERFSFTWSTTYLDSMGLRAVEIEEVGNTGADTFSVANGLSGDAFIHDIQFSFEASDMLNIYGGVNNVFGRNPFLTEQAYPVSPVGTLFFLGATVTM

SEQ ID NO: 16334 - protein, 162 aa, Bordetella avium
MCRSRAERRTLLREAGYIGNAVLGTSASYRGLRVGFTWGFGGVAGAFTQNEVMSLGLAYNNGPFAFGAGYLFAKNPNFSLFGTSATSNAPAAANALNITSPVFSGYAAAASQRVFGAGASYQIGKATIGTLLTSTQLNDIGGTPVNGAAPAIGVVGTLSAAR

SEQ ID NO: 16335 - protein, 385 aa, Bordetella avium
VLSALPLASVADVSLYGEIKAGVEGRNYQLQLTEAQAANGGAGASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 16336 - protein, 505 aa, Bordetella avium
MTTQRSTSGASKFALLAVSLPALTIATPAFADDTAAPAAAASAAVAQAAPASPATPVSPAKPKLKHTPNTTEVQPETNNALVNAEAEQAVTPPEQLSSQAKSKGLIADSHLNLLFRNYADVFDNEGGPHRHAWVQGMQANFESGYTQGLVGLGFDASLFAALKLDGGNGAGNMVHVAKGGGGSDQLAWAYPGMYDIKARISETVVKYGLQTVDNNPFMEPHDNRSLPPTFLGVSAVSNDIHNVTLEAGSFSKVNARGHTYLTDLTSSYGGVTIKRLSYFGGNWDYSPNGTVTLYADQAEDVWNQFYAAVSHSIGDVNTVKWAGLANIYSTHQTGSALQGHINNNAYSLSLSAQHGPHQVLLGYQQILGDQFFDYVNETNGIYLVNSMDVDYNAPHEKSFQLRYTFDGKYAGLPGFKAMLWGVTGWGADASAGAASGAIGPYTRNGEYVHGTHHEIGFIPSYTLQSGRFKDTKITFIAMYHKSTAHYSDPDNMEYRLVVNVPVKVF

SEQ ID NO: 16337 - protein, 184 aa, Wolbachia endosymbiont
YNGEFLPLFTKVDGITYKKDKSDYSPLKPSFIAGGGAFGYKMDDIRVDVEGLYSWLNKDADVVGDTVADNLTAISGLVNVYYDIAIEDMPITPYIGVGVGAARISTPLKTAVDSQTYKFGFAGQVKAGVSYDVTPEIKLYAGARYFGSFGAHFDGEKSDPKDANKKVADKDAYKVLYSTVGAEA

SEQ ID NO: 16338 - protein, 185 aa, Wolbachia endosymbiont
SYYVRLQYNGEILPFYTKVDGITNAKDKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVVYSTVGAEA

SEQ ID NO: 16339 - protein, 72 aa, Wolbachia endosymbiont
QYAGLFQRYGEGTKKMEGYTYNIPSLFVEKLQVHRLVGGYDNNALYASVAAQQQDAKLYQNQIVRDNSHNSQ

SEQ ID NO: 16340 - protein, 192 aa, Wolbachia endosymbiont
RLQYNGEFLPLFTKIDGIDYKKGTDIYSPLKASFIAGGGAFGYKMDDIRVDVEGVYSYLNKNDVKDVVFTPADTIANSLTAISGLVNVYYDIAIEDMPITPYVGVGVGAAYISTPLATAVSSQNGKFAFAGQARAGVSYDITPEIKLYAGARYFGSYGAHFDGEKADPKDAAKKVADKGAYKILYSTVGAEA

SEQ ID NO: 16341 - protein, 185 aa, Wolbachia endosymbiont
SYYVRLQYNGEILPFYTKVDGITNATGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPETKLFAGARYFGSYGASFDKAAKDDTGIKNVVYSTVGAEA

SEQ ID NO: 16342 - protein, 145 aa, Rhizobium leguminosarum bv. trifolii
LGIYTRLGGMVWRADTKPNVHGKNHDTGVSPVFAGGVEYVITPEIATRLEYQWTNNIGDAHTIGARPDNGMLSLGVSYRFGQAEAAPVVAPAPAPAPEVQTKHFTLKSDVLFNFNKATVKPEGQAALNQLYSQLSNLDPKDGSVV

SEQ ID NO: 16343 - protein, 177 aa, Wolbachia endosymbiont
EILPLFTKVDGITYKKDNSDYSPLKASFLAGGGAFGYKMDDIRVDVEGVYSYLNKNNVTDAKFTPDTIADSVTAISGLVNVYYDIAIEGMPITPYVGVGVGATYISTPLKDAVNDQKSKFGFAGQVKAGVSYDVTPEVKLYAGARYFGSYGANFDKSGGEKDKGGHTVLYSTVGAEA

SEQ ID NO: 16344 - protein, 778 aa, Anaplasma marginale
MSHELAAHVARTRLAAACVAAFAWPAAHAVTTGAAVPADSTSAAAAETTASGKTLDIVRVTAQRPAFASDTPGVVEALTREQIDSHVNVTTEDALKYAPNLMVRRRYIGDRNSVFAGRDFNELQSARGLVYADGILLSNLLGSSYSYPPRWSLIQPDDIARVDVLYGPFSALYPGNAIGSTVQITTRKPDRLEASVSTQFFTQRYRDGYGFADSFGGNHQTARVADRVGRFWYALSLDRLENDSQPMQYASPNGTFDPRLGASVPVTGAVSDIGPNGRPRTIVGAQTIERTEQLNETLRFGYAFTDHVDATVTLGHWENHYRQHGDTFLRDAAGNPVYGGNVSFGGRSYTVSPTAFAPQTGDQENWLYGLGLDARLASGWKLSATASAYEVSRDVLRSASGAPTGAWDGGPGTVFHGDGTGWRTVDLRAESPDVRGHRFSFGYHFDTYFLRNATYNTADWQNAVPTTLANRYRGNTRTQALYAQDAWRFAPGWLATLGLRYERWDAYGGQLGNANATLGYAGRGATALSPKLALEWQPTDAWRLRLSFATGTRFPTVAELFQGTISNNAIVNNNPNLQPEKAIDWDFTAERDVGFGVVRTSVFQSDLRNSIYSQTTVAGASTYTNISNVDRVRVRGVELAFSGQDVAIKGLDVDANVSATNAQTLADAANPNYVGARWPRIPRMRANLLASYRFGEHWMTSVGVRYSGRQYNALDNSDVNPNVYGGTSSFAVVDLKARYRFDRHWLASFGIDNVTDRRYYVFHPYPGRTFYGELKWSL

SEQ ID NO: 16345 - protein, 141 aa, Pseudomonas aeruginosa
RINGNIPMNAIQPKTMVYGLGYDHPSQKFGFNFYTTHVATKNPEDTYDIYAEDKRQTDTSIKWRSKSYTILDLIGYVQPIKNLTIRAGVYNLTNRKYITWDSARSIRSFGTSNVIDQSTGLGINRFYAPGRNYKMSVQFEF

SEQ ID NO: 16346 - protein, 780 aa, Syntrophus aciditrophicus
MNRHRRPVRRSRVPRLATLAAALFASAAVAQSRVAIDIPAEPLDAALNALARRAGVQLVFASALTAGKTAPRVQGRYSIEETLHRLLAQTGLTARRQGDDTFTIEAASSGAEVTLPATVATAAQAESANGPVRGYVARRSATGTKTDAPIEEIPQSISVVTRDRFEAQGAQSVNEALRYTASVSSYGAGTRSDWYTAVRGFVPATYLDGLQLPNTINLASWRVDPWQIERVELLRGPASVLYGQGDPGGTVNIVTKQPTTEPIREIEVQYGSHARKQVAGDFAGALDADGKLSYRLTALARDGNLPLGPFNDQRLMIAPSLTWKPSADTTLTLLASTLRDKTNASDSFLPAQGTILPNPNGKIPATLFTGSPDFDAYEKTQYSLGYQFEHRLNDTWTVRQNARYMHLKLDDRMTYGVGLDPSDPAQRTLLRYAGIAQPSYGRLDIDTQAQARFATGAVRHTLLAGVDYQRQTAKDPEDYALTSSLDLYNPVYRPTDLSIFSGVGASPQDIRQRQTLLGLYLQDQVKLGERWVFTVGGRHDWSETRTDDRLGGTTGSQRDSAFTGRVGVVYLAPYGISPYVSYATSFNPTIGTDRNGQAFRPTKGRQVEAGVKVQAGSKASVTASVFRIHQTNVLTPDLDDPSGTHSAQAGEVRSQGFELEATVQPIAGWNVIAAYTYQDVRNTRANDATLDKWPIAIPTPRQIASLWMDYRIRTGVLQGVGIGAGVRYVSPVAGAPDNALKVPGYALFDAALFYNVGRHWHLALNGTNLANREVISGCYL

SEQ ID NO: 16347 - protein, 800 aa, Syntrophus aciditrophicus
MYRSKLSRSILLALSMASAGGAIAAEADAVDAAGGSHAAPTQLDAMLVTGTRASNRTQFETLAPVDVFTKEDITSVESTDLKDVLAQLVPSFVVQRLPMADGQVFVRPATLRGLSPDQTLMLVNGRRFHRSALLGNRGAQAADLAQIPTSAIKRIEVLRDGASAQYGSDAIAGVINIILEDGPGTEITAGYSQYAQGDGASRDFSARTGWSLGDYGSLVLFAESSNSDATSRTRQRPDAIAFQAAHPELDVPNPVQRWGQPELESRRVGFNVKANASETLELYAFGLYSHSDGVSDFNWRNPDTTTGAYRTTAIFPGWNLRSLYPVGFSPQYGNVQNDLQLVGGLRGEITPKLRWDVSASYGRNAIDYSLKNSINASLGPASPTAFDLGRLTQTEKNANADFNYEWDVAALSKPINVAFGGEFRQETYQVRAGDPASYAVGPGAAAGLEANSNGAPGFSASQAGQWSQRSKAAYVDMEVPLGERWSIGAASRYEDFSSFGSTLDGKLSARFAITPDVALRGTVSSGFRAPTPAQLNTTSTTQGLDTRTLQIFTSGRLSPNDPLAQLLGAKPLKPEESRTASLGLTWRTDLGLSGSVDVYQIKLTDRFSQSASFAIPAGTPNPLGYTSVNYFTNDFDTTTTGVDVVGNYLRDLGAGRMTLTLAYNYNRTRVDNGSTSVATNETQRVLFEDRLPEHKGSLTSSWDIGAWSLMARMRYYGAWTDSSGNAVGDIYQRFGAMSFLDLAVGYRVNEHHSLRVGADNVFDRYPDEATFQASRGLVYSRNAPYDTDGANLYAQYRLTF

SEQ ID NO: 16348 - protein, 332 aa, Syntrophus aciditrophicus
DISRVKEKTTVNGVTTKDTTKTATEIADYGSRIGFKGHEHLSNNLNAIWQVEQNTSVAGTDKGWGTRESFIGLEGGFGKIRAGKLNTPLKDSSDSIDPWEASDANSDVLALGKFERVEDRKVSVRYDSPVLSGFSASVQYQPRDNANPKDKYTHEVKTGASYHAGLNYENAGFFGRYAGQFAKYDLKKADRDDVKAAREKNDWGLEVGDVTGISVKDHQTHRLIVGYDANNALFAVAGQYDASKNVDSGKKNEQTEVAATAGYRMGNVMPRVSYAHGFKAKKDGEKQGNSQYNQVIVGADYDFSKRTSALISAGWLREGKGDNKYEKTAGTV

SEQ ID NO: 16349 - protein, 129 aa, Syntrophus aciditrophicus
GDTVFQERTVGEEIYLRRETRHANGPFQLVYGLSATSDGELWAGIGHAYTLTNRRENLFLQFHAMAGLYEEGSGVDLGGPIQFRSGLEVGYQNKTGVRMSVGVDHRSNAGLYSNNPGLETVHFRVSIPT

SEQ ID NO: 16350 - protein, 840 aa, Syntrophus aciditrophicus
MRPQTMRQNSMRQTAASTVRPSQAAPALRPVALALQVLCAGTLAGLAAAGALAPAQAWAQPAAGASQQRQYSIAAGPLESVLNQLGREAGVLVTFGSAVTEGLRSGGVSGRFTVEQALDRALLGTPLAAVRSAGGGYTLREMPVVPAASAAGAAGAPSSQTLRTVLVTASAQASPTTEGSGSYTTPATAAATGLSLSLRDTPQSVSVLTRQQIEDQGLLSLNDAMRSVTGIHVVSSDSDRSDFYSRGFYVDNLQYDGVPTSIGLSFYGDSGTDTTIYDRVEVVRGATGLLTGAGNPSASINMVRKHANSKVFTGSASASVGSWNHHRGTVDLSMPLTQDGRIRARVAGMAEERDSHVDLYHARKQVFYGVIDADLTPDTTLSVGADYQANRPTGSTWGGLPLVFTNGMPADWSTSKTTAANWTRWNSTNKNIFANLQHRFGNDWKLKANFVHRDSAYDAKLLYLMRQPDITTGLGMAALPNYSEYSFQQNSADLQVTGGWELGGRRHEAVVGLTSSRAREHKAGHARTSPLQDVGNYYQWDGSYAEPTWGPLTTSSLDHTRQDALYGALRLSLADPVKLIVGGRQSSWKVRSLSENRSHDVFIPYAGVVLDLSEGFSAYASYTDIFQPQNYRDRGGSYLDPVAGKSFEIGIKGEHLDGRLNSSLSVFRIQQDNVAQLDEGQVAPGTTDFAYYGAKGVTSKGFEAQVSGELATGWNLSAGIAHTVARDAQGLSINAWAPKTQAQLFTSYRLPAGWNQLTVGGGLQWQSRTRASVFVAGNDLVFEQKSFATASLMARYAFSPRLSLQLNLNNLFNKKYYVNIDGQGQFGTPRQAMAVLNYKW

SEQ ID NO: 16351 - protein, 274 aa, Syntrophus aciditrophicus
MKRICLAILAACLSVSAHAQHAGDNVAVLGWFHVMPKDSSTPLTTNVAPTPINTPLRLPNSFTSAGTSLSTNTANTVGLVFSHYLTDHIAVTTVAGVPPVFKIYGHGTIKPPGPAGALGQQDIGDPQANPIVKSVRQWSPALLFQYYFNAPTAKFRPFVGVGVSYNWFSDIQLSQNFVQSTQENLGAILAAGAGKPGKTQVSAKASSSWAPVFNAGLAYNITDHWGLVASVTYIPLKTTSSVIIKAADGTELGVSRAELKADPLISFLAVSYKF

SEQ ID NO: 16352 - protein, 1091 aa, Syntrophus aciditrophicus
MAKKMLFLFVLLLSLTGMLKAQVTTAGMSGKVMADEESVIGATVVAVHEPSGTSYGTVTNVDGRFSLQGMRSGGPYKVTVSYIGYQTAIYTGIQLQLGETYSLNVTLHEASELLGEITITASKSKFSAEKTGATTNISSEQLTTLPSINRSISDFTRISPYASGNSFGGRDGRSNTFTVDGANLNNNFGLSSGLPGGGNPISLDAIDEVQVVIAPYDVRQANFIGAGINAITKSGTNAYRGSAYMYFNNEVMRGNKIGDTDFGVRAEESKTVYGATFGGPIIKDKLFFFANVEYEKSPQQVITWRAAKEGETPNNSTISRTTEADLAEFSQILKDKYRYNTGSFTDFPADVTNLKLLGRIDWNINQGNKLSVRYNFTNNKTWEAPNGSSGNTGYRLAYNRVSAYSMSYANSCYSLQNIVNSATAELNSRFSSNVSNQLLFTYSDMKDERGTNSSPFPFIDIMAGYYENGNQILEPYMTAGYELFTYNNLVKNTVMTIVDNFTYYLGAHKLTAGISYERQKAGNSYMRNGTGYYRYSSFEDFKNGAAPESFALAYGYNGNTKPSADVKFGQLGVYLQDEWNIRDNFKLTAGIRMDNLSFLNDIMRNQAIYDLDFNGMHIDTGAWPDSKLQFSPRVGFTWDVFNDKTLKVRGGSGFFTGRIPLVFFTNMPTNSGMIQNLVSITTRYKDGVVTSRDPRLELLKGNMITDVNQMISTLGLPTSISPEEGVLPSSVVGIDPDFKMPQVWKTSLALDYQLPVSFPLTVTLEGMFSKDINAVRQYNYNVQAPDKDTWSRFNGPDDRYIYPENFLQHTNISSANVLTNTSKGWGWTGNITVMAEPAKNVNIMAAYTHTESKEISGMPGSDANSAWTNVPSINGPNSSGLMRSQYVTPNRVVASINWRVHLNKKTSSNFSLFYSGYSSSGYSFMYSNDMNGNGVTNDLIYIPKTKDEIKFTSTEDADAFWKFVNQDPYLKKHKGEYAEAYSARAPWVHRFDFRWSRDFFVKIGKTKNTLQLSLDILNIGNLLNSKWGVTKNMSGANGGRILTYKGKDESNTPIFSMYKDSDGNYPTESFTRNLNYSECWKLQIGLRYVFN

SEQ ID NO: 16353 - protein, 262 aa, Syntrophus aciditrophicus
MMEFILSHVEKGVMTLTLNRPERLNSFNDEMHAQLAECLKQVERDDTIRCLLLTGAGRGFCAGQDLNDRNVDPTGPAPDLGMSVERFYNPLVRRLAKLPKPVICAVNGVAAGAGATLALGGDIVIAARSAKFVMAFSKLGLIPDCGGTWLLPRVAGRARAMGLALLGNQLSAEQAHEWGMIWQVVDDETLADTAQQLARHLATQPTFGLGLIKQAINSAETNTLDTQLDLERDYQRLAGRSADYREGVSAFLAKRSPQFTGK

SEQ ID NO: 16354 - protein, 613 aa, Syntrophus aciditrophicus
MVLKATPGVSLFRRTGSDAANPTIQGLSLRGVAPSGAGRALVTLDGAPQNDPFGGWVIWTALPGEGLSGATIVRGAGAGPYGAGALTGVVALRERAAGGGLSSLNAQVGARDSWRAAGTFGTDHLLLTASGSRTDGYDPVRDARRGAADTPTTLEDGSVAVRLQGSLTSVRWALRAGAYQERRDAGLVGARSNATGGSLALTLADDAWRLQAWARRSDLENSSVAVAAGRVSTTPANDQFSTPATGYGLNAAWQGRQGGWAWELGGDVRATEGRVNERFRYQSGAFTRVREAGGRTLVGGLYAETALAREDVSLTFGARLDGWRSYAGVRRERDALTGAATLDAPISDASGATPTARAGLRQRLKGDTWWRAAAYAGFRPPTLNELHRPFRVGNDVTEANAALKPETLYGLETGLVGEGTVRWSLAAFYNQVQDPITNVTIGAGPGSFPVAGFIPAGGVLRQRRNVGEINAYGVEGDVELDLTSAWALRGAVSWTHARVDGARGAPQLTGKRPAQAPAVTVTAGTRWRPIERLSLDAALRYEGLRYEDDLNLRRLKAGAGLDVRAAWRLTPASEIYVAADNVLNHDLAVGQTADGVTSYAAPRTVFVGFALRR

SEQ ID NO: 16355 - protein, 1099 aa, Pseudomonas putida
MPHLILENKNLILFLNLKFNFMKRRGLIFNSRPNKTAVFALGLMLGLCPVSKAWADTNMKDSQVVAQAQKKVKGQVVDAIGEPLIGVNITVIGGTEGTITDIDGNYTIGVPAGAKLKFSYIGYKDQIIDVAAQTVINVKLQEDSEVLDEVVVVGYGSQKKETLTGAVTVVSDKMLKNKGTMSSPLQAMQGQVPGVTITRNSAAPGDESWGLKLRGSVSANNAEPLIVIDGVAYDGVNALRNINPSDIQSINFLKDASAAIYGSRAAGGVVLVTTKQAKEGKARIEYSGSYTYKMVGLQPELMTMNEWANAVLQTCQNDGQPDSYSWVKYAKMALANEGKYIDLDHSANPFAPSYSDVMDFVFMDTNWQDVLFGNSYSTQHDLAVSGGTEKNLYRLSVGYMYDDSNLKWGNNNNQRFNLRLTNKLKVFDNFSIESVIAYNRQDQVAPSQLNRTLTSSYPQPGLPASTIDGKPYSWGTWLSPIWFAELGGDNKLKVSEINISEKFTYNINKHLDVVANLGYNSGVASRDIKKMAITSYNYAGTKINTKADGYKQEESSYEKTSSRTDFYSMAGYVDYHNTFAQHHNVSAMVGTQYELKEYDYFGVSVKDIQNSLETVNGAGLVNLTDKHGTKWHEAVMSYYSRLNYNYKSKYLLEVNMRYDGSSKFKPENRWDFFYGISGGWRITEEAFMKNIKWLNDLKIRLSYGEVGNQSGIDRYDGTQFYKFESQSGAYIGPNKGTIIDTNGKIASLGREWERIKNYNLGLDFSLFNSRLTGTAEVYMKRNDNMLINVSYPGVLGDNAGMSNNGKFRSHGWEVMVNWSDKIGKDFTYHVGGTYSFNTNKLTDIGAVSVLKSGFVDKQQGYPLNSIFGLRYAGKAQTEEERQKYLYRFLTGNTIGLTEQNFRLGDNMYADVNNDGKLDQNDIVYLGTDDPKISFSFNVGAEWKGFDLSLVFQGAAQRTIFRTGDNNGNEIWRIPMKALYLNTSNQSVGNTWSPENRGAYYPTYSNKNEINDYNYQASSWSVEDGSYIRLKNVTLGYNVPSAFLAKTKAISSCRVYVAGADLWEYSKINDGWDPEASRKVSAAGRFPFVRTVTFGLNLTF

SEQ ID NO: 16356 - protein, 294 aa, Pseudomonas putida
MARTTGTLGMPDTLADDAARLFTGARTQTALDVGVTNWTAGFNYDLTPIVGVYGRASRAHRAPSEGANEGNVNIPTAEQYELGTKLNFATLDVFATAFYTKYDPYNIGTSAVNPLTGAAESKDYRGSVTNPGVEVAAVWTPAQWLRLDANVTYNDTKVSDLTEVVANGAVAVVDVDGNMPNRQPKLYGNVGPTLLFSTGAFDWDTSLRYAYVGKRYADLENTTELAAYHTLAANILVRNGPWDVQLAVDNLTNAFALTEGNPRTDTISGQGTREPIYGRPIYERNTRLVVTYHF

SEQ ID NO: 16357 - protein, 216 aa, Vibrio anguillarum
KRKVLRALWIPTGTFILNPEKEGHLVPSSVWTTFAGMRSSNDAILDNYLNNNTLLPIKHMCIFGGVVSSVMEQTSDNPNNFSSTQAGHNLGMKLPLSSNTVVCATFTQLHGSSSQDNIPGKSHSHMLLGTVAAFKNWRALSLRSSISYAEESHVMKHQFSKKDITRGSWKNQGFRSTVGLSYAYPKGIRCLKITPFVDLEYTVVNQNPFIETGYDP

SEQ ID NO: 16358 - protein, 351 aa, Aeromonas hydrophila
MKKTILAIAIPALFASAANAAVVYDKDGTTFDVYGRVQANYYGDTNEADSTAASGYKDVDGELKGSSRLGWSGKIALNNTWSGIAKTEWQVSAENSANKFDSRHIYVGFDGTQYGKIIFGQTDTAFYDVLEPTDIFNEWGSEGNFYDGRQEGQVIYSNAIGGFKGKVSYQTNDDQAVKVADVAGGIKTTVFPDVKRKYAYAAAVGYDFDFGLGFNGGYAYSDLEGKTTDATGKKSEWALGAHYAINGFNFAGVYTQADVKNDTTGYKDEGRGYELAATYNVDAWTFLAGYNFKEGKENANLSGSSYKDLMDATLLGVQYSFTSKLKAYTEYKINGVSGKDDDFTVALQYNF

SEQ ID NO: 16359 - protein, 355 aa, Aeromonas hydrophila
MKKTILAIAIPALFASAANAAVVYDKDGTTFDVYGRVQANYYGDHNTADSTVASGYKDVDGELVGSSRLGWSGKIALNNTWSGIAKTEWQVSAENSANKSDSRHIYVGFDGTQYGKIIFGQTDTAFYDVLEPTDIFNEWGDAGNFYDGRQEGQVIYSNTYGGFKGKLSYQTNDDKAVKVTDVGQGIKETAVYGADVKRNYGYAAAAGYDFDFGLGLNAGYSYSDLENTKTNNTGDKKEWALGAHYAINGFYFAGVYTQGDLSYDNTTGGDKDKGRGYELAASYNVDAWTFLAGYNFKEAKVNSNTAGAEYKDLLDETLLGVQYAFTSKLKAYTEYKIQGIDKLDDEWTVALQYNF

SEQ ID NO: 16360 - protein, 311 aa, Aeromonas hydrophila
MKKTILAIAITGLFAATAAQAATVYEADGVTIDLYGDVEVQYLNDTAKDSDKDGVILIDDADFGFGLTYDVGNGYTVGGTMEISAEDGTAELGDTFVGVSHDSYGTLTIGNQATIFDDAGISGDYEFGFDTYVGDVTDASTQVIKYKGEWDNVYAGVAYVLSADKLKDSSHTVDANVGIRVGGLDATVFYSTGKTAAKDEVTAYILQGVYTFDAFDLGAFYANTATKDNASNVDTKDNDAYGVSGNYYMDAWNFGLGLGIVKNNVADTDSKNYYANVGYSFTSSVHVYAELGKSDADNTELGYITGVKINF

SEQ ID NO: 16361 - protein, 349 aa, Aeromonas hydrophila
MKKTILAIAIPALFASTANAAVVYDKDGTSFDIYGRVQANYYGDSDNPNPLTQADTQGDAELIGTSRLGWSGKVALNNTWSAIAKTEWQVAAENSDDSKFKSRHIYAGFDGTQYGKIIFGQTDTAFYDVLEATDIFNEWGSYGNFYDGRQEGQIIYSNSFGGFKGKLSYQTNDNEAVKVADVGGNSFTTEFPGIKRNYGYAASAGYDFDFGLGLNAGYAYSDLESTTNTNTGEKSEWALGAHYAINGFYFAGVYTEGDLKNDTTGYKGEGRGYELAASYNVDAWTFLAGYNFKEGKDNTAGSSYEDMVDETLLGVQYAFTSKLKAYTEYKIQGIDKMDDEFTVALQYNF

SEQ ID NO: 16362 - protein, 210 aa, Wolbachia endosymbiont
GPISDEETSYYVRLQYNGEFLPLFTKVDGISHKKDKSDYSPLKPSFIAGGGAFGYKMDDIRVDVEGVYSYLNKNDVKDVTFDPANTIADSVTAISELVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTVGAEAGVAFNF

SEQ ID NO: 16363 - protein, 1054 aa, Rickettsia monacensis
ITLQAGGNLITNNINFGAGSTLEFNGPLDGGGNIITYGFKGAIVNGNNATLNVNTKLLIAYDATAGTIATINIKADNNFAFDASAGDVTILNGQAIVFEDANSILTLSNLTGGGVNNILLAADLAAPGANEGQLIFDGGVNGLNIGSNVAGTVRNIGNAGGNKFENLFINHVVTITDDVNLGIHDLVINDNADFTSSTAFNADAIQINNATYRIDANGGDLNVPAANIEFAHADAELVLQNSSNANDRTITLGADIDPNNDDEGIVTLNSVNAGRKLTIDGGVTFGRAKRLQAIKFQGAGNLGTVGITFNTANIELDTTGVLELGATTANVTLINDAVQLTQTGNIGGFLDFNAKNGTVTLNNNVNVAGAVQNTGGTNGTLIALGASNLNSVNGIAMLKVGAGAVSIIKGGNTSITEIQGNGTALLTLPANFNLTGSINKTGGQALKLNFTNGGSVSGVVGTAANSVGDITTAGATSFASSVNAKGTATLSGTTSFADTFTNTGAVTLAKGSITNFAKNVTATSFAANGATINFGNSLAFNSNITGSGTTLTLGANQVTYTGTGSFTDMLTLNTTFDGAAKSGGNILIKSGSTLDLSGVSTLALVVTATNFDINNIDPNTKYTVISAETAGGLKPTPADNVKVTVNNDNRFVNFTFDASTLTLFAKDVSQEVIDNNFKPGGPLTNIPNAANVKKSLELMEQAQIGSDARLAFGNWGKLTPIQEADAVTHLMQDVVKPSDTITAINNQVILSNISSSLINLNARMDAIPPVAVAAGDEDRDAKFGAWISPFVGNATQKMRNNISGYKSDTTGGTIGFDGLVNDDLALGLAYTRADTDIKLKNNKTGDNKVESNIYSVYGLYNVPYENLFVEAIASYSDNKIRSKSRRVIATALATTAYQTANGKYKSESYTGQLMAGYTYAMPENINLTPLAGLRYSTIKDKGYKETGTTYQNLTVKGKNYNTFDGLLGAKVSSNINVGEVVLTPELYAMVDYAFKNKVPAIDARLQGMTAPFPTNSFKQSKTSFNVGVGITAKHKMMEYGINYDTNIGSNISLS

SEQ ID NO: 16364 - protein, 1061 aa, Erythrobacter litoralis
MTIGICMNKLNSYMVFINILNFMRNKDTHTRITDKCRCLFVVAYSAMSITGLSSVLAVENHALSSPVSDRVESVQQKKHVSGNVQDANGMPLIGASVIIKGTNTGMITDIEGNFALDAKQGDIIVISYIGMKSAEVKVPANGQIRVMLKEDSQLMDEVVVTGYGDFKKATYTGSASVLNTDKLESLPVVSVAQMMEANIPGLSSVASSSQPGSKATVRVRGIASMNASTEPLYVLDGVPVASRDMSGLSANASAGGLGLIETLNPADIESITVLKDAASASLYGAKGSNGVILITTKKGKEGKMRVSMQATYGITDIAYNYRPIMGGEERRELIYEGFVNYRLNQGDSEAEAKAYADGQIDNYAARPVNGYADWEDALLKKGHQQDYSLSVSGGNEKSNFIGTLGYTNQTGISINSGMERFTGRIDANSKWNKFEYGMNATFSWTRNKHTPEGQYYASALYSSKYQLTPSIPIYNEDGSYHTGFQNNGGINPLYENSVDSNYARLARTMASAKAAYHILDGLKLSTIFTVDYSLNKDFFFYSPDGKDGEATQGSGQMMMIERMSYTSQTNLAYNKTFGKHNINAVLAYEVMKYDYEDMYGEKQVYGQTLNPSLDNGAKPADLTNTRQEDAMVSYVGSLNYGYNDKYYAGFSFRRDGSSRLAPDTRWGNFWAVSASWRLSQENFMKPWENVVSDMKLRASYGVNGNLPTGYYGYHGTYTTGAFYNGKPAPWEDAIANPDLTWEKNYALNLGVDLSLFRRVNLTFDWYTRTTKDLLMSKQLNSISGFGSILTNVGEMKNTGFEIEVRSSNIQTKDFSWTTSLNLSHNKNKIVKLADLPEFIDGNYIRKEGCSYATIYLREYAGVDPNDGRPMYYDNKEDENGNRSRNIVYDPNDADRVELKDIYPKLTGGLMNTFNYKFIDLSFNLSFHLGGYSYDGAMYALQDDGYTAQYNKSTELRRRWKQPGDITDVPRYVYGQEYGGWWNSSRGIHSTDHLRLKSLIVGVSAPQSWLRTIGINSARIYFSGTNLLTWAAYDQYDPELNGIVSYFTPPLKTFAFGLELKF

SEQ ID NO: 16365 - protein, 788 aa, Erythrobacter litoralis
MAFSTSPLYAQDAPVSAAPPPTSEATQSGIEDIVVTAQKRAQSINNVGMSIAAISGDALIERGVSTAADLVKTVPGFAYAETALGVPIYTLRGVGFVDQSLSAGPTVSVYVDEVPLPYSFMTKGSIFDLERVEVLKGPQGTLYGQNSTGGAFNYIAAKPTNEFSAGVDAEYGRFNTLDATGFVSGPLSSTLKGRLAVRTVQGGDWQKSYTRNDTLGRQEQWQGRALLDWEPTERLTVQINATGWIDKSDTIAPQVRKIDPQVPAGVISGVANYPLPPDDPRAADWTPDRDYARDDWFWMTAGRINYELSDDLRLVSITAYQKFSTKAFYDNDGYTYLTGDRYGTGTVKTFNQELRLEGENGPIQWILGGNYSHHKVHQLFTYYLKDASNAHGVFAGLGPIGPNGELGFIGPDGLDFATANGLSDNTIKSYAVFGNAEWEIVPSLTLQGGIRYTKTNRDGRSCAVATDAAGAALSLGTQQFYANIGTKTTPVMPVSPGDCTTLDENFNPAPSFGRLREDNVSWRVGLNYKTPGATLLYANVSRGYKAGSIPAFSASTFTSNLPVKQESLLAYEVGFKAPLFEHTMQINGAAFYYDYSDKQIYVLLQDLVFGGIQQLVNIPKSRLQGAELELVWQPTRGLNISASGTYLDSKIKQYTGYNAGGIFADYSGESFPYAAKWQLAGDAQYDFPISSSMEAYVGGAVNYHSRTTAAFGNDLLIAGGKGNYDLNPYVLVDLRAGVKSPDGNWRVGLFGRNIFNKYYWTTVEKQQDAVIRYAGKPATYGIQLSTRF

SEQ ID NO: 16366 - protein, 834 aa, Erythrobacter litoralis
MVKVLTQLSLRHVTLLGTSLLGSAFVLMMDEGRAATTQSVPVQHKQAHATPTSRKATSRPAPKAPVEVSGGSEAVVVTGTREFGKKARDSIAPVDIVTNRQLTGTGQPTLRDSLALLLPSLTVPTGGFDAGALTDTISLRGLNPNETLVLVDGKRRHTTANIYADGGPAQGSTPVDIDMIPMSMIDHIEVLRDGASAQYGSDAIAGVVNIILKKQNHGLTMRSNTGITSEGDGFQQGVFIDGGLNLNNRGFVHIGGDFVHQDHTVRSGADNRTNTYVNQLLGQPEQTRESVAINAGYDITDNVQAYASATYAHRHAESYQNYRLASTLAKYPGYAAIYPYGYAPIEALNEDDYELTAGFKGTLAGWHWDVSSVFGRDYDAFDTESSTNVGLYTATGQTPTSFAAQSYNDTQWTNSVDLSRKFRTSFWPYAINVAGGASYRYEAYAIGTGSPASYTYSSSDGFPGTNPANAGKWSRDVAAGYLDISTNLMKHWQIDLAGRVEHYTDVGNTKTGKISTRYDFSPRFAIRGTFSNGFHAPTLAQEHYSALSVSPTAASGIIAANSAGALANGASALKPESSTSAEGGIIVEPIKKLHVTVDVYQIDLRDRIMPGGTIYGSQAYSALQTDGFNLPAGSENWTGSQLATHWFANVANTRTQGLDLTATYPTDFGRYGHADWDVAINLNRTRLRHQATSTTGAALLNAQYVAYLTTAYPRSKIIFGGTWRSARNKWAVSVHEIRYGETTSQLTYYTGPYTYSTSHFLEFQNVPKWTTNASVTYNITPKWSATIGGNNIFAKFPSVVPEGNRYLGVPKYYMSTSQLGMNGGYYYLDVSARF

SEQ ID NO: 16367 - protein, 1226 aa, Erythrobacter litoralis
MALAFAVPGFGLPAMADPVQRPTPVAGSVIARKTGEEVRFIDVSDWRVVDINQDLLTGDVLRTNANGQLAIVFSDHTQVRLGRNSSLQVKKMAASGDTVLELQAGTIWARAERGGQGLTVETPAAAAAIRGTDWTMTVKGDQTSMIVLEGRVSLSNPQGSVDVSEGEGAVATIGQAPHKLISVNPDDREQMLFYLDLRDGFGLMPTSPLRADRMATERRRLLALPLEHRSIEDWLELAEVQSAFDGRQAAAASLQNIRGRKLTVAQQARVDLLDATIAGSEKRYGDAAKLFQKALPHLDPTRRNMAQYGGYFARSLADPAHSEPPPATTTGPYGAIMQAYTAGFLENPRAALEIIKKAERRYPDDPTLPAVRAQLAQLIDDRQQMKEAIERSLALDPDHPMALSARAEYKAAYESDIDGALADLNHAIELAPGDSGALNSLGLLQSSRDANGEAEKAFKRAIELDPQDPLLHANLAMLYLDQSRMKEAKREIDTAIALDPSFDIALLVRGRYYLQSGERDKSLEDLLAASTANPAHSQSQLMLAAAHYEKGDRIPSQQALDNADRLDNNDPAISAFRTAVDIDDYDADGAIHNAQEYLRRSRARGGDYSSLGANASAGSTLNNAFRLQGLDAWGRYYGDAVFDPFKGTGYIDQSIKGSIFPFVNATSFSDDSVSQYSVNASTYSSFIQGLLLSPHMLSGRSRSASLFDVPFIEGSLGGGINSVDGHTRRIGEAEIQGYSNETIPISFRADMTWEELALDRDYRDFGGVQTDNKLLSADGYLTATVTPDDRVVAFVNHGKNDGALSALSSNTGFMELLFGVPFPLPLYTTEETARESTYAGVGWSHTFAYENVVNGALLYSGSKSRTSDALDVDLDPLFIRAGVPFIIPFTDVTQETESKTYIGALSHSIGAGPLTFRYGVEGGWMDVSSTVDKTLLGVTAPPDHSESTIDIGRAYVDVLHEITPDLKGEYALFATHLEGGGTDITRLEPRFGLAWAPVQNHWLRAAFIRQSFDTGIPTLAPIGILGLQANQFSADPQGYTDTIALQWDAEWTDRFFTSVEYQHQELHDFSVDFPLISLPSDTSLPISRGSIDRAAVTANVALGNGFGLSATYAYMDSENRDPLEPIYGGPLPFIPQNSGQIALTWVNEAKVKATIAANYIGERDGDRFGTKLDDYWSLDAHLVWEPFDKRMELEAAAYNLLDEDFEITPGVPGWGRAFKGTLKVRF

SEQ ID NO: 16368 - protein, 899 aa, Erythrobacter litoralis
MAMALTLAPQAAFAQDTDAEEQASAPDEDENMIIVSGFRESLESSVAEKRFSDQILESVTAEDIGKLPDDSIGESIARLPGVTSQRLNGRANVIAIRGLGPDFSQTLLNGREQTSTGDNRAVEFDQYPSEVVNQVVVYKTPTASLVGQGLVGTIDVRTIRPLEAGEQILAIGAKGSYADLGALNAGSKEFGYRVNATFVDQFADDTMGVAISAAYTDEPYQLQEFNAWGYAGDGSAANPFVIGGSKSFVTSTQLKRFGVTGTFQAELTPTLMLTADGFYSNFDDDSIKRGIELPLGFGAFGTTFDPSTATTTTTEFGEFATSGTFENVEGVVRNDIFQRKADQYSGGLNLAYEGDDGWSAFFDFGYSRTDRNELSIESYSGTGYNAGVGATDTIGFMSDTTGTSFSPTLNYSDPNLIRLTDPLGWGGSRIQAGYFNDRIIEDELRQYRVGVAKELDGFFSKLHLGLSYTNRDKSLTPDEFFVIPAGGATEVPIPSNLLLRSTDLGYLGLGPIVSYDAREVIASGVLVLDRNTSNDIPAKAYRISEDLMTLYAQLDIDQELGAGVLTGNIGVQAINTSQQSSGIAFPGGVQTPISLGDDFWDVLPSANLSVRLDSGWVFRLAASRQIQRPQLDDLRAAIGYGVVTTIDGQSPTGQYPYINGGGGNPLLRPYRANAVDFNVEKYFANGAGVIALQLFYKDLVSYIDGANTVFDYAGLPLPAGPTPATTIGILNSEVNTGGGDFYGAELSATIPFDAIIPALEGFGATGGVGWTETKVEDANGNVDVIPGYSEWVANGTLYFEKGGFNARGSVRYRSEFLADFTGFGGNITRRLARAETIVDAQIGYDFESGPLEGLSIYLQGQNLTNQPFVSQFDVPVREAVIDNQEYGRRFLAGFTYRFR

SEQ ID NO: 16369 - protein, 726 aa, Erythrobacter litoralis
MRISCVLVQRRRTAATLLLLLSTTSLMASGRDARAQEHGADVTLDELTVTGDGSAAVGYQPRRSSFGTGTETPLLDTPANIAVVSQAVLRDQRVLSLDEALRNVSGIAQTNSLGGTQEGVVRRGFGTTRDSSILRDGRRTVLQQNFSHSIERVEVLKGPASLLYGISEPGGLINLVSKRPLFTRQNSLDVTATSFGGAIIQPDLTGPIEGTNLAYRIVGDVQDYDYWRNFGTIRRQVAAPSMTWRGDATTVTVGYEFAHYNIPFDRGTTFDPRTGRPLRVPRERRFDEAVSRVEAMSHLGSLDLEHRFDDDWKVNVGFSASNLTYDDNQIRPTSYNPATGLLTRRADATRGADFNSQVARVDLVGRFEALGLRHDLLVGAMHERVDYYRRESYRGANQGGFDVFNPVYGRLGASDRLSLPASNNRDRLINTSLYLQDSIHLTDGLILVAGASAQFYDQLAYAGVPAVVSTDIDGIKPLPRAGLVYRIAPHLSVYGSYTQSFRPNVTDLDRTGPLAPEEGDAYEVGIKAELGAGLLVTGAVFDTEKTNVLVTQVVNGTRTATTAGKARSRGFELDVAGQIAPDWSVIASYGFTDAMVTEDPTLAGNRLLNTPRTTASLFLTHQVGLVAPATTLGSVQLGDGFLELGWGSRYVGERPGDATNSFTLPDYVVCDAFLSYRTSVNGLPAALQLNLKNVLDETYYPSSGASNVLVAVGEPFQALMTARVSW

SEQ ID NO: 16370 - protein, 725 aa, Erythrobacter litoralis
MMVRDAETITGTIMIITSARFWGRPLAASLLLFPLVSTATEVETDNDDVHEIPSVTVNEETNQGTLADTSESYQPKTPLSAPTGLSLTRRETPQSVSVVSRTLMDDFQIVSVSEALAATPGVVVDQVETDRVYYNARGFEITNYQYDGLGMPLPYEIVNGDTDTSLFERVEIVRGSNGLMNGLGNPSATVNYVRKRPTLDAHSTLSASYGSWDNRRVEVDTSGSLTEDGRVRGRMVSAYQNRDSYLDRYENERGVFYGVVEADVTDSTLFTLGYSYQNSNADSPMWGSLPLFYSDGTATDYDVETSTAADWAYWDSNTESVFAELRQRFDNGWEANAVFNYRKMEGESKLFYVYGTPNKDETGLFAYPSQYDDKVTERVFDLYARGPFEVGGRVHEMVIGANYAKGRIEETSNYGQGIGTALTPDWAFGGSYPKPTFDASTSGSKWDDRYRSAYLATRLSLADPLTLIGGARYVDVTSEGEGYGASKDASASETVPYVGLIYDLTDVHSVYGSYTKIFNPQTEEDITGQRLEPVTGETQELGLKSEWKDGRIYTALIAFRTDQENLAEAAGMIGPDTYYGGVDVESFGYEGEISGEILPGWQLAGGYTWLEIEDQDGDEIRTYTPREIVRLSTTYRPAALQKLKTGVQVSWQDSIYRGGTGGVPKTTQDSYALVNLMASYDWTKHLTTTLNVNNVTDEKYYNSLYVGQAFYGAPRGANVRFDYKF

SEQ ID NO: 16371 - protein, 1048 aa, Erythrobacter litoralis
MCFTPLYAKQDTASPQQTGKTYTIKGIVLDFNNEPIIGASVYIPGTNTGVATDLDGNFTLKVPANTKTIEFSYIGYEKKIIEFNPKNLNVFRVVTMKEDSGIALEDVTVVAFAKQKKESVLGSVSTIKPAELKTTSSNLTTGFAGKLAGVVAYQRSGEPGEDNAEFFIRGVTTFGTGKADPLILIDNVELTSSDLSRLNPDDIASFSVLKDATATALYGARGANGVILVTTKEGTEGKMKLSFRAESSFSAPSKEVELADPLTFMKLHNEAARTRNPGNALPYLESAIAAREKGLNPYVYPMVDWKDMLFKDYTVNYRGNMSISGGGRVARYYVALSYSRDNGILKQVPNNIFDNNIKLNKYTVRSNVNINLTKTTELAVRISGTFDSYQGPLSGGSAIYSQAIKASPVEFPAMYAPDETNINTKHVLFGNSGSSANYLNPYAEMARGYKEYEKTVVLAQLELKQDFGFITDGLNGRLLANVTRNSYYDLTRSYTPFYYSLDSYDKYTDTYILSALNSDKGTDYLSYNPGSKSVDSSLYLEASLSYDRTFYKKHNISGMMVYTVRESKSGNAQTLQLSLPSRNMGIAGRFTYGYSDRYYAEFNFGYNGSERFDKNHRWGFFPSGGLGWMVSNEKFWKDKPITKVISSLKLKGSYGLVGNDNISDERFFYLSEVSMDGDNGMGFGTNFNAKNSNGKISIKRYANPKIGWEISHKLNVGFEMKLFKDLEIQAEYFKERRTNILQTRADIPTLMGFQVSPQANIGEAKGHGVDISLDYSHFFNKNLWATIRGNFTYASSKFSKYEEPDYSATPWRSKIGTKLSQEFGLIAERLFVDEEDVANSPKQQFGEYMAGDIKYKDINHDGIIDEQDRVPIGYPTTPEIIYGFGFSIGYKDFDFNCFFQGSSRSSFFISPADISPFIQPNDPNNELGGKQATNALLQIVADDHWSEANQNMYAFWPRLSDTAISNNNQKSTWWLRDGTFLRMKSAEIGYTLPKRISSKAKLENFRIYVSGTNLFNISKFKTWDTEMGGNGLGYPVQRVFNIGVQLSL

SEQ ID NO: 16372 - protein, 197 aa, Erythrobacter litoralis
MTSLYLASGSPRRQELLAQLGVTFERIVTGIEEQRQPQESAQQYVVRLAREKARAGVAQTAKDLPVLGADTIVILNGEVLEKPRDAEHAAQMLRKLSGQTHQVMTAVALADSQHILDCLVVTDVTFRTLTDEDIAGYVASDEPLDKAGAYGIQGLGGCFVRKINGSYHAVVGLPLVETYELLSNFNALREKRDKHDG

SEQ ID NO: 16373 - protein, 809 aa, Erythrobacter litoralis
MKLKVYSVLILLIGTCFLSYAQSYQVSGTVTDGATGNAIENVTIYDKDNGQLAITDVNGRYLFTTTQNELTLIWFSYEYVVYEESITVNKDIVKDVKLQQLGEELTAIELTVRKEKLFQLERLKDVEGTSIYAGKKTEVVLIKNSTANLAANNARQIFNQVAGLNIYQNDDAGLQLNIGGRGLDPNRTANFNTRQNGYDISADVLGYPESYYAPPAEGLQSIQVIRGAASLQYGTQFGGLVNFVMKEPHQSKPLELITRNTIGSNGLYTNFTSLSGTSGKWSYYTFFNYKKGDGFRPNSQFESKNIYAHVGYQLNDKTKVTGEITYLNYLAQQAGGLNDRQFEENPFQSNRERNWFEVDWFLYNFKLSHDFSEDTKFTFNAFGLQAQRNALGFRTNRVDQIDPGTERDLIKGDFNNYGAEARFLSTYNIAHKKNIFLIGSKFYKANNTSTQGPGSDGSDADFDFRFDEYPNYSNQNDFVYPNLNISLFGENIFYVNDKLSFTPGFRLEYIKTESEGFTREIRTDAAGNVIFNEVIDENRSNERTFALLGLGTSYKANDAIELYGNISQNYRSVTFTDISTINPAFEIDPNIDDEKGFTADIGARGNFNDFISYDASAFALFYNDRIGFTQVVADDGRVKSQRGNVGDAVIYGLESLVDLNLQKLFIKNRAYKFNLFFNTSLVSSEYTNSDASGIEGNKVEFIPELNFKTGFQLGYKNFMSSIQYSYLSQQFTDATNATDGNLSGVIGAIPAYDVLDFSASYKYSRFKLEAGINNVLDNAYFTRRATGYPGPGIITSPNRNYYLTLEIKI

SEQ ID NO: 16374 - protein, 1035 aa, Erythrobacter litoralis
MKYTTLYTLILGLFSIGWTDCPEDFMERMQRPGHSEIQLSKVTISGRVLDESGFPLAGATIQEKETANGAIADSEGKFTLVVADNAVLRVSFIGYISQDIEVEGRSTFHITLREDMIELDNVIVTALGIEKKENSLSYATDLIKNEELTRVKMPNLITSLTGKSAGVRVNQVSSGLGASAKVSIRGIRSVASDNQPLYVIDGVPILNSTSEQAYSAIGGTANAGNRDGGDGISNLNPEDIESISILKGAPAAALYGSQAANGVILITTKKGQSHGQRSVSFSTSLMFDNAFALPKMQNRYGVSDGVDSWGERANLPEYDNLRDFFSTGVTSITSISLSHGNEKLQNYFSYANTTGHGIIGKHNLSKHNLTFRETSVLLNSRLKLDGSMNLMRQVVKNKPTVGGFYMNPLVGLYRFPRGEDIAYYKENFEVYDEGRNLNIQNWHTSYEDFEQNPYWITNRILSKENRMHVIVSLSANLKINDWLSLQARGNVDYINDKVRQQFYASTAPALAGANGRYIEMDYQETQYYGDAILMMKKQWDAFSLNAALGVSINDKTVNSTRYDSKTASLKYANVFNLANIIMNGSAGLDQKIDARRQLQSLFATAQLGYNEFVYLDLSARNDWSSTLAYTSHEKSGFFYPSVGFSLIFNKLMTLPQWVSLAKIRGAYSMVGNDIPMFITNPSSHITAGGEFLASDAAPFKDMEPEMTHSFEAGIEARFLKNRIGLNATFYKTNTRNQFFKLPTLSGDKYAYRYVNAGDIQNVGWEISLDAVPLLTNHFKWKTEVNFSTNRNKIISLHEALKEFLYGPTSFSSSYAMKLVKGGSIGDIYGKAFVRDDAGNIVYGTEGDNTGMPLVEGDGNTVKVGNANPKLMLGWNHMLSYKNFSFYFLVDCRFGGDILSQTQADMDMYGVSEVTARARDKGYVMLEGNRIDNVKGFYKNVVGGRAGVTEYYMYDATNIRLRELSVGYQLPAAWMEKTKVLKRAQLSFSGRNLFFFYKKAPFDPDLVLSTGNDNQGIEVYGMPTTRSWGFSLKCEF

SEQ ID NO: 16375 - protein, 473 aa, Erythrobacter litoralis
MTTGKMARKTLATALMLASAMAMADAQVLELYVDSNTKQIFSEPGPNRVKIGTFRSVDNPADTKQENTASIDLVEMRQELELRQRELEEKLDKIAMAPAPKPAKKNWAETMKVRGYMQIRSNPIIGGDKDISHQADRSIGDNNNFLIRRMRLIFFGDIGERLSYYIQPDFASRTGDGTGNIAQLRDAYGDIYLTKDRVHRLRVGQSKIPYSFENLQSSQNRIALDRNDALNSCCKDERDLGVFYYYTPEDKQEMFKYLVDSGLKGSGNYGVFAFGAYNGTGANRAENNDNLHLVSRFTYPVKFENGQIFEAGIQGIYGTFKPSRSGTVVADSKTDGFKDQRVGVHAVLYPQPFGLQAEWNWGKGPSLNDAGTMIEETSLNGGYIQAMYRITDFFGYGVMLPFVKWQYYDGAQKFESNAPQNHVNDWEAGFEWQPVPEIEFTAYYSKLDRNNLATAPYSKYNTDILRFQLQYNF

SEQ ID NO: 16376 - protein, 826 aa, Erythrobacter litoralis
MPAGKPYQTTDLPHKTGPARRASRLTGTGLLTAITLAGPLLWAQPAAAQNQAESQARTSFNIPAGALSSALNRFAAQTGLYLAGAGELTQGKKSNGLTGEYTVHEGLQQLLTGSGIRFQFSGSNTVTLTQATDNAVTLAPVTVNAEGIGESAYGPVEGFTAKRSATGSKTDTPILEIPQSISVITADQVKTTGATTLKEALSYTPGVSATPWGNDSQYDWVYLRGFDAYSPGFYQDGLQLRNSGNWAVWQTENYGIERIEYLRGPSSVLYGQNSAGGLINVVSKRPTQDPIREISAQIGTDNRKQIATDLSGQADDDGKWLYRLTALKRDADLSVGDDLPNDRSYIAPSLTWRPSNDTQLTLLAEYLDMKVASNWSNFPLEGTLLSNPNGDIPASTFWGEPNFSRYNQKQWMIGYLFEHHLNDIWTLRQNARYGEFDTDYQSFYSPRFVTVNAGDPGAPENFRLLDRTPFGSDESASQLTLDNQVEAHWRSGRWQHTLLLGLDYQRSDFDVTAYWGGAVDPIDVFNPVYGSPVTLTASPFIDANTVLKQTGFYLQDQIKFDEHWVLALGGRFDRAVIENDDQLTNSNDKQSDEHFSGRAGLVYLVGNGLAPYISYSESFSPTATINPATGNPFDPETGRQYEMGMRYQPPGASSTYSIAAFDLVRQNYVTYDTGFAPRNTGEVTVRGIELEAVAEVLPNTNLKAAYSWTPEADVTDSANPSEIGKRSFNYAEHQFSLWSDYTFGFGLKLGAGARYTGSTYGANEEAPAKIPDYTLIDALIGYQTGPWELAVNARNLTNKEYLSNCNDSECYYGETRSVIGTVNYRW

SEQ ID NO: 16377 - protein, 665 aa, Erythrobacter litoralis
MALDSPPPVEQVIVTAARLPPSAAEAAFSVVHLGEADLAKSQRVDEAVSQTPGVSLFRRTSSLSANPTTQGISLRAIAPSGAGRSLVTLDGVPLNDPFGGWVIWSQLAPESLAGIDIVRGAGAGPYGAGALTGVIGLKERDSGIAGDVSVGELGGQRASAAAVSTFGRFEFFGAASYDKSDGYVPVRGDARGAADTKADLEAKSISGRIDMATSLGLLSLRGGFFEEDRGAGLAGARANASGNVFSATLVRAPRRDALGWRLQAWRRTSDLFNSSVAVAADRSATTPANSQDKTPATGWGLNGALRRKVGGLEWELGADARLNDGEERERYGYSGGTYARGRVAGGKTAVVGAYADGSWTTGPWLVAGGLRLDHWENTDGFRVERTLAAGAVVLDQRPADRDGEVLSGRLGVTRKIGGDAVLRLAGYTGFRPASLNELYRPFRVGNDVTEANAGLKPERLRGLEAGVSRKGANGLIEATAFWNRIDDPIVNVTLGAGPATFPIGGFIPAGGVLRQRQNAGTIDAIGLEGRAERKVGVVTLSSALSVTDARVDGGGVAPQLTGKRPAQAPIWSATAGLSAELTERLTLATDLTWEGKRFEDDLNSRVLDPAYRLDARLDWRVRPLVTAYVAGDNLLDANIQTSRTADGVAGYAAPRVVRVGLRVAL

SEQ ID NO: 16378 - protein, 817 aa, Erythrobacter litoralis
MFRGQRLLSAGLIGVSLTIASQPAWAQLTQITAVQIQPTPDGLNILLGGIQDQSSQITTSVTDKTLTIEISNAQLRLSEGPLFRRDNPAANITALRIEPLAGNRVRITVVGQTALPGVTVTPEATGLSLAIAVTPPAAPDPATPAPTGSTDNPENIELVVTGQQEAGYVVEEATTATRTETPLRDIPQSIQVVPRQVIEDQQVQKIGDALRNVSGVSILQGYGGSTTNYTIRGFDSFVNLRDGFRDDGFYAIYDPANIERIEVLKGPASVLYGQLAPGGIVNFITKQPLRDPYYSGQFTAGSYNFYRPSIDFSGPLTTDGALRYRFNAAYESTGSFRDYVNGQKLIFAPVLTYDISDKTKLTVDFEYQGLDQTFDRGFMPDPRFLALPISRFLGEPSDSYDFESFKGRYVFQHQFNDAITLHNAFSAQSYNAKRENAQPLIIDGFLINDRFLPRRYTDVDEGAESYNMQTDLISKFKTGPVEHELVTGFELRRQQSGYVFRRTPFTPINIYNPSYGTPIPTEFDTVFDNDTTTDNAGIYLQNLIKLRSNLKLLVGGRFDFVTLRAIDLVNGGSRTKTNEDASAFSPRVGLVYQPIQPVSIYASFSRSFQPNFFEFTAPGVVLEPQRGTQYEIGIKSELLGGKLSATLAAYEITKTNIPTPDPNNPDFVIAAGEAKSRGVELDVIGEIRPGWNIIASYAYTDAFISQDNALPVGSRLVNVPRNSASLWTTYEIQQGKFQGLGFGGGLFFVGERAADVPNTLNIPAYVRADATVFYRRANYKVAVNVKNLSNAKYYDSQGFFIYPGEPLTVVGSFTLSF

SEQ ID NO: 16379 - protein, 807 aa, Erythrobacter litoralis
MYQKKPLMLLFCSTFVSPFVMGKTVETTNNQQPTTNKNILPEIVVYGDNNKSLSSVKTLSSDEISKTPTSNGNITDYLRSNPHIRYENSDQNGFQRGEIKPENISINGADPNQTAYFVDNVNINNDLAIDNSIFDGAMQVVPGISHTQAYFFDATMLSKVEVQDSNISASLGGFMGGAVIAKTKQYSGTDSIKLKYRTTNSSWAKMEAGDSVQKILKQVRPDDSGAAELQPKYNKQTFNILAEKRLNDNLGMVLGYSRRTSSIEQNRLIGFDKDASNKAQLDKQNHQRLSDNLLLNFNWTPQEKERIEFGLRYSNYKELKYFKENIGNNVSDYHQALGATLAWVHSFDSGVWTNTLAYDRFQDRRKSSSNNVETTSVSDEDYEPLYNFEKGGYGNSRLTQDNLHFSTEYVMDPFYLASTEHSISIGGIYQATKYQFYRPQDVHQKVTLIMLNKNGKPITETLLSNSTTSKGRVKTSYQNIGIYAEDLIKWRKFEFRPGIRIERDDYLKNNNIAPRFVARYHPWDNTGFTLGLNRYYGRSFASLKLANRILKINDDSTRQHQNFSSLKSPYADELSLSFDQNMSNLALKLGYIHRDNKNRIILKRETVNRMKKSSYINGRPFGVDIYTFQLNNIEPWKLGKTYWTTSLGFDWLNTKRADVSNEFDPNELVYLDGKLMTRSQMLQQVNSSTEDWIARLGIDMTIPDYDITWSNKVYMKAPIRSYEELDGDNNDDTPRYRSYHYGRHTQWDSSIRWQPTIRGKHSVYLQVDILNVLNKTRKNKVTTISTSDEYGVYTPGREFWLEVGYQF

SEQ ID NO: 16380 - protein, 1077 aa, Erythrobacter litoralis
MNKAQKFAVSSRNKNKAVINKNIFQLSIITSALLFSGYTLAYSETGQLGDKNSWESQEYKNDWGLAAMNASSAYALGYHGQGAKIGVMDSGALLSHQELSGSRFHAVKAKGEYGSTGMRYPQELGGHYEKGQAFDVTGDWIKGVNDTHGTHVTGTVGANRDGEGMHGVAWGSDVYVGNTGATDSNNYGPYQDYQYFYTGWKAMVDAGAQVINNSWGTNPRIIDAGKTVGPDGGNTSVHLPVDTTQQTEYEYFYFKKIYGDNPSFVDAAYDAVKDTNVVQVFTTGNRDFKNPYYRPLYPYFNPQAEKHWIAVAGLKQTADKTGYEIEGMFNEAGNAKWWTVVAPSRYIYSSVVDADGNPGWDTFSGTSMAAPHVTGAMGVLMSRYQSMNALQVRDVMFTTANRYNPDGSLYKDWKSADGVPDERYGWGTPDLEKGMYGPGQFLGKFEYQLDAVPLDVWSNDITQAALDQREQEDLAWLADYKANGIDAGGDYNLGTDFVVNDGNPDPTSHIIDKEEAKKWRQEYYQKRADAIQAKIDAGLYDGSLVKTGEGSLVMTGDNSYRGGTTVKQGSLFGFTESFGTADVNVNGGTISVLNHYNDQFTQKGQLVSNESHKANININDNGTYLVTAGHNVNVGNMTLNQGAKLDIAADNIGQLKDVYLNDNTVQGTVNADNLADNRAKSKMLANAAPNAVNNDYALFQKEVSVKDNTITGSLSKKADTSFASFANNENGRSIANVLENNAKGQLFDATLPMSAQDLRHTYQSLGSDMYLNANTASVVNVLGLTRTVKDQAIGIGHGRYANLENSNARIWMTGVGQWGNLDYGYSNMDTDFYAALVGAEIDVASHTKAGLFFGAGSSKYKAHEYGKIDSNDLHVGAYGVSNIQNVAAINYGVTHTNQDRDAKRTLWVGQDSGYNSSSYDAKITQLFVEGAYTQLNNDQYSIEPYAGFNWLHVTSDNLHEQVGNMQFTTKTDNQDIQVGTVGLRGGYPFAAGNVNLALKGDVSASHLFGDNRPEAMLFLSDTGEAKIRGGKLDNLFGIGLGIDAQLNKSTTLGVSYQGQYNSDVNSSGVNATLKINF

SEQ ID NO: 16381 - protein, 826 aa, Erythrobacter litoralis
MDMQPGSGTRGFASVGRKVMIATLLATTALLVEGARSGSGARAQAGVQTTFNIPAGPLSRALAAFGRQSGTQVSYEAAIANGKTSPGFQGTATREQVIAQLLQGSGLVYSFSDATNVLITRPRPVSATTASDGSLLLDTINVEGQGINDWDAPPSYAGGQVATGARLGILGNVSIMDAPFSVTSYTSKLIQEQQAVTVADVVANDPSVRVFTNGISSSAGAGEVFFIRGFSVTNQSILIDGYGGISPDRLIPVETMERVEVLKGPNALLTGYTQYGSLGGSINVVPKRATDEPITRLTGSYISDGQLGTQIDWGRRFGPNKEWGVRVNGIFTDGDTSVDGQSARLGTGTLALDYRGADLRASLDAGYISQKTYAPTGAAGFGFVSDIAIPRAPDASKQIYQSWEYSGTNTAYALGKFEYDINSAWTVYGGIGGSTYRQSMLSTDILVVDPAGNATATAYYSPINGNSTSAQAGIRGEFATGPIGHKINLNTSYLYQSLNQESNYYGFYAFDTNIYNAPTVARPSTFGFSDDPPRYWNINAPAVTLTDTLSILDERVLFTAGVRYQQIKVDVFNPDGSISQAYDEQAVTPAFGLVLKPFDRMSLYANYIQGLQQGPIAYQGTVNAGEVFPPMMTEQVEAGIKYDFGAFTATASIFQITKPSSIISTNAAGESVFSVNGEQRNRGVEVNVFGELSRGLRLLGGVAYTQGTLTQTADRLYDGNAAVGVPNWQTNIGIEWDPEPVAGLTLWGRMLATSSQYVNQANTQQIPSWIRFDLGTQYKTHAFGNPLALRFAVENVFDKSYWAAVNDGWVSTGLPRTFKFSAVMDF

SEQ ID NO: 16382 - protein, 317 aa, Erythrobacter litoralis
MYQTLINQKKTNKTLELTARSATRDIEQQTGEQRIHSVSLNTVGEFAIGDIANRFVVGTDLMRNKMDLGPIYNTRDINDGKVINIDNPNYTNPVAIKKNENNNAYQFNHLKTLGLYIQNTTYFTDNFIITGGLRYEYFDQVVGRSTLKNIRSGYLAQKDGKLLYQLGSVYKFTPNIATFFNHAESFRPQNNRTLIINGELPAEQGKSFETGLKYENAYLNATVALFNINKRNVAETVNVNGTNELQIVGKQRSRGIEFDLNGQLTDNLSIAANYTYTKVKNLENHNNKLAVGKQLSGVPKHQASLFLAYNIGEFDFW

SEQ ID NO: 16383 - protein, 710 aa, Erythrobacter litoralis
MKFQVTTLCSAVVLALNTSPAFAEQKKSSVDETLVVHAQSFDDYKVDSASGAMRTDASMLETPQSVNVIPEIVLDEQLATTLGEALQNDASVSAGSQKWNRETFYLRGFELSSTNGYLRNGHSLFTHYMLPIETLDRIEVIKGPSSLLYGNSAPGGMINMVSKKPTATPKVNVGADFDDLGSTRYHVDASGKLNESGTLRGRTVLVRQDSVESRKYATGDNRERDRFLGYGVIEADLYDWGLLSFNYEKTQDNAPIDSGSWLDLNGNRIGDKETIRDAHWSFINNDVENFGADLNLYINTQWEAKLSYNLQDMKRHRYDSMPTPDSNTLVDGSYTMSPFDRHDHWKTQAFHADLHGNFTALNVDHQVLIGTNGQFYDYAQQRVKGSSISVQPGENPANPGLDYNNATSTYESNNHFYGFYAQDLITFNDQWQALVGGRYDMYFADGTNSKDEVVSGANDSQSFSPKAGLIFHPSYNGSIYANYSESFNPVSNVVNDDNSITERVPEKSRQYELGTKWELMDNRLLLTGAIFDIEKKNISIKENGITTQNGTQRHQGVEAGAQGQIADKWFVMATGMYLDANFDKHDKYQDKRPANVPEWSGSAWTRYAMTDSTAFNLGMFYQGERWADNANTVKLDGYVRFDAGASHKIKSDYVVWDFRFNIENLFDKEYVAGTGGGGEYTTKSGSSTGVINDVHFGNERRFKLSVNATF

SEQ ID NO: 16384 - protein, 711 aa, Erythrobacter litoralis
MQDRTTASRHALSMAGGWAAAVGMGGASALTILSVVAATPAFGQTATASPTAERAISLDVITVTGEKIERDQKNTASSVSVITGKDIEKEKTGDATVSEVVAGVPNVVYTDTVSAPVIRGQDTQGPLTGQYSFWGGTVPRATINLDGHYLNYSEYYFGATSVWDVKSVEVFRGPQTTSQGANAIAGAIIVNTKDPTFKPEGAYQAEIGSYNTRRTSVMVSGPLVENQLAARLAIDYSARDTFIDYVSPNFQKGQTDQDFRALNARFKLLWLPTEISGLEAKLTYAHNASNRPGQEAASAPYENLQHVTTTMPTWNQTTDTGIFDLKYDFYNGFKLFNQTQYTNSSVHRVAPVASNGNADIEQRNVSNETRVTFGDQSTVLSGLAGVYYGYTKTDEVLYLSGLSTFDDRKSNLGVFGELTYKLTDRWTLNGGLRTQHDHIQRLGVSVYAPGPVDYDNTFTVLLPKMSLAYALTPGWTVGALVSRGYNPGGVSLNLNSRQWMSFEDESLWNYELFTRANLLNDTLTLNSNVFYMDFKNAQYNIPVVISTGVAQTYVINAEKAHAYGLEVGIDYRVLQGLTLKAGAGVLQTKIDQISSNVSYEGNEFAKSPGYMLSFGASWDATDKLNVSGEVRHLDRYYSDVANTVKYSIDPYTIADVRVSYQFHQLAQVYGYVKNVFDERAPTYMQENRGIGGTEASMTAPRMFGIGLRGTF

SEQ ID NO: 16385 - protein, 1101 aa, Erythrobacter litoralis
MVNVLRGYKFLFITTAIVSFSPTVCVNANSNNFATFCDPNAQFYKCNDGKKHTIKNKTYHLKFSQEYVSSSTPISALYVEKAGTVVDASQITVTGDSSDEIFGYGASVKEGARLNLTNSNFKNVPALHAENAVIRMIDGAITEVSHAIYALGKGTDIALVRVNIETTPKELNGVEIGLISSFGSKIRLSGSTVTFNGKGAFSSLYGGEYSFDSSVIKGKGKQETVIIGEKSVNKLPEAFDISQDGFVQLNNSSIELSDMHGFLVKNFSDEEDNKGRLLWQGLNSADEFKKTNIKIEKSKVSVQGKGTYGLYFYGLNPEDVWGNMYNGYRALSRAKKVAPGKAFVHLSETNFAVPDGIAIYSVGKHVYRAQAKVRLEKTRISGDLLLKAENNSYLLVEANSSTLTGDSRIKDTSDIYLHLKNGSQWHLTKSKYQDLQNPDATVSSLSGMELENSTIVFDHYQSAGYQTLHIGKKSSVNQLDEEEYVYGAGGNAQIKMSTFMNNDGSFDSQQTDRILIYGNVLGTTLIGMEEFQKTSEREASNEGNKSISLVQVIGTAEESSFKLNNSYTTVNGFPYQYKLRAYGPSSSSGNADPKNRLVAGEGDFWDFRLESVYIGPELDSSETASKPTSTVFPPQSEAETIPSERPTETILPEQPPSVEPPLMPSIPSLPEETEPSETFIPTDSTPTPSKPIPPEPPSVPTVPEEASTVPMPAPFVPVETSTDEVMPSKPSVPVVPSATDSDAVSPPSDAVEPKPSTSSDALKPSSNLPMPLDVQPELGIRAVVPQLPTYLLLPNALFHAGLMDMTTQNKKLETMRGVFHSSWKEDENTAFFLRAYGGSHHYASNLSAFEYGYGAELDYNAFQAGVLLNEIESLYTRTFFGALGNYGNLSLHPQNVEQSKKSAFHKWSVGAYGSLQHDTGFYMDGVLSYGLFKGDVLTLARGKVVALKGKQFSGSLTSGRTFAIGDKGVVFDPQVQIVYQYLQFHQALDVDNLDVDLGKFHQWMGRVGGRLSKTLGISEKGREVSFYSKLSYLHSFEDKQFVSFKNDFQLGSFGSSLEAGLGFDARLSSKLSLHGDVTYQHRLKKVGFSGAHFSAGLRHLF

SEQ ID NO: 16386 - protein, 732 aa, Erythrobacter litoralis
MSIFSRVITAGACVTATISNLLLVSFSLQAEESELQESEMEVIEVTSRQRKENIQEVPMAITVFGEQDIEDLGIERAADFISLTPNMTMVEAQNAGTSFITIRGLTQVRNGESPVAISVDGVLQISPNQFNQDLYDIAQIEILKGPQGALYGRNAIGGAINITTKAPTDELTGYAELDLGNGGLKALSGAISGPMTDTLNYRITASYKDFDGLIDNVYLNEKVDFQQDKNIRGRFIWQPNDDFSADLRIARGETEGGAVNYIYQPLFGINDANDASLNIEANNLGENDRQITSASLKLDWNISDVTAGLILSADELTEFLSGDQFPYSRNTSATSPFGPNVFDGVQTQYLDTSSQSAELRFTSDDDSDLRWIAGLYYLQTDRFISSFNGLDLGKGIPRVEKTPPLNDDISPATVFLADSNDNQSYAVFAQLNYDLTDTQELSISGRYDSDTREQTNRAPVSFDSNSGEVREETFSKFQPKVSYVYTGLPNLSLYANFSEGFRSGGFNQSGVGDLAASAGLSGVSDLYKAEESSNFELGIKGLYPDISTRFNASLFNTSIDNQHYFVFVGSLGAQVLTNIDEVSLIGGEFDFKTELHDNIDLYGSFGITDSEIKAYSLNPADVGNKAPYVPEYTVNLGAQFHAELFSGWLSTLTLDWEQRGEQYWDPSNTSARDAINLVNARLGFNRDEGDWSVNLWAKNLGNEEYLAEWVLGGFAHPAQERTFGIELRWNME

SEQ ID NO: 16387 - protein, 594 aa, Erythrobacter litoralis
MAMAIAIAAAPAMAESAFDQTVFFGDSLTDSGYYNPLLPAASRAVTGKFTTNPGWVWAEYVGDHFGTNAAPNGNGQIGDNYAAGGARIQASSVSALGAAPSVTSQITTYLTANGGRANPNALYTVWGGANDLLAASLAPAQAQAIIGSAVTAQVGAVATLQNAGARYVMVPTIPDVGLTPRFRAGGAVGMAQGTAAATAYNTALFNGLQSAGLRVIPVDTFHLLQEIVANPGTYGFSNVTSTACNPAVPLPACNPTSLVAANAQNTYVFADGIHPTTAVHQILGEYAISLLEAPRLQQVLTHSAQAGGRARADQVAWHLDGKPDADGMRWWGSVRGDMQRYDHADLYDGMAPAGLFGVDWTAGDLVFGGFAGFGRMDADFGNRNGSFKQDDTTLGGFFGWYTGPVWVNAQVSYSWLSYDVDREVQLGPATRVHSGSPDGSNLTAALNAGYSLGEGNLKYGPVAGLTWQKIKLDGYTESNDSATALGYANQDIDSLVGRVGFQVRLDGAMVKPYLQATYDHEFKDGGEASAWLQSMPEVGMYTVPGQNFDRNYATVVLGARTGLWGLQSNIGLSTTTAQRSARDATLFVNFSGNF

SEQ ID NO: 16388 - protein, 553 aa, Erythrobacter litoralis
MSNQYWKLLPVTSAMVMAQLLTVDIKTSVAQEASPMASQTEALQFLQRRNQLKQINVDNPNEPMSQVTNVNQLRDVSPSDWAYEALRSLVERYGCIVGYPDRTFRGDRALTRWEFAAGLNACLTQLERMIQEGVAVVREDLEKLRRLAQEFQAELTALGTRVDNLESRAAFLEDHQFSTTTKLNGEVVFGISGVATGQRNNGSEQIPKITTFGHRTRLELNTSFTGEDNLFTRIATGTVPELEETAETPQANLAFAQPEDSKVSIEVLYYNFPINKNISAWIEANGGAWDDFTNTLNALDGDGGAGALSVFGTRNPIYYQGENGGVGFQGTIGPFQWSAGYLASLKESPLPGEGLFNGPFAALAQFGYVPNDDFGVALIYNHGYNTLYAGSNSRLRGLGRLFTDSIVGTNHDTYSLGFKWKLMDHFIVSGWGGYSDAKTLKSYEDPDTGGTVSRGYLDIWNWAITLGFPDIIKEGSLAGIVIGQPPWVTSSNINLGDGSRLREDSPFHVEGFFQFPFTDNIQITPGIIFVDSPDNNKSNSGLVIGVIRTTFTF

SEQ ID NO: 16389 - protein, 397 aa, Erythrobacter litoralis
MNKNRGFTPLAVVLMLSGSLALTGCDDKQAQQGGQQMPAVGVVTVKTEPLQITTELPGRTSAYRIAEVRPQVSGIILKRNFKEGSDIEAGVSLYQIDPATYQATYDSAKGDLAKAQAAANIAQLTVNRYQKLLGTQYISKQEYDQALADAQQANAAVTAAKAAVETARINLAYTKVTSPISGRIGKSNVTEGALVQNGQATALATVQQLDPIYVDVTQSSNDFLRLKQELANGTLKQENGKAKVSLITSDGIKFPQDGTLEFSDVTVDQTTGSITLRAIFPNPDHTLLPGMFVRARLEEGLNPNAILVPQQGVTRTPRGDATVLVVGADDKVETRPIVASQAIGDKWLVTEGLKAGDRVVISGLQKVRPGVQVKAQEVTADNNQQAASGAQPEQSKS

SEQ ID NO: 16390 - protein, 646 aa, Erythrobacter litoralis
MKTRKMIRRKNTATALSAVLTIICPGFAMAHETELTPIVVTANPIIDRIRIDGFSSTSAVVTESQLHDQNAFDLATALRRTPGVQISRYNPVGAFGGDQGGGVYIRGMGVSRPGSEIKTYIDGVPFYMGVWNHPLLDLLPVNGMQAITVYKSPQPQINGNNFASINLETKRATEEGLHASGRISGGYFSTFIEQADLVGSYGNVDFMLAQGHAQSNGHRPNANGELNNVMGRIGVRLNANWSVGTSFLYVNNQAGDPGDNRLPVPAVAPQYNTQAGIVSVFVSHRHGNWRGGLRVYHNRGEGNWLHQSGLEGDQFNNFQMTGMRWKEEFSLWRGSAIVAGLDSDWVSGDVRFNRLPPAPRDSFDTPTFRVTSPYVALSQKIDLNENWSLVPSVGIRVYDHSMFRTRTSPHAGLSLVSEKLTLFGNVSRGINYPGLEAPVLSFLIPPLGQTWKQLSAEELNHAEIGLKLTPIDATQIDVSLFIDQVKNRFIFGFPPNVPPPPQFLNLGTYSIRGAEIAITQNIGRHWTIFGGLTLLDPTIDNLPYTPARAVTAGLNGQFGMIRVTIDTQYQSSVLALSRSRSAGAGNTERVDSFVIMNARVSHPLPFLGTKGEIFVAMENLLDANYAYRPGYPMPGRWGQIGIAASF

SEQ ID NO: 16391 - protein, 824 aa, Erythrobacter litoralis
MSDVHKSKLAQAIKVGLWGALAVYGAALLPLTAVAASEQTAVRRFDIAAGDLTEVLSRYASAAGAAISFDARQTAGLRSAGLKGEYGVQEGFARILAGSGWQAEPQSNGSFVLRPVPQGSGALELGTTQVQGQELGATTEYSGSYTTGAVTIGKGQHSLKETPQSVTVITRKMLDDQNLNTIDQVMEKTPGITLYDSPMGGKYFYSRGFRMTGQYQYDGVPLDMGSSYVQADSFSSDMAFYDRVEILRGAAGMLKGAGGTAGSVNFVRKRGQATPHTELTMSAGSWDNYRAQVDTGGPLNDAGTVRGRAVVTQQTRQYFYDLGERKDQVYYGALDFDLSDATTLGLGMAYEDVDSRPCWGGLPRYSDGSDLKLGRSTCLNTAWNNSRSKRATYFADLRQQLNDDWALKVAGVYTRNTQDIEYAFPSGSVPVGASRSSTLMLGSIYDYDQVDYGFDAYVDGHFQAFGQEHELTFGANASRSIKDDFYAVAGLPQRQNVLDPDHHLPKPDDSYYESNSTRGGPTDLRIQQQGLYSTVRLKLADPLTLVMGSRVSWYKSQNDSVAYWRDTRTPSSARSKETGEVTPFAGVLYDLNDNLTAYASYSSIFTPQGSYRTLDGASLKPLVGKSYELGIKGEWFDGRLNSAFSLFRTIQQDAQQDDPACPDSTCSLNSGKVRAQGFEAELSGEVIERLQVLAGYTYTQTKTLEDANSANNGLPFTTYVPRHLLRVWGDYQLGGALERFTVGAGVNAQSDNYRVSPTSGNHIRQAGYAIWNGRIGYRIDDTWSLALNGNNLLDKRYYTTIGTEGFGNFYGDPRNLTLSVKADF

SEQ ID NO: 16392 - protein, 835 aa, Erythrobacter litoralis
MNKYYLLIILFFVRSTKVFAEDYFDPSLLATDIIGEGNIDLSAFSRPGGGMEGEQEVAIYVNDEFYSRNTLFFKNTLDKGLLPEFTPGFFDELLSGDFLVSEEDKTISSSDFLKKVPYSDINFNQGMSRVNVSIPQAYLGDGAKLISSPDTWEYGGPAFLLDYNISGNRNDSGNYDSRSLYISSQMGVNLMKWRLRTSSSYSNYKTNSVWGGARSEQNSFYNTYAERDISSLRAILRLGEVSTAGLILDSVPFRGMKLSSSDDMLGMRLRNYTPTVRGMASSQAVVTITQNGRQVYQTNVPAGPFELNDFYLSGYSGDMLVTVREADGSEHSFLQPYSTLPEMKREGVSGFEVSVGRYDNNGAEHYYDAESFVYGNWSRGFARGVTFFAETLQAEKYQSLGGGSTLSLGRLGAASADISLSRADKYGDIRIGQSYGFKYSKSQIETGTTVTLATYRYSTENFYTFRDFVSKTDTARYIWENKLKSRMTFSLSQSLGEYGYLSANASQQDYWNSREVSRNYSLTHSFSWNDIYFSTTLSMDDQRGRETGHLSNKQAGIYASVPLSKLLPRTDPTSSSLTWSTSHADHKVRNSVTLDGKVPESDVRYRVGGSWGNGTTEGSRMASVSWTGDHASTSLGYTRVGKYRTLDYSMSGAAVMYPWGIAVGNSSVTGDGAIVVETPGAKGVRTSTGYKTSWLGTALISSPQKYTENRINLYPDGLPSDTVLGETSKTAVPAKGAVVVLDYTVFRGSQVVFTLRQTDGNPLPFGTVITLDGVSRGKENSGIVGEEGRVYMAGIPEKGTLTASWGLNKTCSIPFRINQHKAEAVIREVQGVCRV

SEQ ID NO: 16393 - protein, 699 aa, Erythrobacter litoralis
MNTLRRLRILGAAATLGGPAAAQEAPAMLEPVRISGTRTGTSVLDTPASVDVVDGHELRARNLQVNLSEGLAGVPGLQLQNRQNYAQDLQLSIRGFGARSTFGVRGVRLYVDGIPATMPDGQGQTSNIDIGSAGRVEVLRGPFSALYGNSSGGVVQVFTEQGSDPPEATGSAAAGSFGTWRYGAKLRGASAADGLDYVLDFNRFTTEGYRDHSAARKNLGNARLGLRMDDGSRLTLSANHVDLTAQDPLGLTREQFEDDPRSAPVAERFDTRKTVRQTQGGLLYERAFDTRNDLRVMLYYGQRRTTQYQSIPVAVQQSPTQAGGVIDLGRDYGGADLRWTSRQQVAGLPLTLIGGLAYDTMKEQRRGYDNYTGPPAAPTGLGVKGALRRDETNTVYNLDPYLQASWQFAERWTLDAGLRYSTVRFDSDDHYQAPGNGDDSGRATYRKALPVAALRYAANENLSLYASYGRGFETPTLNELSYRPDRAPGLNFGLRPAVSTNLEAGVKWRTGAGLVTAALFHTQTDDEIVSAGSLGGRATYRNAGRTRRDGVELQWNGEFARHARAQLAYTWLDARYRDDGPGAIRAGNRIPGVAAQALYAALSWAPPQGWQAGIEARYLGRIEVNDANSEAAPAYFVAAASAGYAWRAGAWSWNAYARVDNLFGRRYAGSVIVNEANQRYYEPAPGRNGSIGLSAAYTF

SEQ ID NO: 16394 - protein, 725 aa, Erythrobacter litoralis
MTRFKYSLLFAALLPVYAQADVSVSDDPKPQESTELPTITVTADRTASSNDGYTVSGTHTPLGLPMTLREIPQSVSVITSQQMRDQNIKTLDRALLQATGTSRQIYGSDRAGYNYLFARGSRIANYQINGIPVADALADTGNANTAAYERVEVVRGVAGLLDGTGEPSATVNLVRKRPTRKPLFEVRAEAGNRKHFGLGADVSGSLNTEGTLRGRLVSTFGRGDSWRQRERSRDAELYGILEYDIAPQTRVHAGMDYQQAKETADAPLSYAVYDSQGYATAFGPKDNPATNWANSRHRALNLFAGIEHRFNQDWKLKAEYDYTRSRFRQPYGVAGVLSIDHNTAATDLIPGYWHADPRTHSASVSLIGKYRLFGREHDLIAGINGYKYASNKYGERSIIPNAIPNAYEFSRTGAYPQPASFAQTIPQYGTRRQIGGYLATRFRAADNLSLILGGRYSRYRTGSYDSRTQGMTYVSANRFTPYTGIVFDLTGNLSLYGSYSSLFVPQSQKDEHGSYLKPVTGNNLEAGIKGEWLEGRLNASAAVYRARKNNLATAAGRDLSGNTYYRAANQAKTHGWEIEVGGRITPEWQIQAGYSQSKTRDQDGSRLNPDSVPERSFKLFTAYHFAPEAPSGWTIGAGVRWQSETHTDPATLRIPNPAAKARAADNSRQKAYAVADIMARYRFNPRAELSLNVDNLFNKHYRTQPDRHSYGALRTVNAAFTYRFK

SEQ ID NO: 16395 - protein, 333 aa, Erythrobacter litoralis
MPGIQKSLIAQEKTSLNQVVNTLKERISLAGYAQLGYTYDDAAKPDNTFDIKRIIFMAHGKITKRWTCDFMYDFYNGGMLLEVYTDYQFLPGLTARIGEFKVPYTIENELSPTTVELINCYSQSVCYLAGVSGSDKCYGMTSGRDIGMMIHGKLFHDFLQYKVAVMNGQGINTKDKNSQKDVVGNLMIYPLEWLSVGGSFIRGTGHAIADSEYTGIKTGENYAKKRWSAGGVVTTSRFNLRTEYLGGKDRNVKSEGFYATGSVCFARNLDFIASFDYFNPNKAADFKQNNYIAGVQYWFYPRCRLQAQYTFCDKKGNGQKDSNLIQAQVQVRF

SEQ ID NO: 16396 - protein, 183 aa, Erythrobacter litoralis
MSAFKKSLLVAGVAMILSNNVFADEGHGIVKFKGEVISAPCSIKPGDEDLTVNLGEVADTVLKSDQKSLAEPFTIHLQDCMLSQGGTTYSKAKVTFTTANTMTGQSDLLKNTKETEIGGATGVGVRILDSQSGEVTLGTPVVITFNNTNSYQELNFKARMESPSKDATPGNVYAQADYKIAYE

SEQ ID NO: 16397 - protein, 728 aa, Sodalis glossinidius
MNSPSFPMRLTLLAFCCSIGSPAWAAAEAAGRQDGPVVLGETDISADKADPHALPPVYAGGQVARGGQLGVLGNADIMDVPFTMSSYTEQLIEDQQAETVGDVLLNDASVRQSSGYANASSIFVIRGLKLTTDDISYNGLYGVLPRQIISTDALERVEVFKGPNAFINGVTPTGSGIGGGVNLQPKRAQDTPTRRFTTDISSDGRVGEHLDLGQRFGEGNRFGARLNLSQREGETGVEDEEHRSKLFALGLDYRGDNFRLSGDFAYQKQRINQSRNTVFVDSALTSVPHAPDSDTNYAPNWTWTETEDTFGMSRAEYDLNEDWTLYAAVGAKHTREVGVYGSPTVHDAAGNTTAAPSFIPHDEDNKTAMAGINGKLQTGAVSHKVNFGLSGIWTEQRSAYLFGGTSSNNLYEPVSQERPALDSFTAGDLNDPGIVGKSRMRSAAFSDTLGFFDDRLLLTAGLRRQQLRVQGYEYGSGPRNALYDEAITTPVYGVVFKPWHYVSFYANRIEGLAQGPTAPDTVTINPGEVFAPARSKQVEAGVKLDMGTFGASLGVYRIEQPADGYQVLEGTGSRYVRDGQQRNRGVEMNVFGQPVSGLRLLAGLTLMDTEVSGTDGGSNDGNRAIGVPTFQFNAGADWDIPGIEGAAINARMLRTGGQYVDAANNLSIPTWNRFDLGARYTFNVAQKDVTLRANVENLMNKDYWASANGGYLTQGEPRTLKLSGTVDF

SEQ ID NO: 16398 - protein, 392 aa, Sodalis glossinidius
MRVLKNAGRGLAAGCFVLAGSGSALAGAWDTLGIGSSELLFAPEEFVAESSFTYVDRNVDYDITTASTAFGPVTGDASSRATPNIWNYQGALKLALTENADCLARVNNPYSIEEEMDPNWNGRFSGYETRAVTFAFDATCSYKFQVGEGQYLRAIAGARALDLTYFSEGLTATSPSNIVVAKVDLKSKGLDVGWRAGLAYEMPAYALRASLIYDSEIHVDLEGDTEAVGVTTFDSFASLTLPQSVEFNVQSGIAPNWLASFGVKWVDWSVIDKLSVTNAAGSKTVDRKLNFQDGWTVKAGIGHRINEQFSVGSSLQWDRGVGGSYSDTYTIGLGGSFAASKNVKFTLGTAAIYKTAGSGDMTNDVSSISAVTEYDYDPSWAYAINTKLRVSF

SEQ ID NO: 16399 - protein, 160 aa, Sodalis glossinidius
MKLQVLPLSQEAFSAYGDVIETQQRDFFHINNGLVERYHDLALVEILEQDCTLISINRAQPANLPLTIHELERHPLGTQAFIPMKGEVFVVVVALGDDKPDLSTLRAFITNGEQGVNYHRNVWHHPLFAWQRVTDFLTIDRGGSDNCDVESIPEQELCFA

SEQ ID NO: 16400 - protein, 459 aa, Sodalis glossinidius
MRLFTFTTLALSIASFAAVAQADTQSQDYVPFSLKGTSEQDEAKGFIDGQSLSGSTRNWYARERATRAPLFKYYKSDGTRHDSHSRDNWLQGTILNYSSGFTQGTVGFAVEAAGYNAIALEQGRAAVAGPNNRTLTHSDGDPVGQWSKMGLANVKARVSNTTLTVGRQSVDTPMIAYIGNRALPSSFQGAFLHSAEFDNLSFDLGTFDRVSPRTEQSLSKFRSEYGAAGVETDRASTAGVNYQPLKSLTTSLYATKVDDFWNQYYFGASHVLGDSTVLSLTTGLNYYKTVDAGSQKMGEIDNDTYSLSFGLTHQAHTLSASWQQVNGNEYFDYLHETNGIYLANSLLSDFNGPNEKSLQISYVLNMAPYGVPGLKFNLYNARGWGIDGTHYRGTAYDVNGLDGETHYEWGIGTSYAVQSGPLKDTSIRATYTAHRASKAQADGSLDEFRVVTTIPFNIL

SEQ ID NO: 16401 - protein, 522 aa, Sodalis glossinidius
MARTIAFYLWSSGRAESETVHSCVTARPRGSFLSRRAVPCVLSGVLALMALACPPALAEETGRPVYEGAGGDPRISVSQPESTSQASGGYVRSIEPSLGPLGDPFGLRPVLKARGIEYSLTYIAETLGNPVGGLRQGAIVEDRLNLRLNLDLKRLAGWDGATVHANAYFIHGTGLSRYYVGNLLATSVIEALPASRLYVLWLDQQLFDGKLGLRIGQQAADTEFFVSQTATLFVNSTFGWPAITGLDLPSGGPAYPLASPAIRAKYVPGNGFSLQAGLYDGDPAGANRPGDDPEAQRLDRTGTNFRTRDPALVVAEATYAFNTQEGSKELPGDVTLGGWQHFGRFESLRIDNTGLPLADPNSTGIGRPLRGNAGIYAIYDQTLYRETGKDDEGLGFFVRAAWSPTRSSLVSAYLDTGLAYKGLFEGRDDDTVGISLAHARLSDDARRSDIDTIVYTGTAMPRRRAETVIEATYQAVVVPGFTVQPDVQLILHPGGGIANPRDPEGRRVRNAAVLGLRATVQY

SEQ ID NO: 16402 - protein, 345 aa, Sodalis glossinidius
MKKTAIALAIAGLTAASVAQAAPQANTFYAGAKAGWASFHDGLNQFENSQNAYGTLRNSVTYGVFGGYQITDNFAVELGYDDFGRAKLRKGGETVIKHTNHGAHLSLKASYPVLEGLDVYARVGAALIRSDYKSTKRAESDYVMHEHSLKVSPVFAGGLEYNLPSLPELALRVEYQWVNKVGRVEKDGSRVDYTPSIGSVTAGLSYRFGQSAPVVEPKVVAKTFALNSDVTFAFGKANLRPEAQNVLDGIYGEIAQLKSVQVDVAGYTDRIGSEAANLKLSQRRADTVANYLVSKGVAQEVISSTGYGEANPVTGAKCDAVKGRKALIACLADDRRVEISVKGNE

SEQ ID NO: 16403 - protein, 689 aa, Sodalis glossinidius
MIKRLFFLLPFSTIVSANEPDTIQVKRIDLDEVTIVAFKQNTPNREPLSISTLDNRFLKENKISGAKDLSSLLPNFYMPDYGSKQNSPVYIRGIGAKKDAPSVGFYVDGIPYFETSAFDIDLSDISSIEVLRGPQGTLYGRNSIGGTINVYTHSPLDYQGTYFRLGYGSYNDMRLIASNYTKVNEQLGLSFSGNYHHNDGFFTNLHTHKKADKLDNGAGRIGLTWKPAAHWTTRFITSYEYSNQGGYPYGLYNADKGTTEAVNYNNEGLYRRNLLTSGINIRYNGPHISFNSQTSYQYIQDKMGIDQDFSPRNIFYGQNKIRQHMYCQEFTVKSVNKSRYHWITGAFVFRQTINRKVDLSRFTDTTRHLTNSGIPTQGIAFYHQSTLDLLQGLSCSVGLRYDYEHARCDFSKVQQLLNGNGETKSLEQFNRSLHFGQFTPRFSMQYLSSHNQLFYASVSKGYKAGGFNVSFLNNDDYLYSPEYNWNYEIGTKLSFLNNRLSADLSLFYIDWRNQQITNTIPTVGNVIRNAGRSRNKGIEASFQARPTKSWMMYMNYGYTDARFVHYQKEERGILKDYGGNYLPMVPRHTFSLTTGYSFYDICSWIDRLTLNAGVSVTGPIYWYEDNQAKQSPYALVNLRISINKGCFTWEVWSKNLTNTDYLSYYFVTSKAYAQKGKPITLGTSVSISL

SEQ ID NO: 16404 - protein, 370 aa, Sodalis glossinidius
MKTPFITLSLLVTGIVSSLAHAGGLNLSQIATTKSVGTAGTGNVTANDASAVLTNAAGLSAIEESAWILGVQYLDVETTFVRDDNSASTTGSSADVLPHLSYASRLNDQWVVGAALHAAGGTGVEYSHGVGAHPALLIKENSISALNLTSSLSYQVNEQLSLGGSLILQHAALETQALNGLELQGDSLDLGFGLSLNHHISDNTQLGVSYQGQFDHDLSLDNANAFGISSELTWVRSLNLGLKHSLNEDLNLLLSSNMETWQDYDDKYSTTYSLGVGVEYAYEDWLLYSGVSGDTSPVSSQNRDVLLPLDKQWRIGFGAEKKISNDLNLGLSYQYQDLGHGEINADSGLFQPSGSYSTNRVHFVTLSLRH

SEQ ID NO: 16405 - protein, 485 aa, Xanthomonas oryzae
MPIFQREGHLKYSFAAGEYQAGNYDSASPRFGQLDLIYGLPWGMTAYGGVLISNNYNAFTLGIGKNFGYIGAISIDVTQAKSELNNDRDSQGQSYRFLYSKSFESGTDFRLAGYRYSTSGFYTFQEATDVRSDADSDYNRYHKRSEIQGNLTQQLGAYGSVYLNLTQQDYWNDAGKQNTVSAGYNGRIGKVSYSIAYSWNKSPEWDESDRLWSFNISVPLGRAWSNYRVTTDQDGRTNQQVGVSGTLLEDRNLSYSVQEGYASNGVGNSGNANVGYQGGSGNVNVGYSYGKDYRQLNYSVRGGVIVHSEGVTLSQPLGETMTLISVPGARNARVVNNGGVQVDWMGNAIVPYAMPYRENEISLRSDSLGDDVDVENAFQKVVPTRGAIVRARFDTRVGYRVLMTLLRSAGSPVPFGATATLITDKQNEVSSIVGEEGQLYISGMPEEGRVLIKWGNDASQQCVAPYKLSLELKQGGIIPVSANCQ

SEQ ID NO: 16406 - protein, 415 aa, Xanthomonas oryzae
MTLSQAALAADEDHPFYILGPDVDHVGWTPGLTPTAIEAEIEDVSTMRKGYFEIPGVSRPFDYTYDRLDDLYNALGLRIGTAYTMLFQGLSGGPWDQFGGAGDFDLMGSWTLVGKDTENTGRVIFDLEERFKIGERTPNSLGSQIATLVATANTFNDRGLALRDLHWEQRLWDGQFRFMFGRADSTAYFGSTWMQSANNSFVNRMFAANPTVAAPGHGPAAGISFKPNDQDFYITAGAANAFSSTTRVNIDSLVDEWTFFSYGELGWTPKFEGLGEGRYTFSGWHAGERESLGQPADWGVTAIADQQFNDVVEAFARWGYAGKADLGIRNYIQGGVGFRLGLAGREANDTVGAAFSWAFPSNSELRQEKVCETFYRLQLTRFSQFSVGAQAIFDPSDAPGTDVVGAFWGRLRIYF

SEQ ID NO: 16407 - protein, 692 aa, Xanthomonas oryzae
MKRHLILLFVGVSLPFLLAAQQKNSVSITKRVLRIPEVTVVGKRPMKDIGVQRTRFDSIAMKENIALSMADVLTFNSSVFVKNYGRATLSTVAFRGTSPSHTQVTWNGMRINNPMLGMTDFSTIPSYFIDDASLLHGTSSVNETGGGLGGLVRLSTSPANHEGFGLQYVQGVGSFSTFDEFLRLTYGDKHWQSSTRVVYSSSPNDYKYRNRDKKENIYDEDKNIIGSYYPTERNRSGAYKDLHVLQEIYYNTGEGDKFGLNAWYINSNRELAMLSTDYGNDMDFENRQREQTFRGVLSWDRVREKWKVGVKGGYIHTWMAYDYKRDKGNGEMASMTRSRSKINTFYGSADGDYAPSEKWLFTAGVSVHQHLVESADKNIISQEGNKAVVGYDKGRVEFSGSVSAKWRPVDRFAASLVLREDMFGTEWAPVIPAFFIDGVLSKKGNIVAKASISRNYRFPTLNDLYFLPGGNPDLKSEHGFTYDVGLSFSVGKENVYALSGGINWFDSHIDDWIIWLPTTKGFFSPRNLKKVHAYGAETNAHLDIMLGKDWKLDMNGTFSWTSSINESEPMSPADQSVGKQLPYVPEFSATVTGRLSWRTWSLLYKWCYYSQRYTMSSNDYTLTGYLPPYFMNNVTLEKQLSFRWADLSLKGSINNLFDEEYLSVLSRPMPGINFEIFIGITPKFGKNKNSKR

SEQ ID NO: 16408 - protein, 294 aa, Xanthomonas oryzae
MIFTTGLRYIYSNLFDSEFTPRIYLVYHLNDNIAFKGGVSKGYKTPSAKQLTNGYYNYANGNALFGNPDLKPEESINYELGADFRVFDFAHYSITGFITDFTNQISSEYLTGMQNGINCSNGTVCKRPINLGKTQTKGIEFAFNTKTYNGFSLNSSYTFMDNRYKDSQKNWFGGDRIENLPRHIAMLKLNYERGKFNSYIKTRARLDTIAKARVGGNGSLPWQKYKPFYIVDLGINYKINKQSSLSFAVQNLFDKNFFDPQVTRWDGANPAGYANRYQDYTEGRSFWLSYKYDF

SEQ ID NO: 16409 - protein, 817 aa, Xanthomonas oryzae
MPRRVTPHCYPRKPLVVAMFSAALLLQATVIHPLSAAGQARAVEATRSYAIASGPLGAVLSRFASDAGVVLSFEAELTQGKHSTGLQGTYSVDQGFARLLAGSDLQVMAASNGNYLLLPRTKDGALELGATSINASGLGATTEGMGSYTTGSTNTATKMNLSIRETPQTISVITRQRMDDQQLHTMSEVLTQAPGITMSQDGGERFNIYSRGSQINTYQIDGVTTTQENQTRTMPGTLLDMALYDHVEIVRGATGLMTGAGDPSGVVNVIHKRPTAYFQSYVQGTIGSWDYNRLEADVSGPLIDSGKLRGRFVAAKQDNNTFMDWYSQDKNIAYGVIEADVTDTTLVRFGVDYQTYKATGAPGVPLMYNNGQQTNFSRSTSAGARWAYDDYETFNYTINVEQQLANDWQLKVAANYMDVDRDVGVAYYATNSLTSSLDPATNRANAERGKSWADQTQKGVDVTLQGPFQAFGQTHELIIGYNYQQYDNTHFSYTGGTQGFDFDTWDNELPKPASYTPLLDFNINSRQSGYFAATRLNFTDDLHVILGARGSNYEYNYYSKVLNAIPERDPTVYGMRERGVVTPYAGIVYDLTPEQSVYVSYTDIFKPQSNRDIDNKPLDPVEGTNYEAGWKGEFFDRRLNANAAIYYIKRDNLGVATGETIPGTSDIAYKAVSGAETKGVDLELSGEVLPGWSVQSSYSWSRTEDSDGNRQLTQLPTDTLRFWTTYRLPGEWDKLTVGGGVNWNSGTSLYFSRYQTRAKQDDYYVASLMARYQVTDHLSTTLNINNLFDEKYYAGFAGNYGHYGAPRNAMLNLRYDF

SEQ ID NO: 16410 - protein, 532 aa, Xanthomonas oryzae
MDLIRQLTRREAGGWDRLANDNKEQSWDLSAGLRGVWADRFDWELSVGRSRYTVDAYIRTVDTARATDYFFGSSLGTAADGTPIHAINQARVYTPLSPDQYDALVAKSHNSAYSWVNQASFSVSGDVVQGWSGPIRFATVAEVAKQGYQLSPDPCANESYPVDVVDSGGGERMRSSAGLEFRIPLLSTLSANVAGRYDRYGNYRSSAAIPTDVGTQSDTTWSAGLEWRPVESLLVRSTVVTSFRAPDMHYVLGEPSSTNQTVIDQSRCISSGAYLIGGCNDENNSIFYTVDVNRRGTPDLRSETGRSFAGGVVWDIAQGLSLSLDYYRIQLDEMIKDLDCDEILSAEAGCRTGTTISGGTWNTPGGAGYCETITSRVLRNADGTIASIERGPINLAQMETSGIDAAPKYRLATAGWGNFQLSLDYNNLIAYREQIYRIDSDENRRDERVRSRVRGSVHWDNGGAWDWTVYFRRIGSMRAVNWGTCERFDDGYQPSASDACLVTDTANVHLGETSKRYFGRAGPAIYCNLSAG

SEQ ID NO: 16411 - protein, 902 aa, Xanthomonas oryzae
MSPLPRASLRCCSPSSLSLAIALSLLACGANAQTQDASAAAAAQISQLDAIKVTSSYQKSLITAMDNKRDDVRMTDGISAQDIGKFPAENIAEAIQRIPGVQISTINGRGSTISVRGLGPQYSATTINGQVIKSADFTDGFRYDIIQPEVAAGIEVIKSPSADMDAGGLSGTVNINTTKPLDYQQTKLLFSAKTQYSEFAGGSPTPKGVLTYIDQFKFGGGDLGVFLSAGYQKLKDRADYLWIDRWYTQATDAGTLYIPRRPRYRSIERETTRKMFNGGLQWKPSEQLEMNLTALYSQDRTANDMNQLVYSFERSPLTVLQTNGLTATQVSASDYWLENNHQIEQHNLSTQLLTYDFKWTGDAWTLSGAANYTQGKTDENERAAILGRIPSATLLDTSNPDAISLTTDADATDASAWNKANLVRSEYPNGSIQSLSNKEWSLQLDAERYLELGALNAVRFGAKYRRETFDRDVRRRDFLYLLRTGAVSGFDMFPELSAASSTVSNFLDGQLASQDSWVTPDVGAYARSLAAAGITVPVLFAPQSSYSIENDISSAYAMARIDTDIGSMRLRGNVGMRYENTKRTTDTYLTQTQAASDDANVVVGTARAPYEYSNWLPSLNLVLDMREDLLLRFAAAKVLVRPILDSNTAIASTISTGTNTGGTTTYVVAQGQTDLKALTADQADLSLEWYYGNGGALTVAGFWKNIKNGTFNSIVCPAAFNGTVLSSNAAGDCVSSNGDIYEITATTNDPSKVKIRGYELGWTQSLDAWLPIDGFGFTTNFTRVIPQRDTDFKIRNLSEKTWNATAYWESAHYSARVSLNHRSEYEQDSSDSFFAREGHIMKARTQLDAVLGYQVNDKLSFQLGGLNLTNRKEEAYKDIPSRWQMTGVTGRSYYLSMQWDML

SEQ ID NO: 16412 - protein, 752 aa, Xanthomonas oryzae
MRQQSHGRLQQFHLPMRVLRNTSFSLLLAGVSASPLSLADTVTEDSQAAGKKPEAAARLKTVKVNATATDGGVDNGYRTETVSGVGAWQGRSLQDTPYSLNVYSEELIENLQATTPDQVYRVNPTTQLVRAQHENNQPRIMMRGFSVQRSYRDGVPDDQYNHSATMEDTARIEVLNGLSGFLYGANNVGGVTNYVTKRSTDERVNQLTLSSLGGDSWYTHGDFGGKFDSEGKYGYRVNLVEQGGDGAIKNQEIEKTFYSLAFDGYLFDDFWVQIHGMDYTYDVNGSQTYWYFASGVKRPSADSIDNDISWGQPWTNRWYDYNRYGSNVKWQISERVALRAAYIDNRGTRGSESTSNTITSAGTYNQQISGVYAPGLDTLLSEQKDSGAAAYLDVLFETGAVEHKLTAGYQYNDSFQYRYQNQNGVATNAAPINLSGLSMSSPTYIPHPTNVAPVNRGVLILSSNTEYRNLVIGDDITFNEQWSALLGAAYTSITQKTGTGYDESALTPSVSILFKPVETLTTYISYIEALEAGVVVPQYYNNNQSVTVVNYPGVFDPLTSKQVEVGVKAKVSQLALDAAVFRIEKGLQYYVMIDPANVRFVQDGQQVHQGIELTAIGNLTDNLNIIGGFTWLDAQVEEQNENPALEGKTPVDVAERIMKVRFEYAAPFVPNLNLSASASYNGSSYGNTMNTDKVPGYTLFDIGARYQMDVAKKLVTFRADLHNLTNEHYWNGFNGTRIGDPRTLMVSATVEF

SEQ ID NO: 16413 - protein, 660 aa, Xanthomonas oryzae
MSRPQFTSLRWSLLSLAISATLPMSAFATETMTVTATGNARSSFEAPMMVSVIDSSTPENQTATSATDLLRSVPGITLDGTGRTNGQDVNMRGYDHRGVLILVDGVRQGTDTGHLNGTFLDPALIKRVEIVRGPSALLYGSGALGGVISYDTVDAKDLLQEGQNSGFRVFGTGGTGDHSLGLGASAFGRTENLDGIVAWSSRDRGDLRQSDGETAPNDEAINNMLAKGTWQIDSAQALSGSVRYYNNDAREPKNPQTVEASDSSNPLVNRSTIQRDAQLSYKLAPQDNDWLNADAKIYWSEVRINAQNTGSSSEYREQTTKGGKLENRSTLFADSFASHLLTYGGEYYRQEQHPGGATTGFPQAKIDFSSGWLQDEITLRDLPVTLLGGTRYDSYRGSSDGYKDVDADKWSSRAGLTISPTDWLMVFGSYAQAFRAPTMGEMYNDSKHFSIGRFYTNYWVPNPNLRPETNETQEYGFGLRFDDLMLPNDALEFKASYFDTKAKDYISTTVDFAAATTMFYNVPNAKIWGWDVMTKYTADLFSLDVAYNRTRGKDTDTGEYISTINPDTVTSTLNIPIAHSGFSVGWVGTFADRSTHISSSYSKQPGYGVNDFYVSYQGQQALKGMTTTLVLGNAFDKEYWSPQGIPQDGRSGKIFVSYQW

SEQ ID NO: 16414 - protein, 818 aa, Xanthomonas oryzae
MNKAILLAGAAALAMTVQASPGFAQEASEDAELKQDVIVVSARKKEEGLLEAPVAVSAFSEETLENLQLESVDDIARFTPGLSFGKAFGRSTERPVIRGQSNVLAGVQFGVESGTAYFIDGVYYSGSIQNLDPNDLQRVEVIKGPQSALYGRNTYAGAINFITKGGTDTFEATGKLRAGNNDTAEYAASIAGPIFPGLTGRLSFRDYEYGGEHENSVTGELVGQEKTTSLAGVLDWAPVSNFDSRLRVSFSEDRDGVLPLFLQSAEENNCLPGYRSLAFWPLSGSTNTNQYYCGVIKPGQVAVNSGVDADGVPNVVPGAPLNSTFPFFAGAYGLGDGTAFDGITRDLWVASSVSTYRFGDAGWEASLLAGYSKEHNKQGYDSDHSSVNFFLAGPTQEPFFANTTRKDIEDYSIEAQIASPQDLRLRGMLGVYLYDQLFYEGDITFADPSGRSADTGKRTIRNEAIFGLVEFDFTDRLTATLEGRYAEETKTDRTSTVTPEVSYSKFTPRLTVDYDLGNGGTIYAVVAQGVKPGGINGAIGEAVGMPTYKQEESDNFEVGLKTPLPDVGLGDWSVSMAGYFTDATNVQLTSAVAATSGAINSIATNQGAGEIKGLEIDLNGAVNDILSGGFTYAWTDAKFTEGCDADEWTMTSGGGVLTDPDNQTGTDFSGLFPGAGPASCSIAGRTFPLTSEHQASVFARLDFREAGPFGSDFFVSSDLTYESSKFVQIHNQAETGDATLLGARFGFETDRWTIAAYGQNITDEDSIVVATRWLQGPYFSAGFSPNVAPTTASRGAPRAYFGSLRRGPQYGAELRVRF

SEQ ID NO: 16415 - protein, 495 aa, Xanthomonas oryzae
MISTKNLLRSAIIAAAVAPAVSMASGYKINEQSAAGMGTAHAGRAAMAEDASVVFYNPAAMTQLDKAQISGGFTYINGYGEFEGNGTDVAGNQITGANDSDPFNDGGNFLGEKFIPFFYYANPISDKLAVGLGVYTPFGTETNYDENFVGGGFADETSLISLELQPSIAYKINDQLSIGGGLDIIYMEGTLSKSVDSVPYNQAVNDNIGSGVVLGNPEYQGFEGFYEVTGDDWGVGWNIALHYQLSEKTNLGVTYRSEIDVDLEGDSTFRDNTFALYNNNGTAADPFDDTVTPVPVQPQASKVPLTTPESLTLSVTHQATDKLLLQAGATWTGWSSFQNFDVIATERATPNQADGLDISDISYGDGVTGLDAGYIGHIDERWVDVWAVAVGATYQLNDQIKLRAGYAYDESPVRDEFRTARVPSSDRQWLTFGAGYKVDQNLSFDLAAGYLFMYPMDLSEINKQNDNTPTDSKASVTGEYEIDVFGLALQANYQF

SEQ ID NO: 16416 - protein, 706 aa, Xanthomonas oryzae
MRPCALLLLLIGLLPLLNAPPQAQPAPARPVADTTARADSLWQLDMEQVVVTATRAERSADDVGVPVSVIGQQEIEAQGAARATDLLADQPGLSINNDHGSGLQMRGLGPEYTLILLDGEPIVGRTAGTLDLGRLTTANIERVEVVRGPTSSLYGSEALAGVVNFITGAPAGDLGGEVRTRYGTHGTVDLSARLEGTSGPWQGSVFVDRYRTGGYDLSPAALAPTRPGYVDYTAQARGQYEAGPSTTFSLRGRLATQSQNYDVGISADGTTGDVRHAQQNDRHDWNASAEVEQQLGAGWRLTGTLYCAGYHTDQSLRRVDNGTIRSESVLDQYHGEAEAVLRGALGNNHLLTVGAGTTVETIDADRKTGTRRGGFGFVQDEWSPLASLDVTGSLRLDGNSDYASRLSPKMAVRYAPFDRVSFHASVGSGYKAPAFRQLYLNFTNPQAGYSVFGTTEAQRGLQQFEEQGQIDTFFRDPSTLGEPLAPETSWAFNAGFTASLWGDATLRLDAYHNEVDNLIDAEAVARKTNGQSVFTYVNRNEIYTRGVEARLTLRPTSALRVQLGYDYQEAKDRQVLDELEAGDVYRRENGRDVQVSPDDYAGLPGRPAHTGTVQLRHMALPFGLTANVQGTLRGRAGYADRNGNGIVDVDREYVEARTRWDVTVSKTLLDDYTLRLGGENLFDYTNPRRVPSIPGRTWFAELQAQF

SEQ ID NO: 16417 - protein, 642 aa, Xanthomonas oryzae
MASTITKTVLLAGTASAAFAAQGWGQELEGYYALDPLYFEQLDGLAGAADRATSMYVSGRELEHARTGDLKDLFSGIASVSVGGAIPVAQKIFVNGVDMLNLGVVVDGTAQNNRTFHHATANAIDPGLLEEVRVDATVSPADAGPYALAGSVVMETVDPERLLDEGRNFGGNVRLSYGDNGETFQRALTLAGRTGGLSVLGYAKRATGEDYVTGDGDTMGGTAADLDSLLGKIAYESESGHRIEFSGQQLRDDTLRQYRANFGGDDSDLRTYDTTRTSYSLRYENTAATGLWDPSAHLGYSESDIIVEEPYDSNGLSWTKSATLMNTFNLATGTVNAGYDWRERFGEYDSPAFDEYQTEQSVTHGLFAQARLQPTDALGLSFGARYDWQEFEGVTGEEVSHSGASGNLSATYAVTNELTLRGGVSSVFGGIDIEDNYTYWEFLPPFDYGTLDPSRARNASLGLDWERGRLKLGGELFITQIDNARGGTDNFDFESRGFNIGASYGWDSGFARFTLSKSDTRIDGDRSDSYDQLDFGAPLGTVMAFEIDQETGVDGLNVGGGIDAALDYEMPSGLEDLEGYTVVNAYAEYVPPQLDNITVRASVDNLFDTEYADRATYGSDYVGFTTLKEPGRTFSLTVVGRF

SEQ ID NO: 16418 - protein, 1037 aa, Xanthomonas oryzae
MTIHSARHRRPFFCSTSPVRYGRISMLALALSGAVGMLATGTAAAQSTTAGIYGSAPASAGATVTAQSDNGFTRTAPVDASGRYAIGNLPVGTYTVTLQREGQAAETRKNIALRVGAGTDVSFGSSDASSGTATLGTITVTGNNISPVDVSATASRTVITAEQLQRLPLARSGEAIALLSPGAVQGSGYFGNAISFGGAGVTENAYYLNGYLSSNPLTNIGGVTLPYGAIDQQETYTGGYSARYGRSAGGVLSQVGKRGTNEWHFGGQMLWRPKSLSSDYKDVFYPDTPLPSSDYSYSKPKLPGTLYRSRKGDKAWNTVFSAYVGGPLIEDKLFVFLAAEQERKDGVSTASRGASVIGRDTYRVDKPKVYAKVDWNINDSNILEFTGVKNNDRESGAYSDFSYPGVIARSASGAFADTVKVDDRYYIGKYTSYITDALTFSATYGKSQQSDYRNNPSLAPYLYNANREDPAITGGGEIHNNQTSTQSRDGENRTHGLRLDLEYVLGSHTLASGVDNMYFNANNEGALTTGPGYTWSYDNLDPNVPISDTLGVGPAGGNGYYVYRGVFKTATSMSVRQKAYFLEDKWQINDRLLLILGVRNDKFTNFNDAGKVYVESGDQWAPRLGISWDAFGDSSLKVYGNVGRYYLALPNSVAIRGASPSTKTSEYFTYTGIDAQGNPTGLTPIPVDPSVGVSCSGNVVSSDRECGQQPDVASVAAHNLKSMYQDEFMVGFDKTLGSDWVTGAKFTYRNLGTTIDDVCDSDKMRTKLTAIGVDPSTVDVPGCVIFNPGETNSFSLANLDGSGRTALSMSSADWGFDKKAKRKYLALDLFLQHPFDGTWEGRIDYTVSRNFGNTEGQVKSDIGQADVSKTQDWDAAALMWYSGGYLANDRRHQIKLYGSYQIAPEWLIAGNIRVLSGTPKSCLGYVSINGISENSAAGDPVGYGSSYHTCNGQPSRPGDAGRLPWTKIVDLGLTYRPEFADKKLAFTLQGFNIFNERKPLQVDSIWEDNHYKLSNTYGMGVNFTQPRYTVLSVSYDY

SEQ ID NO: 16419 - protein, 1082 aa, Xanthomonas oryzae
MTHPLRMSKLTLGLVAALAAAPAFAQSTSAGVGGQVMSAAGQPVAGAEVTITHTESGTVSRATTDASGRYNARGLRVGGPYTITITKSGEGTKTEEGVYLNLNQVNTVNANLGGDLAATNLDAVNVVATAGGLDLFSANKMGTGSNVTRETMDALPSANRNIQDYIRLDPRISQVSKADGAISAGGQNTRYNAIRIDGISASDPFGLGSNNLPTERQPVSMDAIQEINIDLANYDTTIAGGTGAVINAVTKSGTNEFHGTVYGSYRDKDMVRSRLEGDKSDFNGFKDEKTYGMTFGGPILKDKLFFFTNYEKYERSGGGVSLSDSPYNKDPSKGGISDADISAVQKRMSDLGYPVGGVDGLNNKTTIEEYAVKLDWNINENHRAALRYNKMKQDVVRFPQVSSSALSLSDFWYTQPTQYETWMGELFSDWSENFSTEFKVSHKDYSSNRVAASHLPQMRVRFGNNSLYLGTEQNTHTNLVESKELSAFGAGTWYIGDHTVKFGFDYTDNNLMNFYGRNLYGAYDFRDLASFLKGTANGYQLRVPRPGGSLDDIPAKFHLKNTGLFIQDTWAINYNLSLMFGVRLDIPDFTSQNKYNTDIQSRYGYDNTKLVDKSLFQPRVGFNYTFDSDRPTQLRGGVGLFGGAAPNVWLAGAYQNTGLNYVEYNVSGNPGGFSADADNPFIPDPSKIIARQNVDIIAPGTRLPSVWKANLAFDHELPWYGIVASAEVLFTKVKDGLYFERLDLTDGKGKGATFVSAQDGRELYWNPAGLNQANSKIDSRSGDNLGMENGTNGALNRANRPNNIGDVMLLRNTDKGRGSQATFSLAKPLTENWGWSLGYTYTQSKEVSPLTSSQNTSNWNNTQILNANENIAYNSRYAIKDRITGTLEWKHNFFGDSATRIGLFYEGRSGRPYSYVFYNDANGDSAIGNDLFYVPKGVGDVLFTGGATMEKKFFDWLAQNPELEAYRGSVVPANSHRAKWVNSFDVRISQEFPGFVKGHKGEVALDIMNVGNLLNKKWGLIDDYGFYATRRVGNFAGIDPATGKYVYSFTGADDSSIQENNNDKGNTAVSRWSMQLTVKYKF

SEQ ID NO: 16420 - protein, 784 aa, Xanthomonas oryzae
MSPSRALSPLSRALLLACLGGPVLVSAGSACAAEIRTDARQYYRLPAEPLEQALNHLGRQAGVLIAFSPEQTAARRSQALDGEYTLEEALAALLVGSGLEARARGDGAYTLEALPVEDPANLQALTVVGDWLADASAADVFEHPGARDVVRREQFQAQGAASTREVLERIPGVSAPLNNGTGSHDLALNFGIRGLNPRLASRSTVLMDGIPVPFAPYGQPQLSLAPVSIGNMDAVDVVRGGGAVRYGPQNVGGIVNFVTRAIPEDFATKLDVHSELSPSSSQDGLKTTHNVLIGGTGANGLGGALLYSGTRGGDWREHSDTRIDDLILKGRFQPSDEHTFSAMTQYYDGEADMPGGLGTAAYHDDPYQSTRPYDKFWGRRTLASASYEYTPNASQKLNVTGFFTKTLRSGYLDQGRNLTLSPREYWVRGLETRFSQGFELGESRHEVGIGHRYVNEASHELRYWTRADSGQLPSTGSRNDRDTRGSTEANAFYIDDRIDIGNWTITPGIRYEKIDSEQKNLLKNSKDSGRYNASLPALNVIYHLTPSWNLYANTEGSFGTVQYSQMGKAVRSGDIEPEKARTWELGSRYDDGILRAELGAFLINFDNQYESNQQTDSVTARGKTRHKGIEAAIAYDLADLDPLLSGFDVYASYAYVDASIREDGPNKGNQVPFSSKHKGTLGANYRTGAWSYNLDGSFQTSQYADNANTESESADGSTGRIAGWMVWSARGTYDFGPQLNDLKLGLGVKNLFDRRYYTRSFDDNNKGLYVGQPRTLYVQASVGF

SEQ ID NO: 16421 - protein, 853 aa, Xanthomonas oryzae
MFRALLPVPLVRTRPTLLAACLAFSLQAYAGPLHFQLPAQPLAASLSQIAQQAKIQLLFDEQLLRNAKAPALQGDYSPEEAIRTLLQDGRFNLVKVDNTYIVRPADTNLSSGSALQLGAMSVIGNGTEVDSSSVGRSTLNQAEIDRHQATNVVSLIDTLPGVSLGGSLKPGGQTINIWGLGDAEDVPMSVDGATKSGFERYQQGSVFIEPELIKRIEVEKGPHSPETGNGGFGGTVHMETKDAPDLLQEGRNAGAMVKYGYSSNSHEQAYTGAVYGRTDDHRFDALAYWTKRDGDDMKIASAQPDPRNAYPINPKRLPNTAQDMEGELFKLNMQLTDEHRLGFSYMRSNSDIWAPFSAKSYPTPPSQSDINKYGYDGATRRFLAQRNTIDTTWIAKYQYTPVDNPWIDFEAKYSDSTTDQTDERGPNAFFQPASGGRKITVGYDDKILALKNTSRFSTGPLEHALTNGIQIRKHTREVDMWMPGKTYEVPKYNYGHYQPGFMPHGKVDNNAFYIQDAITLGDFTLTPSLRYDHVRNRGEKNDAPFYNSPDPVAGHDYGDKTYTGWSPRLSAFWTVTPQFALFADYSKTWRAPVIDEQYEVQSAASTRSATSRDLDPERITALRAGNITSFSDVFTQADRVQVRTTLFHNTIKDEIMKNLGIGCPEQLTSGKSISQVCNQPTIGVYRNIGDLTIKGFEVESFYDSTYLFGSLSYSWITGKHEGAYTNPWGPNVWARDIPPRKWVASLGVKIPQWDAQVGWQGQWVRQTDRVPSDIYAGGPGSALGDSYWDQYKNDRYNVHGLFANWKPQQPYLKGTEVNFTLDNMFNRDYRPPLSGDNASSLGRNAKISVTRFF

SEQ ID NO: 16422 - protein, 707 aa, Xanthomonas oryzae
MDVLSYKGFIYMNTQVKFISAVISTILYSQASLAQAVPADSTETMIVVGYQQHYKIDQAHAAMRSDVSLLETPQMVTVIPSEVLEDQLAVTLGDALRNDASVSLGRVTSDRERFSLRGFSLEENTNILKDGHQHFAKYRMPMALIDNVEVLKGPSSLLYGQSAPGGIVNLVTKKPSNESSVKFAVKGDDHGSFRNSIDATGSLNDNKTIRYRAIIEQQNNNSWREYQDGSNLESESVVGSLVTEFDVTDALTIALHYDKLDDVSGQDSGALVDDNGNVIGGDSTIWDMPWTKIDAQSENYGVDVTYQVNSYWQVATGYNNQHNERERWESKPQTGKYDPLDGSYGNKPYNKLEDWQQQSFYFDLMGSVTTGSINHELLVGGNYLAHEYTSLKVKDKEKLDGNINDGTIIEQPVLDYADPKAESKSEDYKYYGVYVQDLVTLNDQWQVLAGVRYDRQDKTDANNNAVLPKFGVIYHPQDNASIYANYSESFEPLGRVLDDGPSGNNGMELDPVKGKMYELGTKWQVMDNKLAINAAIFDITRSNIKLTKDADDGDGDVTTQGGEQHHQGVELSAIGKVSSNLSLITSVMYLDAKYAKHNELEGNRPEDVPEWTASIWSKYVFTEQLSVNLGAYYEGERYGDEDNKFLKDSYIRIDTGINYQTSVAGNALQLRLNIDNLFDTDYLAGGENGEVNVGEPRTFKFGISYTL

SEQ ID NO: 16423 - protein, 163 aa, Xanthomonas oryzae
MTVADPDNAGYYIQSGQQRARGLEMDMVWEPSLAFSLLANYAHTDTRDDGTSPGDRVARGPDNSGRIAARYRILSGPAQGLGVGAGVTAVSPRELTLPNTIALPGYAVFDAQASYDVGRFTLGLSLVNLTGRKAWDPSSYMGYPVVAPNQPRSTYVTLKMDLK

SEQ ID NO: 16424 - protein, 601 aa, Xanthomonas oryzae
MTISKFASSTLPRHGMLLLSISGFCAPAANAQTSEQRTDAEATTLDTLKVQGQRQRRLESPEAVGSRLGLTQRETPASLQVIDHTDIATQGARTTSEVFDMVAGTMVGNVPGNPAVVTMRGFSGNTISVLHDGVRLGASTIVTRNLDTVGLERVEVLRGPASVLYGEGALGGATGANSDLLRWRVDLPLGNHWSLQNDLSWYQADRDFFYSDKWIYTPATGQLSRTAERIQHDQRFWNERLALSFDGRLGGHRNRFTAGMEHNDTKFHTPRQTGVTTPVSPLDPVLGVFPDGSAANFPGAGNNVIFDSRLRTLAVFAENALNLTARWSLLAGARVEKIQLSRDIRDVNTGNVASFRPDYRPFSWRVGTVFDLTPEVQLYGHYATAVSPVSTLLTMRPAAGVFDLSKGKSLEAGIKANAWGKRIEWTAAAYRIERDNILTRDPANPSISVQGGAQSSQGVELSAQAQLTRGLRLDLAAAYGTARYDRLLEAGGADRSGKRPPNVPDGSATLAASYRFLRVPLSLGASSRNVGGFSTDNANTIHVAGHTTFDAWLGYDWQRVSAVLRVRNLSDALYGTYSGYPSTHIYLGAPRSIELTLRTRF

SEQ ID NO: 16425 - protein, 251 aa, Xanthomonas oryzae
MIEMKKVIVVSALAMAGVFSAQALADRGKTGFYVTGKAGASVVTQTDQRFRQDFGDDVYKYKGGDKNDTVFGAGLAVGYDFYQHYNVPVRTEVEFYGRGAADSHYTLDTWHSPMGDGGREDTQNRLSVNTLMVNTYYDFRNSSAFTPWVSVGLGYARIHHKATYTDTSWNKSGEVSDISALHYSGYDNNFAWSIGAGVRYDITPDIALDLSYRYLDAGKSSLSYKDAEGDKYKSEADVKSHDIMFGVTYNF

SEQ ID NO: 16426 - protein, 378 aa, Xanthomonas oryzae
MIDGGRKSGDAYAGQLMVGTDVDMDRLFGWNGATVKLYVTNRHGTNLANSSIGNSTSVQEIYGGQGTRLANFTLLQKLFNDRLELEAGRSVANIHFLGSDLCQYFQGNSACGNPTFVFRTSNFTYWPVSSWAAHATAWVTPKVYLHVGAYEVNPIQAQDGQHGLNWSTNDTTGVVVPYAVGYKNKGGDGSMAAMYELGGWQDNSDYSDPLRDRNGNPAVLSGLAYENKQGRSGLFARFEQQVTNPDPSGTRGLTVFGAVLQSTGGQAIEDHFIQLGLVQKGTFASRPQDNIAFVITQQKYSDEAIENLRLARASAGGTGTPADNQIMMELSYGIQVTKRLRIAPNLHYVINPDQFNEPTRTTDLKNALIAGMRIDWNL

SEQ ID NO: 16427 - protein, 709 aa, Xanthomonas oryzae
MNMFTKSSIALAVASITLSSTAFAQQDTETQQSDSSNDVSERIEITGSPLDRATTATGLPLTLRQTPQSISIIDRSFIDGFALDTVADVMQFAPGIQAQQAETDRFFFRSRGRDVTNFQFDGVPIAYNSFFSEALADSVIFERVEIVRGATGLLTGAGEPSAAINLIRKRPKAEDGGYASLGIGSWSNYRFEADHSQTLSETGNVKARVAMAYEEGDSYVDLSEKENAQIYAVVTADLTTQTRLTAGADYSERNPKGSMWGALPLFYSDGTQADDLPVSTTTASPWNRWDRESTNAFVQVEHAFDNGWDVQFDVERREGKMDGYLLYFSGFPDKETGTGLGTSPNHYVADREQTSVRFLASGPFELFGREHQLTAGALHSKQTVDSVSYGTNDPIVVPSIFDWGNGVEPVDFNQTPNYSTFESYKQQGVYAAAQLSLTDELTTIIGNRLTTYETTVESPFSPSDFKHSGVNTPYFGIVYDISDIISTYASYTEIFKPQSAIDANFELVGPVEGSNSEIGIKGDFFNEALTASFAVYKVKEDNLAITDPDAAEPLPGTNIYPSIGVAGAESEGYELELNGKPNDALNIFVSYTHNESTDRDGSDYAPFLPENMVKTSVLFQASDALKVGVNANWQSDISNPGIGPNGETFTQDSYTVVNAMASYQLTPQWDLSLNVNNLFDETYYSSIDFYNQGFFGAERNFELSVKYAW

SEQ ID NO: 16428 - protein, 416 aa, Xanthomonas oryzae
MKLAPTLLGSALLLALAAPAAHAEIAIDVIGGSEISLEGLVQADGNWFHNDVQDLNGPIGANGDNSEFSIRRAELVLKGKGPGNFEWVAGYDPSVLKEVTIRGTTIRSTGRFLDNNIKYKFGGNANNYLQIGQFKQPNSLEELSSTKNNDFVSKASVTNTYGISRRLGVAYGMGDNNWSVTASAFGRELTRNQAHGNGYGARGTWAPINETGNVLHFGLSYLAYDTDDDTLRLRARPDADLTTVRLIDSGAITNVDNVGVAGAEAMWITGPFKLQSEYFQENANRIGANAHDYKSDGWYVSGVWNLTGETWGYKAGVPTTPLPNEPASGMWQLAVRYDTLDLNDGHLVANGNTPFVDGVLGGKMNIWTVGANWYWRSNFKFALDYAKVDSTRYNSTTRGLVDDNPSIIEARAQFYW

SEQ ID NO: 16429 - protein, 685 aa, Xanthomonas oryzae
MALRLSFLTLSIGTALLTLPFAQAQEAAFEIIEVHGAHQGSYTSVTPEAQAPVSDISGLLTQLPGTAVNGNGPLTGIAQYRGLFGDRVNTQVNGVSLAGAGPNAMDTPLSYASLINSERIEMHRGIAPVSAGTNTVGGSIKVIESQASFNDTQGRIAAQYQGNGGQSHLGAKVNVGGKNHALLVYGDLMHGDEDMKSGDDLRLSPTGYDKQIIGGQYRLNLSDKGLDDESIAIGYQHLETTEAGTPALPMDIDFIRTDRVKLEGEHRLDTWDLNWHLAFSDARHGMDNFSERQKPESANARYNNAESQSYDMALTLGRDAWLFGLDSQLSEHNSLITDPTKPMFRVDNFNKVQDDTYSAFAQWQQDIDQWHWQLGARVKHYRTDADEVSHSMAGAMPAIKVLMDRYNQADRTQAQTGLDLVINGRYRVNEELTWILGLARKQDSASYQQRYLWIPMQSTGGLADGRTYVGKMDLDLETAYQLELGADFNRQGLSISPRVFLHRIDDYIQGVKSTDPAVIMAANMMGSQDPMEFANVDAQLLGMDINASYEITDQWQLDLLASYVSGERRDIDDNLYRIAPPKVNLGLNFREGNWSARIEGVMVAAQDKVSESQSEQASAGYGLVNLVLAYDRQNWLVKAGVNNLFDIDYEDHLGGYNRVFNADLTPGQRMPGTGMNAWLTGEYRF

SEQ ID NO: 16430 - protein, 911 aa, Xanthomonas oryzae
MNRSLLATTIASCLILTACGGGGGGGNVRSDAPQTTVIAPTPTTPPPAADPLPAPAPAPTPAPPRYQGVGSNLLVPTNADLAQQAGARGQGVKLAVLDDNLVPSYAPISGKVDSFNDYTASPGTPESSANALRGHGTIVSALVLGSAQDGFAGGVAPDADLFYARICAENSCGTQQTRRAAVDLAAAGVRIANLSIGASYPDAAASANAALAWKYALTPLVQADALIVASTGNEGAAEASYPAATPVQEASVRNNWLAVGAINIDSAGNAAGLTSYSNHCGAAAQWCLVAPGSYTAPALAGTELQGQIAGTSFSTAAVSGVAAQVLGVYPWMSASNLQQTLLTTATDLGDPGVDALYGWGLVNAAKAIKGPGQFASNWAANVTAGYDSTFSNDISGAGSLTKSGAGKLTLSGTNTYSGGTTIQDGVLSLTGSLRSDLLVANSATFESRGGVVNGNYSLVNATGTTAIELGKGLAVTGQASLKGNLLLLPEAAGYTVGSTEKIVKAGVLQGTFDRVQYANNFFWTAALSYDPTTVTATLTRNASAASAQAAGAPQSVVNGANQADALVKVLDTRVASGDTDNLGGLISATGSLIAASDAQVAASLPTLTGQVHGIERTLGFQSALNDARVAADRLPYLADTTTLTTWMQGSYLDGDLGRSGFDSADYTQQATTFGVDLPMGNAGTIVGAAVTSGQDRAHIAASSSRLRSDRYAMTAYLYQPIGRAYLSATGSYGMSNVETERNVQAGSIGERLQDRRHDTNWSARAEIGLMPQAGLSPFVAAGVVSQTQDAFSEASVTGLGLSANSDTLRAGYGEVGVRGHLARGKWGFDGLVAYRSLLGNPNSDFSAWFTGLPEARFNVAGEPVSKQSLRASVGLRYQLNDAFSIYGNVGAERGRSDTNSINANVGLRWQF

SEQ ID NO: 16431 - protein, 992 aa, Xanthomonas oryzae
MRHHHPHSAGPARKLLRCALASCLLLGAAPAFAQSTAATIRGQVTIDAAPAAQAQVTATNLATGLTRSVQVSNGGYSVGGLPPGSYRIDVTANGQTSSQNFTVQVGQTATLNLGVGGEPATAAGGNATTLDAVQVKAPPVLVETRTSENVTYISNVQIQNLPRATRNFLELADTVPNVQFTREANGTTKVRTGATSAEGTNVYIDGVSQKNYVLTGGVSGQDSSRGNPFPQSAIGEYKVITSNYKAEFDQVSGAAIVASSKSGTNDFHGSFFWDTSNDSWREESPLEKKAGVRDDFEETQYGATFSGPILKDKAHFFIAYEAKEYTTPNVVIPGSIYSDRVDQLPVQLQPLVVTSSTPFKEDLYFGKIDWTIGQNNLFELTGKYRKEDELNDVGQTATYEHGSINGQEEKRANLRWQYSGANVLNEANLSYESAFWNQAPINNGNGYILSYPPVRGNETDILAAGAGSSFQRKGQKGWTFQDDLTLNSLEWHGAHTVKMGVKFKSIDLDSTQFNPVNPQYYYNILTDVETPYRVRFGAPLVEGGGSVVSKNKQYGIYLQDDWEVNEHWTLNLGVRYDYEQTPAFLDSVTPSDVASALQNWPNLRNANYTINDFISSGNNRQAFKNAWQPRLGASYDLFGDQAHVIYGGAGRAYDRNIFDYLALEQLNNSFKSYSYYVTSANNGACLGDPCTAWNPAYNNQEGLNTLTDNSTGGGGREVYLIDNNLKTPYSDQFSIGMRNMVPLWGQDWSTDVTLSRIESHDGFAFVRGNRLPDGAFFQPGTISGAPTDGPNGYSAIVLGTNGVETGNTQLALQVEKPFDEASGWGLTVAYTYSDAKENRQFGEHYALDRERIQDYGWREAGGIPNNRLVVTGIYELPYEITLSGKLSLASQTARYGQNCLAGNDQCEIIQFKPDGTLGDKEFSIAANKEWDTGGGVKFNVRADILNVFNWVNYATFNGDTGTLQDLNTAYGTPTGVLASPMRTFRLAFGLNW

SEQ ID NO: 16432 - protein, 364 aa, Xanthomonas oryzae
MGSYILPEFEYESDDPTAGNPYPGDHSSRSREAAFVPVGYAAWELRDDIRMGVGVTVPYGLETDYDRDWIGRYDAINTELLTIDINPTVAWRVNEQFAVAAGLSAQYADASLSSAIPGQGMDPSTDGKLDVEGDNWAYGFNLGALFEPVEGTRLGVAYRSRITHDLSGDAEYDPANFGPGTAEPQEVGGSAKLRLPETLSLGIHQAINDRWAVMADATWTRWSRFDELRVDFDEDITIGTTLMGPITSSGSVDDYSWDDTWFVALGATFRPNNEWALRVGVAHDESPVSNCCRTPRIPDEDRTWLAFGASYQPNDNVKLDFGYTYIWLDDADIVLNDDNPNVPDVEGEYESSVQILTASFNYRF

SEQ ID NO: 16433 - protein, 437 aa, Xanthomonas oryzae
MRDWAVRAARVLVLPMVAGAAGQAHAGGFGLREQSSYYQGTAFAGTAAGGDGLASMFWNPAAISFTPGLSVEGNVTYIAPHASLDVYSATAPITGASLGTTGASDIVGNGVLPTTYISYAWEKWAVGFAVTSPFGLVTDAPCNFSGRYYGCYNRIFDMNVQASVAYKVNEWLTIGGGLNVNYIDAKLTNAQFAGFTSPLNNLYAEVNGDDLGVGFNLGVLFTLAPGTTLGIGYKSSIDQNLSGNLNLSVANITTVNQVAASAGLTLPDQVTASFRSQLTPQWTVLGTVEWTNWSTVQQLVVTSRGIPVSTLDLKWNDGWFFSGGVEYQWDPKLALRAGIAYELTPVPDETRSPRLPDTNRLWLSGGFTYNFTPQFSFDFAYSHIFGENSPINLSASDPANALRGSLVGEVNDGYVDIVSVGLRYKFGAPVTAALITK

SEQ ID NO: 16434 - protein, 903 aa, Xanthomonas oryzae
MHSRTTTLALCITAALYCSGSAMAAGQEQQAPASTPSATTELDTITVTGYRASLEKSQSVKRAANSIVDAISAEDIGKFPDTNAAESLAHVPGISVDRQFGEGEKVSINGTDPALNRVLLNGQTIASGDWGGNPSDTSGRTFNYTLLSPEIIGLMEVYKTPEARIDEGSIGGTVIVHTRKPLDLPKNTIRGSVGYNYNDRSKEGNPRGSALWSWKNDDETFGALISATHDEQDLARAGIEYFGYTTGRNDKGEGIPATATITGDGSDVATARVPAGISSAFFQQTRERNGLQGALQWKPDENNEFNLTGIYIKGKYNNYSQARYVCPACNDDLKKVTRANVENGVVTSATVSDNTQGGVNDQPYAQMDTNYRESTVTTKSLNLRHDWSGEKWVFTTQIGDTEATGGKNPEYLMKYLMQDGGYNYAFDGRNTAVNYDNGGAANWALPGNPAGLAPGAETIPGTLPQVSPMQAGGLDYQKSKDQEKYFQWDAARDLSWGPFNKLQFGYKYINHDNGVDARGNRINTTDPVSLTQFNPGTTQSSLYDGLGASGDLTTWPTANLGAVRRYLLAQPQGPYNTDFGGSFDVKEITQNVYTQLNFESGQWRGNVGVRLLDTTDKSEYWQSADNGASYSRVAETHDYRKALPSFNVAYDVTDDAVLRFSVAKVMARPRYGDLAGSFTVNSGNGNLTASGGNPDLRPYESTNYDLAAEWYFAPSSMLSGEVFYRDISSYIVSTTVSEFRQADRRGNEQGIYQITTPTNASDAKVKGASINYQQTFGLGFGLQANYTYAKADASTGLNLPYLSRDTYNVIPYWEHGDWTVRVNYSYRSKYFTQLGRLASEDFADSYKQLDLTASYQITDYMGLTFGATNLLDSTYKLYSGTRDTPTAFYKNGRGYQAQLNFKF

SEQ ID NO: 16435 - protein, 800 aa, Xanthomonas oryzae
MKYSTMGVSMLALIATSGPSHAHDELPLHSTERIQKLETTSVTARRRLEKEQDVPATVSVVKGNQLEAGRIYQLQDLPQLMPSLTAQFLHPRQSSIAIRGIGNNPANEGLEGSAGIYLDNVFLGRPGLAVFDLLDIEQAELLRGPQGTLFGKNTTAGVLNITTRKPVFKPEYSAEASYGSRDFEQYKVMLNQPINEMAALRIAAYKTHDDGWVKNTYDGKNLNEINRTGARGQLLLQPSESFDLRLIAEHNEEDSSTGTLVPYRYGPWTPNAFMFLGIHPVTGQPVFGPDYSSNLPAGTPGSNATDAITHANGLGASNRAYDPKDYKVTLDGRQRTRTSQDALSAEANWHFNGYTLTSITAWRQWQFKPDNDLDRTDLFAVNGGVDARHKQYSQEIRLASPLSDVFDYVAGVYYYYQDVSNREQYMTGPDAFALTTIYPDNSAFSGSGYAKTHSYALFGQGTWHLSEKLDLTAGLRATMEKKEARVVQDQITPLPPILSPLLDHYDTGVQHQKDESLSSLLTASYWLNDRVLGYATYSSSEKSGGFNTNGVASPGAVLGTEALNIDPEKANNLEFGIKSSWLDQRLVANASVFLTRVKDYQAITGTSINGTYAGLLTNVGDLSSKGMELDLRARVSQHLSLSLSGAYTDASFDRGTAPTPAEEFNGPGGTSDSGYGKGTRSIAGNQVNGASRWAFSSGAHLRWNPADNLEHYANAQYSWRSESYGDVNNSEYSKIAGYGILNVSTGLRVTSGKHRWDFSLWAKNVLDKRYFLGLTNAGSNLYVGSAGQPRTIGASLRYDF

SEQ ID NO: 16436 - protein, 87 aa, Xanthomonas oryzae
MEVPSELYLIILKWRSPSMKKSLLALAAMSAFATAANAQSSVTLYGVVDLPIEYTNHLAPGLGAPNASGVPQSAPGGGSRVGLSGCA

SEQ ID NO: 16437 - protein, 793 aa, Xanthomonas oryzae
MRFSSSCYALSLAVAAVLLAPDGRTQTVTPASGNQDATTLDAVIVSGTARFKGLAKRDASFSITTASPEQIQQAVPQSTADLLKIVPGVWAEPSGGGTGANIFVRGMPSEGDAPFVTMQLDGSPLFPPPTLSFLENSTLLRVDDTVERMEVLRGGSSPIFSNGQPGLTVNFIQKKGQDAPEGSVRLTGGNTALRRIDVFNSGPMGNGWYYSVGGFFRDTDGVRDPQFSADKGGQFSATLSKRWDSGELSLYARHTDDNNAFYTAIPLLSRNNGNALSSFPGLNAQTGTLLGRDFRTVDLLVGPNGQTLRRDLADGRGVDIDVFGGEWNWERGGWTVADRFNVMNGSAPTYALFTGDAPQRLGDFIAGYGSSGSASYTNGGGAVDANQQVLEAGWWSVDKRLNSLTNDLRLSRELFAGNTLTVGAYDAKYSSADTWYLGNTLLLTAQNNARRIDVALDDGRQPTRQGFTSTAFFNLRAKYNGENIAAFVADEWELSERLRLDLGARYECQSVTGDVHDTATVDLDGNPATLYDNATSLALATTRRIDQDDEAFSWTAGVNFTLDRNNSLFVRVNSGVKFPGFDNLRDGQNRVQDVDQYELGVKSGTSAYDLYLTAFYNTFKNSPFQAFLANGQNFTAVGDSRARGLEVEGAIRPLGGFELAGTGVWLDAKYRNYREFTGNQVMRQPKRQFRITPSYYWMLPFGDLKVFATYSYIGERFADLANSQRLPSYDMLELGANLHVGEHWEVTASGSNVTDTLGLTEGNVRVPGAATDGVFMGRPIAGRQYQMSVAYRW

SEQ ID NO: 16438 - protein, 274 aa, Xanthomonas oryzae
MHTADKKLLFSSLLFSSLLFSSLLFSSAAQAAGEDHGRGPYVQADLAYAYEHITRDYPDAAGLEKGKKISTVSDYFRNIRTHSIHPRVSVGYDFGGWRIAADYARYRKWHNNKYSVNIKELERNENKNSGNHLNIKTQKTEHQENGTFHAVSSLGLSTIYDFDTGSRFKPYIGMRVAYGHVRHQVRSVQQETEIVTTYPKSGAPSSVPGAAVGKPAYHESRSISSLGFGAVAGVGIDVAPGLTLDAGYRYHYWGRLENTRFKTHEASLGVRYRF

SEQ ID NO: 16439 - protein, 477 aa, Xanthomonas oryzae
MHTSHHVKTHTRATALLLAALTAATGLTPLTAQTAAGSDDIAALREQIRLLDQKIRVLERNQELKDEAAEAKAKATPAGATVTLDGKGFNVASADKNFSFKIGALVQADYRAFLDDSAPNRDGFLLRRVRTPITGTAYKIFNFNITPEYATGDSNSTSNNNNTQLIDAWLDARISPYFGLKAGKFASPVVLEPGSNRHFNESPFPNNFAPNRDIGLEAFGSLAEGIVDYRLGIFNGVENNVTNRTGGLTDGDLTTAGRLTVTPFKKDDGILSKLAFSIGGSYGNERGTAGSNTSGLRSILSNGQQTVLNYGNSLFADGHHARVSPGIEWYTGTPFSVAAEFIWERQDISNGTTYNESIANTGWRVSAGYVLTGEAATKSGVSPKNAFNWENGTWGAFEVVARVSGADIDGKLFDGSGLSDTTNITGAFAYGAGLNWYLNNNIRALFNVEKTNFSGGHSGANTNDNELYFFTRLQVSF

SEQ ID NO: 16440 - protein, 713 aa, Xanthomonas oryzae
MSTFRFHALPIAIAAITLALPQPARAADTPTTDAVDATDGGTPIRALDAIQVQGTLLGRSKPDDVQGYAGSRQVIDREQLRNGGNRSLDDALQRVPGIKIFDETGNGALPQLMLRGLYESRSGRAQLLEDGIALALAPYGQTSLSLFPVGLHQIDRIDIVRGGAAVQYGPNNVGGVINLVSKEIPSAWNTTLAHKVTAGGQGQFLQDSALSGGGYLTENMGMQLDANRTYGEYWRAHSDTDISNLRVRAEWWLDDTTLLKARVQRYLVDMDLAGALSPDDYRRDPRQSTRPMDSFNGRTTRASLSYAQLLGDWGAMKDVRLDWTNFSARSSRNFIVGMRQASTETWRSDLPPQLRQTAPRDFRVVGSEPRLSWTMGDAGGMRQQWTAGARAVREDIDFLVGNLRLRDGLFTTVRDWQFEDHALAAYVSNAITLPDERVTITPGLRYERLDSRYFNRATGVSTFNRTRDVLPGLTLGFQANEQWFFYADGQRSMRAPQVTQIIFGNNLDAELAWNYEAGTRYQPNERTRIQLGGYLIDFDQQIQLDNTTRVFRNLGKTRHQGGELELQWSPEQLRALTLNASYAYLDASQESGAFRGFRVPYTSRDQITLGGSYALDHTTVALSGYHFSKAFSDAANTVQENAIASVGQLPAYMVWNTQVRHTLFEHDGEKFSASLAINNLFDRQYWFRGVDTSPWGRQAAPARTVTAELEYTF

SEQ ID NO: 16441 - protein, 788 aa, Xanthomonas oryzae
MSLSSTRFPGTLRRLALACAGLLAAQVAQADSPPLTLDLPSQSLEATVHALAHESGVAIAADSRLLSGRGAPALQGRYTVLQALRQVLAGSDLVAVEENGVIILRGGGEDGALTLGATTVNASGFNSDLPDTYSGGQVARGARIGLLGNRDIMDTPFSVSAYTAKTIENQQSGTVGAVLRNDPSIRFSTGEGHTYENFMIRGYALDSTELAMNGLYGLAPDGHVPTEFLERVEVLKGPGALLSGMAPNGGVGGVVNLVPKRAGDTPLTRLTTSYVSDGYVAEHIDVSRRFADNRFGIRFNGVYGSGDTGVDEQSKDRTLASLALDYRGDDFKLALDAYESHEKMDNGSPMMVGFSKLGSVTKAPKPDTNILEGINAKQVSKAVTLHGEYQFDDSWTAYASVGGARTRYDGFLNGTRVIVTKPDGTATGETYNQAGYTHSLSTEAGLRGNFMTGPVSHQLVLSTTLLHQDIGRAPTVTGKGYTTNIYHPGKAIIAGDHGSNVKTGDNTLSSFAVADTLGFVDDRVLLTLGARAQRVRQKMSTPSYDERKVTPAVGIVLKPWDAPVSLYANYIEGLTQGGMVTDVKAANYNEQFAPYVAKQMEAGVKWDLGDFTHTLALFQIEKPSMIYDKASNRYNDDGEQRNRGVEWTMFGEVTPDVRLLGGVTYTRAVLTKTANGAMDGNTARGVPAWSANLGAEWDLPWVDGLTLTALGIHSSSQYLDSANQLKIPQWTRYDLGARYATKVLSKDVTLRASLENVENRAYWAGVFNDGYATVSEPRTLKLSASVDF

SEQ ID NO: 16442 - protein, 1052 aa, Xanthomonas oryzae
MRRTLNSFKSKAMFTFVGGLLVINPAFAQDVAPPPAPAPQSSSDSATTLDAVNVTGIRNSLNQSMGIKRDAAGVVDAISAEDIGKFPDTNLAESLQRITGISIERRDGEGAQVTARGFGPQFNTVTLNGRLIPGADAFGAPGQTPIGGVDVGTRAFNFAQLASEVITGIEVFKTSRATAPSGGIGATINIQTDKPFNHDGVVANAGAKMVSDRSEPFGDSLTPEVSGIFSYTNPDKTFGIGLSASYQKRHGGSVQATENTWNIQRWTGTDPALRPDAVVTNAPAIGQLYGMPNDLRYAFADFQRERMNGQAVMQFAPTDSLTLTLDYTYSANEIREERGEQGIWLQRANSFTDLTFDTGQAVATPVYLRDVPNGAKDFGMEQQRNEQKYTLGSLGFNADWQVSDRFQLSFDAHNSKTQSLPNDPTTGGSATYFSFAGTNNCTNGPYCGGQWGQELWFNNSLPIGARTWYPTAADSLANTNGVVNPAFTPAELGSQVLRIFYQKQVTETKEGRLDGKFDFDDGRFQFGVSSTNTTMQRRVSETNSPLGDWGVANAGNEPGMVALLQPVSITGMFKDFNPSGAASSAWRGDADQLALWGGSQYGATTRYNPQYTADNRVEEKTRAAYVQLEIAGAIAGMTTNTRLGLRYERTDVESTSQVATPTALLWLSNNDFQLIRSTDQQPFSEKTSYNYVLPNMDFSIDFTDSLKGRASFGQTIARAPYNNLIAGPTPNTPNGSILINPSNRAGGDSQTPTLDPLESDNLDLALEWYFADASYVSATFWNKRVSNFIGNTVTRESLYGLTDPTSGPDAQAALAFLQSGACAAQVGAAGNDVAGACSANDTSLFAAMALLRNAAATGGLSAYNGSSAQSLALENAYDIAGNASDPLYQFDVSRPINQNKANIHGWELGGQYFFGSTGFGIYANYTIVEGDVAFDNTVIDRDQFALLGLSDTANVMLMYEKYGWSARLAWNWRDEYLIAANQDNANRNPYYVEPYQQFDLSVSYAFNKQLSVGFEAINLTGEDVRWHGRSEKQIIRLIDQQPRYTLGVRYAF

SEQ ID NO: 16443 - protein, 1060 aa, Xanthomonas oryzae
MNRSIQKRALALALVVAMGSVHAQSTTGSIVGSVGQGSGTSVLVENNSGFSREVPVDARGRYTAGNLPLGTYKVTVKRDGAVVETRENVAITVGANTDVSFAASAAAGSGVQTLDSVTVSAASLTTIDVSSVDTRTVVTAEQLQQLPLGRTAEAIALLAPGVVVNSGGFDNGPLGGSLPSFGGSAASENAYYLNGFNTTTISNNLGGLTLPYGAIDQQEIFTGGYGAQYGRANGGVINQIGKRGTNEWKFGAAVIWEPNGLKANQRDIYWRPDSQGSTINNAAYRYARAANGLYQPASEAEANQTTYSAYVGGPIIQDKLFFFLAAEQVNSDGVRVGTNRDTDNGRTGGLTDYDYTQKRWYAKVDWNITDNHLIEVTGASDVAETNGSIYRYDYVARQRGAYFTDESTWKTGPTLFTGKYTGYLSDNLTVTALYGKMRTPDELTPFNYDAAGGPVINSAALQNPAYTGGTPRIGNQLVTSVSSPDREYKKDNQRLNLEWRIGHHTLNFGLDNQKSEGIDVGSILSGPGFAWTYGQTNDPYGLATGGLVSQSANEAGGIGAPSPGLVDPVNGSSGYYVVRNINTSLYSYEAKQRAYYIEDKWQVTDNLLLSLGLRKDEFTNYTPFGDPYIEIDNAWAPRLGFSWDVNGDSSLKVFGNLGRYYLGLPLSAVSLFTPATTTDTYFTYSGINADGTPILAQQLGSAVSANSRFGRIADVRTAVAKDIEGENQDELILGFTKQLDSGWVLGVRGTHRRLNAGIDDQNYDVSNTALIDAAAAQGVTIDFSKVAGASLINPGQTNTWGVIGTDGQFHEISVSREAAGFPKFKRNYSAVEFNLERPFDGKWYAKVNYVWSHSYGTTEGQVRSDLWRTGGALGSYQGQASVSTTQSWDHPALMEHFNGDQSNDHRHQLKLFGFYQFTPQWGASANFSLISGAPHNCLGNYYGTEYSGRDPAGYGGSAITGGPYHYCYNPETGTGVASPPGSQGRLGWIAQLDMGVTYKPAFADGKLALRLDVFNITNEQTATNIYPFSQLPDNTTNPLWDQVVAYQAPRSGRVTLSYDF

SEQ ID NO: 16444 - protein, 494 aa, Xanthomonas oryzae
MRHAILPSMCAVAVAASCSPTLAQQAAPAAAASPAYLNTERGLRVKTLEGREISPSLMKGMRPEEQITKRTPGVPTRPSVLLQHEGGTSAPGLEWFAARPLKMMPYLDSSYVFGNTCAEPNAWIREDMISTGAQKLKTALSRYGITYSAQFGFNYTGLTGGGLNGKTDFPSYNGSLLTNITIFRNHSTGSGLYLASEFDFGNGFDFNEGSKGPKTTLGSLQNPTSSFQGPAPHLSNLSLAWVGAGGKLLLMAGQLDTTNYMDHNAYANSHNNNLTNSVFGNNPVLPLTDNSLGFHFAWQPTTSFYVMGATAANNMAQNHNPFRNLNSDNWTNVLEFGYVAEDFCSMGPGVYRLQPFFTTSNGENGGGVAVNFQQQLGRSSHLGWFFRGGWASDDAATLTGVRCAATTGLVLLSPFRGKGASNDGYLGLGFLWQQGAKKNGPYVNRNEYGIELTYVAQVTPTMTLQPDIQLVKNPVNGRRGQTAVVFQIQNVWSW

SEQ ID NO: 16445 - protein, 85 aa, Xanthomonas oryzae
MSPGWTLGAGVRYSGRQYGTLDNADVLPDVYGGTSRFLTVDLKAGYRIDRHVTLALGVDNLTDRRYFVYRPYPSRTFYGQLKWRL

SEQ ID NO: 16446 - protein, 927 aa, Xanthomonas oryzae
MRRHLRGSLALYPLFNGLSVRLTGRAVIRIRRHSLSHTRKALPVFILAIFPHPAEGACNLAPTPGNAVQVCDSGNNGPFTDVSTTRHTLVFPAGGTGTVIGTITYGAEADSIDMGSGRILGNVNQGAGSDTFILSSGEITGEISQGANPDDFVMRGGTLGSLAQGDGLDTFLMTGGTILRAFEDGDRAVMTGGSIGRVDMKLDNNVFELSGGSIINNLVAGFGRDTITVSGGSIGGAISVSGGDDRITVSGGEVRGEIRASFGNDSFEWLNGGYVRSSVLMADGNDIAQLYNLSEYLTSSNPLLDGGPGDDVLTFGNSVVSRPEHYTQWETVNLFNASQLNMAGALTLGDSVSTTGILNIDASSTLRSTSGSVVAFNTSSRATLDNAGTLDLTGNGSSVTDTLTVNGNYYGRAGRLLLQSTLGDETSPSDKLVVSQGTIGGTTSMRVSNVDGLGALTQGNGIEVVQATQGATSEVTAFSLQNSLSAGAYDYYLFKGGATAGSENSWFLRSTVIAPPLPETPPPSEPVPVPVPVPVPVPEPIPTPLPEPAPEPAPSPSTPPEPTEPTVPPAQPPPTDPIPSPAQLPATTLPVAAIGTPSLPEPIRGAAPVPLYRPEVANYAIVPPAAATLALTSLGTFHERQGDQSLLAQSGAAPAGWARVFGSDFKQQWSGTVSPGLDASLKGYQIGHDVYAWSLDGQQILRIGLFVAQNRLDGKVQGFAGGFHARHTGRIKLHGDSVGAYWTLSSPTASYVDALVMSTRLDGYSRSDRGLRIDTQGHALSLSVEAGHPFVLTPRWVAEPQVQIIHQRIDLDDQHDGISHVGFDSQPYNTGRLGIRFKGRYALAGMPIEPYLRANLWRNAGGHDTVTFDHTERIKTAHRSTTGSLGAGMVIKVASDTSVYWGADYNRDLNSHDSSGANASLGVRLAW

SEQ ID NO: 16447 - protein, 560 aa, Xanthomonas oryzae
MSAYSRIRFLLMFGTALSAGVPSWAMAASQDDEVAAMRREMRQMLGEIRQLQARVARDESGAKAARHGAPAGRVRVARAAPPPWTGPEPVIGTPPAVPDRTLLTFGSSSGPRSDAGSRLITPEGPPSSWSDFRAATARDETMHIGGMAIGFPEGRPTIASDDGAYAFSLGLTAQEDIGGFVGTAPKRGEGKGNFNPLTENARRIRLYFSWRYKDWVANVTPEFGNATADGSVSLFEANLNYTGLRHTILTVGYFQPRMEEESAERASSFEFMERPTIVDLVRNLAGGVARFSVGGEHAEKRWLAAAYFTGQKYGDRSKDTTITDSQTGAVARIAGRPYVSKDIDVHVGAGATSAFKVNQSSTGRNYTFSDNVEMPLGETSLLTSGALTNVAQIWAAGPQVGFRWRNFLLKSEYYHIGVERGRAAAGAAPLPSLGFDGWYVAANYTLFGKGRAYNAKTAAFTTPGVIYDFDPLHDQWGAMEVSGRWSVTDLGDVPDQGGKGINGNQQTVWEGGVNWYPTRHVKLMLDYDHFIVSRSKGVSGGVNLLGRSGNAVMGRVQASF

SEQ ID NO: 16448 - protein, 818 aa, Xanthomonas oryzae
MSTLHTLRLHALACAVTTCLCAPLALAQDATPPAPATPPAADSAAVNLDSVFVTGTSTATTKLKSSVSVSTVGAEAIEQSAPRSTAEIFRNIPGIRSESSGGEGNANIAVRGLPVASGGAKFLQLQEDGLPVMEFGDIAFGNADIFLRSDFTMDRIEAIRGGSASTFTSNAPGGIINFISKTGDTEGGSVGVSRGLDYDNTRIDFNYGAPFAEHWQFNIGGFFRQGDGVRDAGYTTDKGGQLKANLTRLFENGYVRVYGKYLNDRAAGYLPVPTSVRGRDGSPDLGGFPGFDPGNDTLYSRNFRTDVGLDGNNQPRRTDLGDGMHPISRTIGAEAWFDLGNGWNLSDKFRIADNSGRFVSPFPAEVTDAAALASSIGGAGAQLVEAGGANAGQAYTGTAIRTHLFNVAINDLGNVTNDLSLSREFGGDGRTLNLRMGYYTSRQTIDMDWTWNSYVQSLGRDSRLLNVVDASGVSRSQNGLYAYGTPFWGDCCITRSYDVRYDVNAPYVALTFDSGKLSIDGSLRYDMGDARGNYSGTAIAQNLDVNGDGVIQPVEQRVATVDTANARPVDYDWNYLSYSLGGNYLINDDLGAFARVSRGARANADRLLFGVIRDDGSVTSDEAVNVVRQTEAGLKWRRDGLSLFATAFAARTQEQNFEVTSQRFFNRSYKAHGIELEASYRYEGFTVNGGVTWTDAEIARDQITPENTGNVPRRQADFVWQLTPSYRGDGYQFGVNLIGTTEAYTQDSNQLKMPGYTQVNLFGDYRITDALTVALNVNNLFNTFGLTEAEEATIPANGIIRARSIAGRTTSLSLRYDF

SEQ ID NO: 16449 - protein, 820 aa, Xanthomonas oryzae
MAFTTPTSLVSFASLSCVSGASEGAGLAPTASARAVRLLACTLAAAAWTGMPSLAIAQSGVSAGVAAEAGNDEVRDYRIPSGSLDEVLNRFGRESGLLLSFTQDQVQGLSSPGLHERATAQQALNRLLAGTGLVAQRSPQGALLLRKMGQPVSDGAAALSEVTVTSKYDAAMSGYAANDRPMATKLGSTLMETPRSVSIVSQEQIKNQAPKSIEQALSYTAGVTTEVTGADLRMTGAIIRGFSDGSSYYKDGLRQFSAGTYGSWNDEIDELESIEVIKGPASVLFGQGRPGGVINVVSKKPEADHVNSVGISYGRYQRAQLTADLGGALSESGDVLYRLNLKGRDSNSRTVGSRDDRISIAPSLRWNLSAQTHLTLLGSYSRERGTPKSWWPSLFTYPQIKNLSSRLTAGDPAFDRFDRNTKSIGYEFGHLMDSGWQLSQNLRYSTIDIDYRHIYAMDVLADGHSISRANLAQRTKGKTLAMDSRVQKDLRWGELQHRLAFGLDHTRYRERGGLGFGWDVPDLDLNAPLYGQSIAMPELEDSHSNLRQTGIYTLNQLQYGRWIANLSLRHDTARTTQNSITQPRISDSDTTGSAGLLYQFESGWAPYASYATSFDPTTGLAYDGSAFVPRRGKQYEVGVKYQPAGSSTLITASVFDLRQSNVITQDPAHPRFSIQTGEVRSTGLELEARIGLTRELSSLLSYTWLDPRTTQSTRAAEVGRQTLQTTRHAASIWLDYRPRAFPGLMLAGGVRYKGRSPYNVASDGRLNFNDAVTVADLAVAYDTPRYRIALNINNLFNKTYFAGIFRGVDREANLSVKYYW

SEQ ID NO: 16450 - protein, 707 aa, Xanthomonas oryzae
MTPRLLSAAITVALLAAPVGAAFAADADSERTTDLDTVNVIAKLEAARNALSPDIGSSQFAITADDIDRLPLGAATPLNQVLLQAPGVVQDSYGSIHVRGDHANLQYRVNGVMIPESISGFGQSLEPRIIKNLKLLDGALPAQFGDRTAAVVDITTKSGAELGNGGSVGITAGSFGTINPNASLWGSSGRWSWFVSGDYDQNKNGLENPVDSLNPIHDKSHQGKGFADLTYLVNENTRLSLLVGYANNRFQIPNNPGQTPAFDYLGTTDFDSARLDEKQRENTRFGTLALQGTIGDTNYQISAGQRYSSVAFSPDVAGDLIFNGTASQVDRSNRANTVQADFATPWGGSHTLRYGLYGNFEHAIASNNSYVFPANDDGSQSSNVPLFIPDGSRFHASTYALYLQDEWKIGNDWTINYGLRGDKYKAFGNTEGQLSPRLGVIWRASDSTTVHAGYARYFTPPASELISTSDIALYDGTTNQQSAGNGQTTPLSERSDYYDLGISQVVTDHLTLGLDIYDRKVDRLQDEGQFGAAYVYSTFNYRYGRIRGAEFSADYTNGPVTAYFNIAYSKAMGKRVITSLYNFDPDALAYTYDNWIHLDHDQKLTSSGGINYAFSEGSKVGLNYLFGSGLRTDTDTVPNGASLPSYFQLNASVGHDFDVNTHPLHVQLAAVNILNRSYQLRDGGGIGVFAPQWAPRRGVYVSLQQDF

SEQ ID NO: 16451 - protein, 947 aa, Xanthomonas oryzae
MNLRTSAVRLGLLPAGIAIALTPAFAAAQESTTTLDRIEITGSRIRSADVETQQPILTLDRQALEKQGLTSVADVLQNLTSAGSPAISRADALSSGEDVGGYYVDLRNLGAQRTLVLVNGKRLGASTSGLQDLSQIPMSAIERIEVLKDGASSIYGSDAIAGVVNVITRKRFDGAEASVQFGQFGQGDGDTTQYSFTVGSQGERGGVTLSAEYSKQDPVFAKNRWFSRDGSRGPNSTPNSWSPISQNGSWCNPLQVDCDDPDTAVWQTLNAGGNPNNPADYHPITPAEYANSNQQMMVQTGIERKSVFANVNYDVADAITFNADIAYNERTTDGQIAGYPYQSGSFGTPLEGSSAFNPIGQDVDFRRRLWEVPRASENQLKTLRFAPTLSGYFDIGGKTWDWDVGALWNRNENTKRSRGDMSLIASRQALGPSFINGQGVAQCGTAADPISLSACRPWNPLLPYNVAGQGSLADPALQEFLFPTFTDTGLTKTTSFTANLSGSVVELPAGDLGVAVGYEHRKEEGRFSPDAFAQSGESTGLGAKTTQGQYSLDEVYLELNVPLLSDVAFAKELTFNAATRYSDYSNFGNTLNSKFGLTWRPLEDLLVRATYAEGFRAPTISDLYGGLSSSFEDYIDPCGVGAPNSVNGNAACTNAGVPLGYTQLGQGFVPCTTYPCQTPDEFISGANPNLKPETSTSKTAGLVWSPRWVQGLDISLDWYRYEINDMIIADSVDRILRDCYVLGDAERCANVTRAADGHISAMSYGVANLGQMETEGYDLGVKYRLPETAIGSFTFDWQTSYVSKYDEAGQDSAGNAIMIGRVGEPGIFRVRSNVGVNWSLGDFGVNYTLRYYSGMKESCITLAEGYCDAPDHIANGESDPLRHTGANTFHDLQVNWKAPWDATIALGANNVFDHRGPLQYSAPNSSFAYYGGFEIGRFMYMKYTQRF

SEQ ID NO: 16452 - protein, 897 aa, Xanthomonas oryzae
MQVTGVRRANAAAVESKRAATNITDVISATDVRALPDSTIVEALRRVPGLSVLPATDNEHPRDEAATPVLRGLGPSYNNVTIDGLTIASPGTPNGTLGSITRGVRLDLLPASMVSELQVVKTFTPDLDPNATGGAINLKTRSAFENGGKPFFSADAALGHANDVGKPRDQEDPGYRVNATGSRTFGSEQQYGVTVSANYQTLSSYTETHMTTDTVHYGFYDNNGVLQSGANLGNGWAVPQQDKYWYVQDQRDRYGVTGKFEMRPSAALEAYAMAGYYYFKDDMERNEVIIDPRNRGKVFNQTATSGSYPGGDIEVGYSNQIVTTRTKVAQLGTIWRPTDRQQFSARGAWSDATYDEPIRMIKYATGITRPAPVPVGQTGSGVTIHATPNYAFNYDTSGFDQRFGVSPQAYNNLDNYSLLYWRPDYKRTAADRILTGRLDYGFNQGESDQGIGFAAGVSYTTDKPSYDIYRVEYQPNSTAPAFGLADVAGTGRPPMRYVGLNLLSIDPNKANRVLAATPLSAFNSTDQQAFSNQDNFTHTEKTFGSYGLISYRSDRLNVQAGVHFDSTTLDTVGRERQLDRASNRYVYVDNPTTADYNYLLPSAVMTYHLTDALDLRAGASRTLGRPPYDAYAARTSIGFVNTTDAGNPNAQGVTVTIGNPDIKPRVSNNLDLSLEWRLPGDFDAFASAAVFDKHIQDEIFTLSRADSFTFDGTTYANALISTPANAAKARIRGVEFNGIVNTLGPIAPWLSGVGFSANVALLDGSLDVPYSVGSGSSVSQSERKLDNLVGQPDYTANATLFYNTGGLELRAAYNRQGKALRSIVSNTDWQDLYWSPRSQLDFTATYAVSKQLSVISQVSNITHSRITSVTGPGQNLLKDSYSVPTTYWVGLRFTPTL

SEQ ID NO: 16453 - protein, 720 aa, Xanthomonas oryzae
MSATFPLLSHCPLALVLAFCCAPALAQQQPDADAVELDAVNVRGERVETSTALSGFGATRLLDAPASIALIDRQQLLDRQARVLSEVLRADASAGDAYAPIGYYENFVVRGYSLNAANSYRINGMSAVGEQSIALENKQQVQLLKGLAGLQSGVNEPAGLIDYRTKRPEQVRSVTLGTDEQGSRYLAADLGDWFGAERTLGVRINAAREDIDSDVDHADGYRNFLSLAGDWKITPQALLQLDVEYQHRQQRSVPGYQLLGGTQVPRDIDVHRLLGYQPWARPVEMDSLNAQLRYAYQFNDDWRATADASRSRSTINDFSAFAWGCYGAASCADIATPNFFSAQGEYDVYDYRSPDDTRVHDQLRATLEGRVATGALEHRLSVGGEWLRRTIDRFGSVNALIGSGSIDRDPEVFAQTDVPLAPKQRRLDSRQRALVLADRIGLGAQWELSLGARYVQLDERSFDHDGLLERRTRKHTVLPQAALLFKPQQNLSLYASYAKSLAAGGTAPWFADNADEILPPTNAYQLETGAKIDLQGLRLGAALFDIRQAYQFTQPQADGGLLYVQQGRLHNRGLELSADGAATRQLRLFASIAAIRARAEDTDIAEYEGHQAINVPKLRASVQADYSVPGVDGLALLAGVQYSGRKFADRLGNASVPAYAVANLGARYATALGGLATTWRLNVDNVFDKRYWRDSGEYQGDAYLFPGAPRTARLTVQVDF

SEQ ID NO: 16454 - protein, 1004 aa, Xanthomonas oryzae
MRETRTLPRTRRLTSALLFALSTPLAAQTAPAPQSASTVPGSSQADPATLDTVQVSGIRGSLTSSMNVKRDAQGIVDGIVAEDIGKFPDTNLAESLQRISGVSIDRSLGEGSRVTVRGVGPDFNLVLLNGRQMPGASIEESNASNSRAFDFANLASESISGIEVFKTSRASTPTGGIGATINIKTARPLDNPGMHANVGLKGVHDSSNENLPGRLQGDSLTPEISGIFSNTSADGRFGVSLSGSYQERDFGYSQVGVPNGWRAFRGDSTAYGTIPQPGAPGSENIVNRPGPNDIYSVPQNLNYRVVGVERQRTNGQLVLQYKPLDNITTTLDYTYSENKIQQQRNEMSVWFNYGPSASSWTKGPVAGPITYSEIVNPPTSDLATAGSNAATRNQNKSLGFNVDWAVNDQFKLNFDIHRSTAEAGADSPYGSSNSLGVSGFYRGTSVVDFSKDFPVLQQQLGFGLNGLDPSRTLVTGSAFRNSYMKSEIDQAQVNGDFTFENYSQLKFGIGSTEVKNRSAFSNVQRDTWGGNGTAADYPDDLWIPSSFAQYFDAIDGSGNPAQFNQLFLFDFERARQAAAQAAGDESLYRISPVFTTDRRVTEKSKNAYLQWGNSWDDLRVPISLAAGVRYEETKVEARALVPVAVGIDWVANNELPIRLADSAFSGGSGKYEYWLPSLDLSFKLREDLVLRGSYGETIGRPGWGDIQGGQTLNQIGRIEGGSGQEGNPGLKPLLSHNIDLSLEWYYGEASYASVGFFRKNIDNYVGVTTRNDTSLGLHTPVGGAYWNQALANGCATADLTCIRNYIFRNFAGQPGVVRGTDDTNGNATGTISGQPGDPVANFSITAPANQRSASLDGWEFNVQHMFGQSGFGVSANYTKVDSGLTYNNYVIGEQFALEGLSDSANLVGFYDKGQWQVRAAYNWRDEFLAARFDGSGLPNPVYTEAYGQLDLSIGYQWTENLSLSLEAINLTNEIQRQHGRQKNEIIYATQTGPRYMLGLRYKFW

SEQ ID NO: 16455 - protein, 1012 aa, Xanthomonas oryzae
MKNHRTVSALPARSLLCCALAASLLAANPAMAQSSNATLRGQVAASQAGTTVTATNVATGTTRRVATGPDGSYALVGLPPGTYKVDAGPGTEKTVTLSVASSVSLNLGGGGEAATPADGTATTLDTVKVTATSLQEVKTSEVGTNVSLKQINTVPQLTRNFLEFADTVPGMQFETDPNGNSRIRGGAQASSAVNVYIDGVGQKSYLFGGVSGQEQSAGNPFPQLAIGEYKVITSNYKAEFDQVGSAAIVASTKSGGNEFHGEIFGRTTNTDFRARQADERASAPNADGTKRQTHQDEYGMAFSGPIVKDKAHFFVSYEGKGFEVSANPVSVPDTFSALSDDLPAGVQSRLGSVTRPFKEDLYFGKIDWDVGENDRLELTAKYRDEKSRDDVGDRNTAIAGKNNLNTEERYDLRWQHFGQTYVNEARISYEDVLFNPNAFTLGNQNIYTRGVAEDDVLIRDNATSGLAIQRKGQKGPSFQNDLTLNSIDWHGSHVVKMGVKYKEVELTQSENSTVNPSFYYAVADGLGTSAIPYQVKFNLPFAGAAPSVTTKSKQLGLYIQDDWDVNDKLQLNLGVRWDGEKIPSYLDNVTPPEVVAALNGPGTDPTVSATYAEQLAKGGVNINDYISNGRSRKQDTNNFAPRLGFSYDFRGDESLVVFGGAGRSYDRNLFDVLGLEQVKSALAQYTLRFAEAAPGCTPAPGTCVNWNPAYLSDPGSLGSLVNSGVRNGEIDLLNNDLKTPYSDQYSLGLRTRLGEWNTSATVSYIHSKEGLIFTLGNRYPNGDFFQAGTQPWNENPPGFGSLLIGNNGVETKTGQLLLSADKPYSQESGWGLTAAYTFSRARGNRGNDDRYGFDAATIANYPFLDLNAVPRHRLVLTGIYDLFWGISASAKLTLATVTPRNEAVSFDQYGGQPSENIRIVSVDAPGGKFIAGGDIFGTRQLDLSLSKDMHVTEALTVQVRGDLINALNFRNYDQYAIDWGQGGIYAPRASINQYGALSTPPRTMFLSARIIW

SEQ ID NO: 16456 - protein, 1011 aa, Xanthomonas oryzae
MKNHRTVSTLPARSLLCCALATSLFATTPAMAQSSNATLRGQVASAQNGSEVVVTNVATGSVRRAPVNANGNYTIVGLQPGTYKVESNGISRTVTLSVASSATVDLGTETAAAPAGDATTLDTVTVSAPMIRDVKTSEVGNTISARQIQQLPQATRNFLEFADTVPGMVFQVDGNGNTKLRGGASNASAGNLYIDGVGQKSYVRSGGVAGQSDTQGNPFPQLAIGEYKVITSNYKAEYGQISGAAITAATKSGTNEFHGEAFYRYTDQDLRDKRPDEEANGKIDSQTKEYGFALGGPIIQDRMHFFVAYEGKENVAPKSVQPSSEAAAFVSQLPANLASQYGPANMPFEEDLLFGKIDFEPTDRDRIELSTIYRDETQTANVGGTNTLAQATDKINKDKRTNLRWQHSADNWFNEVIVGTENSENNPTPRTLGNGIVYTYFQPRSGSTDIDERTFLTTGSAGGKNAQRKSQKGWFIQNDLTFTSFQWHGEHTIKMGVNYKDIELTSQDAAALNPQFSYRVSNGSIDATPYRVDFIAPYTTPGQRATVVSPSKQYGIYLQDDWAATDKLMVNIGVRWDYEDTPAYTNFVTSQAFVDALYANDAENPGQPWANRLLPSGINVADYISTGNNRKNFKDAWAPRFGFSYDIFGDEAAIVHGGAARSYDRNLFEQLALETSKAALSPVAVYFENPATGTCYRADRTCVAFDPRYLNGIDQLNTIPGVAGSAELFMFNNKLKTPYSDQYSIGITNQVGDWLTDVTFQRILSYDGFAMGLINRYPDGSYFQNGNVPWGEPVPGYQNTILGSNGLEQRNSQVLLSADKPYTKESGWGLTLSYTHTSARQNRNIDEPYVFDKATIRGYPFVKSDAVAAHRFVASGSIDGPWGVTFGAKLVLATPEPINTIACFGFTDPDGATCQQVGVTPPGSGKFLVGGDIWGYRTVDFQATKEFTVAGDFKLNARVNLLNAFNFKNYSAYAYNGFGSNGQFAPDIAINTSGEINYVPRSVVLEIGAKF

SEQ ID NO: 16457 - protein, 708 aa, Xanthomonas oryzae
MRLLFLILILTSLQATAQVEQKKDSLNPERLEEVVVTGQINPQSVSKSVVEVKVISRKDIERQAGNTLADVLNTTLNLNITPNTSTGKSGVSLFGLDSQYFKVLIDNIPVINEEGVGNNTDLTLINLDDIERIEIVEGAMGVQYGANAVSGIINIITKKSSRNDWEFTVYSQEETIGDEYEWFDKGRHIQSLKVGHNLTEEMYANVVYTRNDFAGFFNDKQGENYVINDGLRGHEWLPKLQQNAKGLVSYTKQNLNLFYRFDYLNETIDRFSENVDLNENAATGTINPTALDEIYTNNRFYHHLNGSGTLFNKIGYNVSVSYQKQTKDLERYTYRIQSQEKENIEAGEYQSRSALFSRGTFSNIINTSKANLQLGYELTAEKGSGSSVAIVINPGSDAVTQELNNYDFFAASELQLTKRFSLRPGVRASFSNLFETQYIGSLSAKQTLGEDWELRAILGSANRTPNYNELYTYFVDVNHNVQGNGNLNPEKGVSAFLHLKKKSTLGDGAIRLKNKLSFNYLNLTDRIELIIVNQSPLEYQYNNIDRFKALGVFSENEVFYKNFKGQIGASLQGISKVLDSRTQANEDYLFNLQLNSNVSYTLPEWKTTFSLFFKYLGKQQQFVEKTNDQGEQEFVAGETDPYSWMDATVNKSFFDGAFTTTLGCRNLFDVTQVDTTAFEGGAHDGDPAQISLGYGRSYFLKLTYNLSI

SEQ ID NO: 16458 - protein, 185 aa, Wolbachia endosymbiont
SYYVRLQYNGEILPLFTKVDGITNVTGKEKDSPLKASFIAGGGAFGYKMDDIRVDVEGLYSQLSKDATIINTSEKNVADSLTAFSGLVNVYYDIAIEDMPITPYIGVGVGAAYVSNPLATKVTDDKASGFGVAYQAKAGVSYDVTPEVKLYAGARYFGSYGANFGKTAKDDAGIKVLYSTVGAEA

SEQ ID NO: 16459 - protein, 188 aa, Wolbachia endosymbiont
SYYIRLQYNGEILPLFTKIEGIEYKKGTDSHNPLKASFIAGGGAFGYKMDDIRVDVEGVYSQLSKNNVDGAALTPADAIADSLTAISGLVNVYYDIAIEDMHITPYIGGGVGAAYISTPLKTAVNGQNSKFGFAGQVKAGVSYDVTPEVKLYAGARYFGSYGANFDKSGGEKDKGGHTVLYSTVGAEA

SEQ ID NO: 16460 - protein, 190 aa, Wolbachia endosymbiont
SYYVRLQYNGEFLPLFTKVDGITYKKDKSDYSPLKPSFIAGGGAFGYKMDDIRVDVEGVYSYLNKNDVKDVTFDPANTIADSLTAFSGLVNVYYDIAIEDMPITPYIGVGVGAAYISTPLKTPINDQKSKFGFAGQVKAGVSYDVTPEIKLYAGARYFGSFGAHFDKDASTGKDKGELKVLYSTVGAEAG

SEQ ID NO: 16461 - protein, 185 aa, Wolbachia endosymbiont
SYYVRLQYNGEILPFYTKVDGITNAKDKEKDSPLTRSFIAGGGAFGYKMDDIRVDVEGLYSQLAKDTAVVNTSETNVADSLTVFSGLVNVYYDIAIEDMPITPYVGVGVGAAYISNPSKADAVKDQKGFGFAYQAKAGVSYDVTPEIKLFAGARYFGSYGANFDKAAKDDTGIKNVVYNIVGAEA

SEQ ID NO: 16462 - protein, 342 aa, Neisseria meningitidis
  misc_feature (225)..(225): Xaa can be any naturally occurring amino acid
EIYNKDGNKLDLSGKVDGLHYFSNDDSADGDQSYMRLGFRGETQINNELTGYGEWEYQASLNTAESEDANNFTRVGFAGLKFGQWGSLDYGRNYGVMYDLAAWTDVLPEFGGDTYGADNFMFQRANGVLTYRNKDFFGLVDGLDVAVQYQGKNGSATESTMGRDVLRQNGDGYGMSLTYDLGEGFSAAGAMMASTRTSEQNGRQNPAIIGNGDRAETYTGGLKYXANNIYLAAVFTQTYNARIGVSSDSSHLGYADNAQNFEAVAQYQFDFGLRPSIAYVQSHARNVPGYSNQNLTKYVDVGASYFFNKNMLTYVDYKINLMDDTRLTRDAGINTDDIVAVG

SEQ ID NO: 16463 - protein, 318 aa, Neisseria meningitidis
ATADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTDDNVNAWESGKFTGNVLEISGMAKREHRYLSVRYDSPEFAGFSGSVQYAPKDNSGSNGESYHVGLNYQNSGFFAQYAGLFQRYGEGTKKIEYEHQVYSIPSLFVEKLQVHRLVGGYDNNALYVSVAAQQQDAKLYGARRANSHNSQTEVAATAAYRFGNVTPRVSYAHGFKGTVDSADHDNTYDQVVVGAEYDFSKRTSALVSAGWLQEGKGADK

SEQ ID NO: 16464 - protein, 143 aa, Neisseria meningitidis
GNEDLEIIPFSVRVGLDINDFAGIHGDSSLQLGIEPFVNTIIAPDRGIEAGINIGLRYMTPMADGVSIFGEISSGPAYFGIDTVEQGDAGFNFLSQFGAGLQVELSRNMAFNTAYRFRHLSNAGFTQPNDGINTNAIIAGLSF

SEQ ID NO: 16465 - protein, 161 aa, Neisseria meningitidis
TRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSKADEVKDQKGFGFAYQAKAGVSYDVTPEIKLFAGARYFGSYGASFDKANKDDTGIKNV

SEQ ID NO: 16466 - protein, 136 aa, Neisseria meningitidis
GSGNVVSEVLFAKPVVPADPFWSQFVPRPTVGGSYNTAGRTSYAYLGATWTFDITDRIFVEGFFGASFHNGATGRFVPPNFNALGCSPLFREAASLGFRLTEHWSVLATIEHQSNAGLCVANRGLTNVGGKVAYTF

SEQ ID NO: 16467 - protein, 175 aa, Neisseria meningitidis
PFKTRIDGIEYKKGTEVHDPLKASFMAGGAAFGYKMDDIRVDVEGLYSQLNKNDVSGAIFTPTTVANSVAAFSGLVNVYYDIAIEDMPITPYVGVGVGAAYISNPLEASAVKDQKGFGFAYQAKAGVSYDVTPEIKLYAGARYFGSYGASFNKETVSATKEINVLYSAVGAEAGV

SEQ ID NO: 16468 - protein, 108 aa, Neisseria meningitidis
  misc_feature (11)..(11): Xaa can be any naturally occurring amino acid
  misc_feature (42)..(43): Xaa can be any naturally occurring amino acid
  misc_feature (47)..(47): Xaa can be any naturally occurring amino acid
  misc_feature (59)..(59): Xaa can be any naturally occurring amino acid
  misc_feature (66)..(66): Xaa can be any naturally occurring amino acid
  misc_feature (99)..(99): Xaa can be any naturally occurring amino acid
  misc_feature (101)..(101): Xaa can be any naturally occurring amino acid
  misc_feature (106)..(106): Xaa can be any naturally occurring amino acid
ANSLTAISGLXNVYYDIAIEDMPITPYIGVGVGAAYISTPLXXAVSXQNGKFAFAGQAXAGVSYDXTPEIKLYAGARYFGSYGANFDKTNNDGKGELKXLXSAVGXEA

SEQ ID NO: 16469 - protein, 199 aa, Neisseria meningitidis
GPVSDEETSYYVRLQYNGEVLPFYTKVDGITNATGKEKDSPLTRSFIAGGGAFGYKMDDIRVDVEGLYSQLAKDTAVVSASETNVADSLTAFSGLVNVYYDIAIEDMPITPYVGVGLGVAYISNPSKASEVKDQKGFGFAYQAKAGVSYDVTPEIKLFAGARYFGSYGASFDKAAKDVTGIKNVVYSTVGAEVGVAFNF

SEQ ID NO: 16470 - protein, 174 aa, Neisseria meningitidis
PHFRKFSAEETPIYGTESPTKKVFGLKKDGSITKSGDFTRTDVSFEGQNNFISGFSGSIGYIMDGPRVEIEAAYQKFNPKNPNNETDTSDYYKYDALSRAEVMTDKKYVVLKNDGIAFSSLMFNACYDITAEGVPFIPYACAGIGADLISIFDDINLKFAYQGKIGISYPITPE

SEQ ID NO: 16471 - protein, 128 aa, Neisseria meningitidis
AAPSEQGIDFNGELIFTPEWEVLGGIARPNLGMSINSAGDTSYIYSGGLLEWDGGSGWFFDAGVGLSMNDRKGKDLGSNLLLRLALEVGHDIYQCHRVSLIMDHISNANTADPNPGIDNIGLRYGYLF

SEQ ID NO: 16472 - protein, 152 aa, Neisseria meningitidis
GEILPLYTKVNGIANATGKEKDSPLTRSFIGGGGAFGYKMDDIRVDVEGLYSQLAKDTAVVNASETNVADSLTEFSGLVNVYYDIAIEDMPITPYVGVGVGAAYISNPSKADAVKDQRGFGFAYQAKAGVSYDVTPEIKLFAGARYFGSYGA

SEQ ID NO: 16473 - protein, 140 aa, Neisseria meningitidis
GSDNARAHRLALVYPIPMQDNLLTRHNLGINLELAYHYWQDYTPRDNHGVSLIPVLSYQYPLESLSLYFEGGIGITYIDSEHYLDRSLGSHWQFEDKLGAGVILQKHHKLGIAFNHYSNANLASENDGFNVVGLSYGYFW

SEQ ID NO: 16474 - protein, 164 aa, Neisseria meningitidis
ARGVNKVILVGNVGGDPETRYMPNGNAVTNITLATSESWKDKQTGQQQERTEWHRVVFFGRLAEIAGEYLRKGSQVYVEGSLRTRKWQGQDGQDRYTTEIVVDINGNMQLLGGRPSGDDSQRAPREPMQRPQQAPQQQSRPAPQQQPAPQPAQDYDSFDDDIPF

SEQ ID NO: 16475 - protein, 269 aa, Neisseria meningitidis
GERGFGRRAEGCWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKGENTSYDQIRP

SEQ ID NO: 16476 - protein, 64 aa, Neisseria meningitidis
RISKTMLKWGEMQPTAPVFAAGGSRLFPQTATGFQLQSSEFEGLDLEAGHFTEGKEPTTVKSRG

SEQ ID NO: 16477 - protein, 257 aa, Neisseria meningitidis
FVASTATQAAEVYNKNANKLDVYGKIKAMHYFSDYDSKDGDQTYVRFGIKGETQINDDLTGYGRWESEFSGNKTESDSSQKTRLAFAGVKLKNYGSFDYGRNLGALYDVEAWTDMFPEFGGDSSAQTDNFMTKRASGLATYRNTDFFGLVDGLDMTLQYQGKNEGREAKKQNGDGVGTSLSYDFGGSDFAVSAAYTSSDRTNDQNLLARGQGSKAEAWATGLKYDANNIYLATMYSETRKMTPISGGLPTKRRTLKR

SEQ ID NO: 16478 - protein, 280 aa, Neisseria meningitidis
FFFFFFFPVLKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPATYTVDSSGVVTAVVGKPGSDVYYAGLNYKNGGFAGNYAFKYAKHANVGRDAFNLFLLGRIGEDDEAKGTDPLKNHQVHRLTGGYEEGGLNLALAAQLDLSENGDKTKNSTTEIAATASYRFGNAVPRISYAHGFDFIERGKKGEHTSYDQYAS

SEQ ID NO: 16479 - protein, 287 aa, Neisseria meningitidis
GAIKAGVQTYRSVEHTKGKVSKVETGSEIADFGSKIGFKGQEDLGNGLKAVWQLEQGASVAGTNTGWGNKQSFVGLKGGFGTIRVGSLNSPLKNTGANVNAWESGKFTGNVLEISGMAKREHRYLSVRYDSPEFAGFSGSVQYAPKDNSGSNGESYHVGLNYRNGGFFAQYAGLFQRYGEGTKKIEYGNQFYSVPSLLVEKLQVHRLVGGYDNNALYASVAAQQQDAKLYGTWRANSHNSQTEVAATAAYRFGNLTPRVSYAHGFKGSVHSADYDNTYDQVVVGAEY

SEQ ID NO: 16480 - protein, 1688 aa, Neisseria meningitidis
  misc_feature (379)..(379): Xaa can be any naturally occurring amino acid
WQEAALVPSFTQAQDDLGIKYKETALSSFVDNTRHTARQARAKILLYIERVKQQDFDTKKQEYINYGVLPTDIEAATNLGISYDPSKIYNNVETDQKVRRAEKDKKAVIDLYISSINRDIKYKYYVDKDIIPKMQEVMTTLNMNKDDAESFVASIRTEIMENAKEQYIANSHVPTKEELTNRFGTSRYDNKDGYIKSIRLKVMNKEKPQYIADSSIPTEEELEKKFGANKDEATNYIASIATQMMFDIKPYYIDNILPLTLKIMHKFKIGKIKHFLYRSNKSRNKGKTVLNNNDTTKQPAKFSQKKSVSKDDWYTWSNQGELNKDKGESSIISIGRKEKKPYFFNPISTFRTYLNNKENNDQLTLSQQNIKRIIQQEEXIKDFKDLIKTDPIAALNLEVDSSYKQEAVKTILSDFNDDTIQRVLFSDDTERLDFNTNIDVKNRPIFKELLENSSSEEKTKFVERIQDYAIRNISNSKFEEKARLDLVKLAASKDKSSVENFLALQLELKNKMHQYIAKSVYILTPEIVNEINIELKNKGLITDSLTQDYIIKLTKAVNKQTLNSAIKVILSDSSILNNEINKILGLAVGNNANNLEQAQSGIPNPPPLPLNMSIPNPPPLPLNGSMPPPPPPLNSQDFSSNSNDFDLNKLQAEYPKIYTSYIQFTRNTTVQPKALLQLTTSSAHRKMPKTAYAKLYAAYRTETGGKKADDLQDQLIKRQADLTNVIRQILTESYANQGADTKTLVNLFSISTPEIAEKAKEAFNTLIQDPYIQDIAVNGKKTITSEDIIKNLFNEDTDDAVKRILLSSCKMPEELKIPIQLELNKSELIRELQNKKNPFAQLEFAYTNAQHFDQDIFGDRVKELINNPNILTIEQQATFLTKTDTHLRKTINSDQAQAKLDDLRTAILSTIKFEELITVDLSQHEFIAIVKEKKPALLQELLQAITIKLTNNNSDQLRLALPSFTGMSDEQLRILTSKLNTTKILRALQECSQEKVKKHIHTGNMPPPPPPPPPLPNSQDLESAYLTRLGITRFNINTHISKKISEAYKFKSDIGLRYRKFTLSGEKAVGYKAKYSDADLFKKAIVESVAFEHLKNLPEAHQNKTYFEKIQEAVNTMQPSFIGPRTEIGQEVHNIYTSKVLELTKDKNFIEYIEGNIIPKQKLTEAFNTANSDFIGPRTEIGQEIHNIYTQQLTKYPEEAVKEAFNTANSDFIGPRTEIGQEVHNIYTSKLLESAKDKELFLSVEQLLVESTEIDKNMVVIFNQKVSNNRKKTGHLDPGLLKLFEQKNKATNDESLTKDDTQPEDSNKKSEQSDSKTVLSPRSLYSNDSKNDKSSDDKKSLLALRSSDEDDKGYETDESDDKKSPLALRSSDEDDKGYETDESDDKKSLLALRSSDEDDKGYETDEEELEESDSTTNEELKKDIVLESEDEAIDVSFKTEAITEQDEATQKQQVSDDTSRKVTILVKATSTLHKPIHYNILSDRLKVAAIGAGDEEASINRGVWISSLYDIRKQKTWKNIPKYQSRTTSITIGTDAEFINSHDVIGIAYSRLESLIKYNKKLGKTTVNGHLLSIYGLKELIKGFSLQAITSYGHNYIKNRSKSIDNIIGKYQNNNLNFQTLLNYKYRTKYDLYFIPNIGFKYDYLRASNYKEYNVDIENLMIQKKSNQSFESSLGGKIVFKPIVTKTI

SEQ ID NO: 16481 - protein, 347 aa, Neisseria meningitidis
RNIQAQLTEQPQVTNGVQGNQVKVTKAKSRIRTKISDFGSFIGFKGSEDLGEGLKAVWQLEQDVSVAGGGASQWGNRESFIGLAGEFGTLRAGRVANQFDDASQAINPWDSNNDVASQLGIFKRHDDMPVSVRYDSPEFSGFSGSVQFVPAQNSKSAYKPAYYTKDTNNNLTLVPAVVGKPGSDVYYAGLNYKNGGFAGNYAFKYARHANVGRNAFELFLIGSATSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQI

SEQ ID NO: 16482 - protein, 115 aa, Neisseria meningitidis
FFADHLHPGPQVHTIIAQYIQSIIAAPVQATYLNQSVQSMAQGSRTTLNSRYQQLRQGENPVGSLGMFGGYSGGYQRYDNNEAEGHGNHNNLTVGVDYQLNEQVLLGGLIAGTLE

SEQ ID NO: 16483 - protein, 238 aa, Neisseria meningitidis
ARRIRCRRRRVPLRQQGIFIGLAVELGWFRSGPVENQFADPSPALDSCDSNNDVASRFGIFQFQDDMPVSVRYDSPEFSGFSGRVQLVPIQNSKSAYAPAHVVVNNNVETVVGKPGSDVYYAGLNYKNGGFAGNYAFKYAKHANVGRDAFNLFLLGRIGEDDEAKGTDPLKNHQVHRLTGGYEEGGLNLAWAAQLDLSENGDKTKNSTTEIAATASYRFGNAVPRITVCPWFRLYRTR

SEQ ID NO: 16484 - protein, 267 aa, Neisseria meningitidis
RELLVGSLSAAAVCACSLLISGSSFAYSGNNDASDVSGVMNGSFYVSGSYSPSFPSISSFDISESDRGGSYVKGYNKNLSTLNVSDPISFTQNDPSFKFAKSLLTSFDGATGYAIGGARVEVEVGYKKFETLAESDYKHVESHNFVAVGRDATLTPDNFFVMKIDSVKDISVMLNACYDVMHTDLPVSPYMCAGLGASFINIADHVTSKLAYRGKVGVSYKLTPEISLIAGGFYHGIFDEQYAGIPASNRVNIAGGAAAKVKANIAS

SEQ ID NO: 16485 - protein, 161 aa, Rickettsia endosymbiont of Haemaphysalis sulcata
KTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEIN

SEQ ID NO: 16486 - protein, 943 aa, Neisseria meningitidis
MNKKHGFPLTLTALAIATAFPAYAAQAGGATPDAAQTQSLKEITVRAAKVGRRSKEATGLGKIVKTSETLNKEQVLGIRDLTRYDPGVAVVEQGNGASGGYSIRGVDKNRVAVSVDGVAQIQAFTVQGSLSGYGGRGGSGAINEIEYENISTVEIDKGAGSSDHGSGALGGAVAFRTKEAADLISDGKSWGIQAKTAYGSKNRQFMKSLGAGFSKDGWEGLLIRTERQGRETRPHGDIADGVEYGIDRLDAFRQTYDIKRKTREPFFSVEGERESKPVAKLAGYGKYLNNQLNRWVKERIEQNQPLSAEEEAQVREAQARHENLSAQAYTGGGRILPDPMDYRSGSWLAKLGYRFGGRHYVGGVFEDTKQRYDIRDMTEKQYYGTDEAEKFRDKSGVYDGDDFRDGLYFVPNIEEWKGDKNLVRGIGLKYSRTKFIDEHHRRRRMGLLYRYENEAYSDNWADKAVLSFDKQGVATDNNTLKLNCAVYPAVDKSCRASADKPYSYDSSDRFHYREQHNVLNASFEKSLKNKWTKHHLTLGFGYDASKAISRPEQLSHNAARISESTGFDENNQDKYLLGKPEVVEGSVCGYIETLRSRKCVPRKINGSNIHISLNDRFSIGKYFDFSLGGRYDRKNFTTSEELVRSGRYVDRSWNSGILFKPNRHFSVSYRASSGFRTPSFQELFGIDIYHDYPKGWQRPALKSEKAANREIGLQWKGDFGFLEISSFRNRYTDMIAVADHKTKLPNQAGQLTEIDIRDYYNAQNMSLQGVNILGKIDWNGVYGKLPEGLYTTLAYNRIKPKSVSNRPGLSLRSYALDAVQPSRYVLGFGYDQPEGKWGANIMLTYSKGKNPDELAYLAGDQKRYSTKRASSSWSTADVSAYLNLKKRLTLRAAIYNIGNYRYVTWESLRQTAESTANRHGGDSNYGRYAAPGRNFSLALEMKF

SEQ ID NO: 16487 - protein, 943 aa, Neisseria meningitidis
MNKKHGFPLTLTALAIATAFPAYAAQAGAAALDAAQSQSLKEVTVRAAKVGRRSKEATGLGKIVKTSETLNKEQVLGIRDLTRYDPGVAVVEQGNGASGGYSIRGVDKNRVAVSVDGVAQIQAFTVQGSLSGYGGRGGSGAINEIEYENISTVEIDKGAGSSDHGSGALGGAVAFRTKEAADLISDGKSWGIQAKTAYGSKNRQFMKSLGAGFSKDGWEGLLIRTERQGRETRPHGDIADGVEYGIDRLDAFRQTYDIKRKTTEPFFLVEGENTLKPVAKLAGYGIYLNRQLNRWVKERIEQNQPLSAEEEAQVREAQARHENLSAQAYTGGGRILPDPMDYRSGSWLAKLGYRFGGRHYVGGVFEDTKQRYDIRDMTEKQYYGTDEAEKFRDKSGVYDGDDFRDGLYFVPNIEEWKGDKNLVKGIGLKYSRTKFIDEHHRRRRMGLLYRYENEKYSDNWADKAVLSFDKQGVATDNNTLKLNCAVYPAVDKSCRASADKPYSYDSSDRFHYREQHNVLNASFEKSLKNKWTKHHLTLGFGYDASKAVSRPEQLSHNAARISESTGFDEKNQDKYRLGKPEVVEGSVCGYIETLRSRKCVPRKINGSNIHISLNDRFSIGKYFDFSLGGRYDRKNFTTSEELVRSGRYADRSWNSGIVFKPNRHFSVSYRASSGFRTPSFQELFGIDIYHDYPKGWQRPALKSEKAANREIGLQWKGDFGFLEISSFRNRYTDMIAVADQKTKLPDSAGRLTEIDIRDYYNAQNMSLQGINILGKIDWNGVYGKLPEGLYTTLAYNRIKPKSVSNRPDLSLRSYALDAVQPSRYVLGFGYDQPEGKWGANIMLTYSKGKNPDELAYLAGDQKRYSAGRVTSSWKTADVSAYLNLKKRLTLRAAIYNIGNYRYVTWESLRQTAESTANRHGGDSNYGRYAAPGRNFSLALEMKF

SEQ ID NO: 16488 - protein, 603 aa, Rhodospirillum rubrum
MSCPKSLPVVFAGLPLVFLSVSDALADNESVVAALDPIVVTATLGPKTRGESDSSVTVIDEQAIERLQPQTFDELLMGQPGIDITSNGSFGKNTSVYTRGTGSESTVFLVDGIRLRSATSGSAAWQYFPPQMVERVEIVRGSRSNLYGADAVGGVIQAFTHSAETGHEGWVQAGGGNFNTQEYVAGAAGTEGRMKYSLSASHLETDGTAIVEGGEDKGFRNTSALASVAHQFDSGGEAGVVLMRAQGNTEFEGGDTDFAIQTLGFKLDTPISDYWRSRILLAESIDEQDTRDEFGNSTFDTKTRSARWENQISVGRHEYILGGELLVDEVDSTTDFDETSRTNAAVFGQALLNFGPTDFQLSLRADDNEAFGREETGAIAMGVDMDRNHRVRVSYSTSFRAPTFNDLYFPNFGNADLQPETAGSVEFGIGGNYARWFWDAAIYQTDADDLIVFVFRDGRFAPFNVNEARIRGIELSAGLELDEWTVQAGASVTDPRDRETDNRIRRRSAKQFRVDLDRDFGQVSLGTTVKGQGYRYDDAENEERLAGFVTWDLRAKWEIDSHWTTNLTVDNVLDREYATAQRFDGTAYIAAGRTAMLTIRYDL

SEQ ID NO: 16489 - protein, 186 aa, Rhodospirillum rubrum
MKGGAAYAWHEIDMVRSVSFPGFSDTLVSEYDAGTGQVFGEVSYDLALSTATISPFAGLAYVHHRTDRFTETGGAAALTASGIDLDTWFSEIGVRGSMLIGTDLSLRGEAGWRHAFEDTTTLEAFRFATSPAYLVKGVAIDEDVGFIEVGADYRLNEWATVGTAYEGQYGSDTTSNSARADLTFRF

SEQ ID NO: 16490 - protein, 146 aa, Rhodospirillum rubrum
NKHGIEKYGVDLDFDSGFHWGNPEGWFVNLDWEVALGQWRSTKGTNRQNITEFGVTPLFRLEKRGGSWVPFIEAGVGPRLLSHVSTSNEHYFSTAFQFSDMIGVGVAFGSKQQFQMGYRFEHLSNASIKRPNPGTDLNELYLRYTF

SEQ ID NO: 16491 - protein, 988 aa, Rhodospirillum rubrum
MRHCKLSVLTMALATAGFSVVYTPQLAFAAETTPTQQEAKQAQDDNIKNDTNTNTKSVETNKKASDEAANIERIEVKGYSKSLIDSLDAKRYGDTVSEQLSADDLGALPDVSMADALTRLPGISAVRTGGQAAEINIRGMSGGFVFSTLNGREQVSTSGTRSIEFDQYPSELISSAAVYKSPKASLIEGGVAGTVELQTVSPLQSDKDHSFLVNARGMYNDRASEVYGADEYGHRLSMSYQGKFFDDTLGVALGYARLKQPSVATQFIGLAYNDSKEVDGLANDTNGPIDAPANEYISEGFELQHLGGVEIRNGYMSAIEWAPRDNFKLKADAFLSRFDSESFARGFRVKFGGSGAAIANPVLDGNSVIGGTFNRTSKSYTRVETVNDDNQDFDEVNSFGLNADWQVTDRLNVAADISYSSAKSNFRNGLLWANVAVDANADTPVFDDNVSISYQLNGLNLPDVGFNQADAFTDLDRVMVSKYGIYPYENEDAVKAYRLDFKYDLENDYISSVEFGVRYSDRNYSNRRSVFEYGNDGAFSSAEPPLKLTSDMASVVDWQGEFSYFPSYLAIDLDAALAAWFPEGIPQPVQTWGNADGVLDAKGYTTNYSWTVLQSGEVFEKVFAAYAMVNFDTEIGGIPVTGNLGLRRVETDQSATVLENVGAHPELGAQYIVDDLGIVNNYYAPKIKGIDYVDYLPSLNLSFKFTEDSQIRLAAAKVMSRPPINRLAGDASATANSDGVINGSSTNNPYLKPFYADQYDISYEKYFDEGAFVAALFYKNIDSFIDTVAITNFDFKGNGFNVPDYIVDPVTGVQTSTSNGTYTTAMNNAEGGYIRGLELAYTQVFASLPDLFSGLGFNASYSYTESEVQSITSLGGDSATQSLPGLSNNVFSATLFYGYEGFETRISARYRDAFVSEQVAINDQVVNFDSETVMDYQASYQVTDGLNVLFQVNNLTDEPTKSYFGTEQKTGTLQYFGREFFLGFTYAL

SEQ ID NO: 16492 - protein, 1819 aa, Rhodospirillum rubrum
MTIGKSKLLLGSGVGALALGLAHPALAQVEPGDPQCEIEGERVFCEGDLSPGVEVDDADGVSELFLRPLDNDIAPPADRDGISFVRTDGPIRIGFVAPDFVNIIATGSGHGIFASTSETMLIEHTRGIEAQGTGSGIRAILNSGSSNAARRLVAIRNRSSTIATSGSAADIWVTSNIADANDLVDVRVIDDSGFATRGLSSDADGIRVETLLDAGADPALLGQSTAFVFIGQRTTPRSYTNGAAGIRFLSATTNTVRVDGDLGGPLSIVGGAGTDTVINNGFIIGSVDLGAGDDTYILESGGRQSSGSSVTIQGGDGTDSFILGGNGNDNREGNRNNSNTFFLNRLDPLSGAFGAFSGFERVAKDGYSSWALSGSLNRALDFDVRLGVLLANATSPTLAVNVLPRGTLSGNGVVGSVDASGILSPGNSFPAGSGFGIARLTTGNLILRAGSTLEIEVDDAGRSDVIVVNGSVTLEGGTLAVVELTRDGFLGSDPFRYIIIENDGTDAISGSFGTIVNDFAFLTPTVSYTSGDGNDVQLVLTPNNAPRTGVQLRGCAGSGSELSCSGDLARGVRLTDADGIDSISITGLTRAVTPDSLSSGFSITRHSGPITITTDASPHEVVVRGRLGRIANGIGAETSGSQVRISNALDIRGVETTGFSGISVINNRGDDPAARANVNIVNTGDITFNQPGSGSGVVARAISVVTDGPGEFSIVNSGDLTQIDECPSVTCNAEMIQFEVFRDFLDNDFEQTDGPINLSIINDGTITVSSGFAINVTGVGGGDSTAARPIYENIEIINRGDILPVLSNGEIVANQVAADGIYVRGGLTSASGTFLVRNEGDIIDTGDGIDVIGGNVGTYRLENTGRITASDNGIEIQAGDVDRSVLLEFPTVELINSGDVDATREFGFNRVDGSGGILAGRTQHRIENSGNITASAGAIVSADVNDDDSQFLNAFNPFYRSSVLNTGSARSLNFWGLIGVYSGSGTVENRGTITTDGEDQAALYVESLTAVDVNNSGEVFTAARGSDAVALREISIVRDEQLGMIEFDRALDLQGSLSFTNSGTVTASGVDGDGVDVQTAFFDTVLNCNPDNEADSYFFLCRPESTFNEEYDPTTSVVNEAGGTITGGSGSGAGVRFTGPGTHTLDNSGTITAASGRAVVGGEGRETVTNAGTIIGTVLLGAGADAFVLAPIGNLPDIDGGDGTDVFALGGGGSGTFDGSTFDGNSFERFEKRGSSNWNLVGTPSALFPVIGTLRGGVLRVNGSYGALDLTVRAGATLGGTGTVGNVTSTGGTVAPGNSIGTFTLNGDLVLDAASIFQVEVDDVGNGDLLIVNGAVTLGGATLDVVEIGTFGGSDPFNYIIIDNDATDAVDGTFGTVENDFAFLDAMVSYTAGDGNDVGLTLTPTGTAPPPPPPPPPPPPPPPPPPPPPPPPPPPPPPPTPPPAPPPPPPPPPPISSGTGLFPTVATTFNQTNAAIRLDNLDLADSDANDVYKALLFATTPQALTAFDTASGEIYASLLAGQAEVGLGRTRGLLARANEQAGEGWGIWGGVHGRDGSIDGDGNAAEFDYDGFGFDLGVDYRGYGDGWAVGVSAAWDDGSSDLPGRTSSADSEGWSLGGYARYGSGNAGITASVALDYSEREADVRRNITVVGLSRTATGIADYDSLSLAGELRYGVATGGGGWAFGPIVSLAHSSADFEGVAELGAGALNLSGAGDDFDLIRYGGGLFANRQGGSSGFDFAAQYVTGSAEFAQVTLTLDGAPGVARPVRSPLADGDGALLAASGFWKIGGGWTISAETRAVLGSDQSEVAGSLTAGWRF

SEQ ID NO: 16493 - protein, 422 aa, Rhodospirillum rubrum
MPSATRITPTLLLALASTTALASDDLMTRSTLTGDWGGLRHQLEEDGVKITGDYSGETAYNAHGGLHRSARYSQNVKLGVQFDLSKLYGLDNGGKVQLTINDRRGNSASEDLVGNRLPIQENFGGLYTRLTELSYERTLFTPALNVKLGYMAMGNDLGGLDSGILCNFMNAGFCGHPLNMSGGSGWTNYPNAHLGVRVKYDLSPAWQLRVAAFNVDPESNGNSSRAWHLGPKHTTGTVVPVELVYKLQGELPGEYKLGYYYDSSDVKRIGSDDEVSGRGGHYLLVDQAVWNDQASPGRSLHAFGQYSASSKAASPFTKWYGAGVVLYKPFEGRPKDTVALGYGRAVPNPRSRDVLEDAAFNAGQQFPDIDSAEQLIELSYGYQATPWLNLRPDVQYIIEPGAFSGKDIDNALVVGLQVKATF

SEQ ID NO: 16494 - protein, 126 aa, Rhodospirillum rubrum
MRADAYEEEGSAVTGLSIEDEHVRTTMLKAGADFSGRFGSGDRAIWGASLGVRHLVGEDAVASRRVSLDGASWTVSEPGDDRTSGFASISLGYAPSPNSRIWTNVGTVRSPGDEQTYGSVGFSLQW

SEQ ID NO: 16495 - protein, 241 aa, Rhodospirillum rubrum
MKKILFATVALLVVGAAAPAVGADLGNRNYYKAPAPAYVAPIYNWTGFYLGAHVGGAFSSDNNFNGLSTGNNGNGRFLGGVQVGADWQFNPNFVVGVEGQYSWLSGSVGAVFPGGVAYTNDQRGLGSITGRVGYTWGPGLLYVKGGYAYSDNNEKVTVGGVPTGFIIDGDHRNGYTVGAGLEYMFAPNWSAKAEYQYYNFGDAHFTAGPLAGTGNFTTDDHTFKAGVNYRFNWANSTVARY

SEQ ID NO: 16496 - protein, 1171 aa, Rhodospirillum rubrum
MVNDMKRILFDTTKVLTLCAITIAVRAQSISNGQTVIVPDTRASPWDLGSTTLSVGQSGQGTLIIHNGGIVSNGQGYVAQNVGSSGSVTVSDPGSTWTSNGEFRVGNNGPGSLTISNGGTVVNNSTNNSSLGYMAAGIGTGLVTDAGSVWRNSGPVLIANSGQGTLTIENQGSVISSNGVFAQSTGSSASATVTGDGSTWTMSGSATVGNAGAGALLISNGAVVTTGQTASLASQVTGSGTVTVTGSGSTWTIGGNLIVSANGQATLNIENGGQVSAPAVIIAQHTGTGTLNIGAAAGDAPVAPGQLSAATVTFGAGTGTIVFNHTDTSGGYTFAPAVSGPGSVNVLNGVTVLTGNSTYTGGTAISGATLELGNGGSSGSITGNVANNGALAFNRSNTLTLAGVISGTGTVAQNGGGTTVLTGDSTYTGGTTISAGALQLGNGGTSGSITGNVTNNGTLAFNRSNTLTFGGVISGTGTVAQNGGGTTVLTANSTYTGGTTISAGTLQLGNGGTSGSITGNVTNNGTLAFNRSGTLIFDNVISGTGSVLQDGPGNTILTGNNTYTGGTTISDGTLELGNGGTSGSIAGVVSNDRTLEFDRSDTLTFGGIISGPGGVTQHGSGTTILTAASAYSGPTVIQRGTLAAGAADVFSPNSNFAVESGGTLALQGFDQTVPGLTNAGLVRTSGDPGTVLTTGSYIGNGGTLAIDTFLGDDSSPSDKLVINGGTASGTTNLAVTNAGGPGALTRGNGIPVVEVTNGGTTATGAFSLAGEVRGGAFDYRLFRGGTGGNLPDDWFLRTDFSVPGPEEPSPPGPEGPTLPAEEVLPPDPPPAVLPPGEYLIIGPELATYSVVQPLARQMGLTALGTLHERIGDTLTPAGGGNDNPGWGRSGWARVFGQQIDNRYRTFSDARASGSLVGVQAGVDIWRGSFLPGHHDAAGVYFAYGNSSADVDGLVTNAAATGYVLQHTGSVNLNGYAGGAYWTHYGPGGWYIDAVLQGTYYDGHASTQFARLPVSGSGLLTSVEAGYPIPLPLGPGFVLEPQLQLIWQHVGLDEANDGLGTVDPGSTSGVTGRLGVRGQWTITRANGQVWQPYVRTNLWRDWGAEATTTFSGVSGELLEQRVTRMDVAVGVTARLDTRMSLYSQFGYQFSINASSTGSRKGVWGDIGLRYAW

SEQ ID NO: 16497 - protein, 764 aa, Rhodospirillum rubrum
MSLAPPFALRPCLALLLLSPSLALAGNAVPLTPTTITATRTEQAVDAVPSTVSVQTREQLDRQNVNNIKELVRYEPGVSVGGTGQRAGITGYNIRGIDGNRILTQIDGVELPNDFFSGPYAQTHRNYVDPDIVKRVEILRGPASALYGSNAIGGAVSYFTLDPSDIIKDGKDVGARLKTGYESASHSWLTSATVAGRADDFDGLLHYGYRQGHETESNGGHGGTGLSRSEANPEDADSYSLLGKLGWNYAEGSRFGLVFEKYKSDVDTDQKSAYGGPYDKGKPAIPPSVLPGGMYQWRKGNDTLTRERYGLEHHFLVDSPVADRIQWSLNYQVAKTDQATREFYYPITRKVLRTRDTTYKERLWVFDSQLDKSFAIGETDHLLSYGINLKQQKVTGMRSGTGTNLQTGAESPRDALERSSDFPDPTVKTYALFAQDSIRWNDWTFTPGLRYDYTRMEPHITDEFLRTMKQSQNTTVDESDKKWHRVSPKFGVTYDFAQHYTWYGQYAQGFRTPTAKALYGRFENLQAGYHIEPNPNLKPEKSQSFETGLRGKFDEGSFGVAVFYNKYRDFIDEDALNTAGTGGNGQTFQANNIERAVIKGVELKGRLELGALGAPQGLYTQASVAYAHGRNKDNGEPINSVNPLTGVFGLGYDEAGGNYGGLLSWTLVKRKDRVDDSTFHTPDGTASQFKTPGFGVLDLSAYYKLSKDLTLNAGLYNLTDKKYWLWDDVRGYDGVGEASALAPANLDRLSQPGRNFAVNLVWDI

SEQ ID NO: 16498 - protein, 681 aa, Rhodospirillum rubrum
MGDVVFTSNFNNAGDANADSNGDGVINASDGFSKIGYDTNNDGVEDTNGGWSHDNDNVDELNLKLDNGSKWVGDAYFTYDRIDPTEMYNLEDGTNSLEPDSVFDKWGNVVDDKTFQSGIFTVALDNGSEWDTVNASNVDTLTVNNGSQVNVADSSSLIADTITLTNGSTMNLSSYGEVDTDHLTVDSYSKVDLTNETAYLYANTITVSNGGEFSIGAGEFDADSFGTDTLELTNAGVFNINNSDYVLDADLVNGHTNTTDTSNATYGYGVIAMTSDGHLTVNGNGDYYNGDNTADTTYSANGEADNSYTDNVVAATGNYKVRIDNATGAGSVADYKGNELIRVNDVNTDATFSAANKADLGAYTYQAKQEGNTVVLEQMELTDYANMALSIPSANTNIWNLEQDTVGTRLTNARHGLADNGGAWVSYFGGNFNGDNGTINYDQDVNGIMVGVDTKVDGNNAKWIVGAAAGFAKGDLSDRTGQVDQDSQSAYIYSSARFANNIFVDGNLSYSHFNNDLSANMSDGTYVDGNTSSDAWGFGLKLGYDLKLGDAGYVTPYGSVSGLFQSGDDYQLSNDMKVDGQSYDSMRYELGVDAGYTFTYSEDQALTPYFKLAYVYDDSNNDADVNGDSIDNGVEGSAVRVGLGTQFSFTKNFSAYTDANYLGGGDVDQDWSANVGVKYTW

SEQ ID NO: 16499 - protein, 361 aa, Rhodospirillum rubrum
MTIIPSRKRFASVAGVLLATAGLPAHAQSSVTLYGVVDAGILYTSKAIDPKTGLNAGHQVSMITGGMTPSLFGLKGTEDLGGGVKALFTLESGIDVSNGGYADSNGNLFGRQAWVGIESSYGTVKAGVQFSPFVLSLIATDARSVSYFGSGVPIYVGGVLVTGIFNANAISYTSPVVAGLQGSAMLALGGKAGDFQAGRQYSASLNYTVGPLLVSAAMYNGNSGGTAAATPVPSTVPFTGRTLGASYQYDALTVKAAYVNYKIAGSFDSRVYGGGAAYQFTPVVSADAGVWYTSDGNDTNNHSILAAAGLTYSLSKATLLYGQLGYVNNHGKMNTGLSTNGALYGANGSTFGTVIGMRHLF

SEQ ID NO: 16500 - protein, 710 aa, Rhodospirillum rubrum
MQGHHFGGGMSNSEAIDNTTAKLRLAQSSSLLALALLIGSAPAQAADTDWGWLAIGAPAAKAQGWTGKGVVIGVVDTGIDFSHPALSGRAFDYNYGSFVAGSNHPHATHVAGIIGATDINRGMEGVAPDVRFSSMKIFTGAGGSYLGDAAVADAYDGAIGSGVRIFNNSWGSSDSIANFTSREELLAHEPLLVGAFTRAVNADAVLVWSTGNDGRSQPSWQAAAPYYIQELKANWIAVTSVGENGTIASYANACGVAKAWCLAAPGGDFNPGIYSTIPGNDYGYMSGTSMAAPYVTGATAIARQMFPKASGAQLAQIVLQTSRDIGAPGIDDVYGWGLLAVDNIVDTINPRGAALFASAAWGRFTTLSAIGNTVLDRISDLRNGRGDVVTAPLAFAGQNGAFSQSGSNPRNAYAADLAAAPQPSPLGFGSVWARGLAGRATLSGSASSPQTTADISGGLLGFDLVNNQNLLVGIAGGGSNTNLTASGISDKAGAQAWHVLGYAAAMYGPAFVNVAGGWNSFDQSYQRRVIPGTAGTVFASTISAAQSSSTDVAYFFQGRGGWTFQTEVGRIEPYVHGATRNQSFGGFSETNASIFSLSVPSASLSEAEYGAGVRWACAPIKTVDQRVAVAPTIDLAYVRFTNDGPIQVETNLLGTSVVGQTAALGADAIRVAAGLSLTSLAGISGSFGYTGTVRDAATAHTVSGGLSIKF

SEQ ID NO: 16501 - protein, 417 aa, Rhodospirillum rubrum
MMAEFCEGGALINRIYIASGGGKQQHPESKRGERMRSIAMILLLYMTLLPVAGYAGSDDHWLKRDSVTGSWGGLRDALKDQGVDIELMYTGEMVRNFSGGVFNRPGSLYHDNLDLKLTAESDKLGLWHGGRWLVYGLRNHGSQPSVSLIGDLHTVSNIEAPDQFIVYEAWYEQQWLDGRLSLLAGLHDLNSEFYITEYGSLFLNSSFGIGPDISGNVTASIFPRPGLGLRLRARPSEQVYIQGAVYDGDPATRAIRRMEGRMMIAEAGYVITGGAGYKLGCWRHTADRIYAGRSFSGDYGLYATVDQPLFEFDGGGKAGLFLQYGWVPADRNRNIRYIGGGVHLQGLIRGRSQDEAGVAIARADTHLDAETTLELTYRLVLYPWLAIQPSFQWIDNPGGDAKVHAAKVGLLRFSIAL

SEQ ID NO: 16502 - protein, 764 aa, Rhodospirillum rubrum
MPLSPPFALRPCLALLLLSPSLALAGNAVPLTPTTITATRTEQAVDSVPSTVSVQTREQLDRQNVNNIKELVRYEPGVSVGGAGQRAGITGYNIRGIDGNRILTQIDGVELPNDFFSGPYAQTHRNYVDPDIVKRVEILRGPASALYGSNAIGGAVSYFTLDPSDIIKDGKDVGARLKAGYESASHSWLTSATVGGRADDFDGLLHYGYRQGHETESNGGHGGTGLSRSEANPEDADSYSLLGKLGWNYAEGSRFGLVFEKYKSDVDTDQKSAYGGPYDKGKPAIPPSMLPGGMYQWRKGNDALTRERYGLEHHFLLDSQVADRIQWSLNYQLAKTDQATREFYYPITRKVLRTRDTTYKERLWVFDSQLDKSFAIGETEHLLSYGINLKHQKVTGMRSGTGTNLDTGADSPRDALERSSDFPDPTVKTYALFAQDSISWNDWTFTPGLRYDYTRMEPHITDEFLRTMKQSQNTAVDESDKKWHRVSPKFGVTYDFAQHYTWYGQYAQGFRTPTAKALYGRFENLQAGYHIEPNPNLKPEKSQSFETGLRGKFDEGSFGVAVFYNKYRDFIDEDALNTDSTGGNGQTFQSNNIERAVIKGVELKGRLELGAFGAPQGLYTQGSVAYAYGRNKDNGEPINSVNPLTGVFGLGYDEADGNYGGLLSWTLVKRKDRVDDSTFHAPDGTASQFKTPGFGVLDLSAYYRLSKDLTLNAGLYNLTDKKYWLWDDVRGYDSVGEASALAPANIDRLSQPGRNFAVNLVWDI

SEQ ID NO: 16503 - protein, 722 aa, Rhodospirillum rubrum
MPSPLAPSRHLPARNLLAMAVCMAIVTPALAEDDQPTTLVLGATEISSDRLGSTTEGSQSYTTGSMATATKLPLSLRETPQAVTVITRQRMDDQAMTSINDVVKATPGLFLDYSGGPGRQNYISRGFDIDNLMYDGIPSGYKPYTVGAQPNLAMFDRVEIVRGATGLITGSGNPSAAINLVRKRPLAEQKVTLTGAAGSWDDYRGEIDASSPLNDSGTLRGRVVTSYRGANSYIDDVEQDHGLFYAITEADLSEDTTLTLGFSHQKDQTNNFWGAMPTALNGHHMDFSRSYNPGSDWENKDQEINTVFAEVQQRLANDWKLQVNANYSQQDGTFTGSYQSRWAGLNKPLSRTAYQSKHQENQAGLDGFVSGPFEAFGRTHELVVGASKRIYDMDTRNYSPYDTNWPIDGGKPNFVHTNNVREVTTQEGVYMTTRLSLADPLKLILGGRLDWYDYDNKESASADYKVTRNVTRYAGLIYDLDDHHSVYVSYSDIFNPQEYKDASGSPLKPVEGKNYEIGVKGEYFDGALNASVALFRIDQENRGVSQTDLAGCSDPTNCYVASGEVRSQGIDMELQGALTRNWQVGAGYTYARVHTLKDAANPGNVNQRFDTDTPEHLFKLTTTYRFEGPLEKLRIGGNISWQSRIYNDFTVADGSEYRLVQGSYAVTDLMAGYQVNKHLDLQLNANNVFDRKYYSAVANSVNYAGDTWGAPRNMMLTAKYSF

SEQ ID NO: 16504 - protein, 456 aa, Rhodospirillum rubrum
MRGNYVRVAVALCAAACGTPAGATDVFNLEGFGPVSRAMGGTGAAFDIGPAAMMANPATLGLMAEGNHLHLGLDMVTTDIKATNTATGETARSGNHGNNNGPYFAPEAAFVYRHDNIALGAGIFAEGGLGTQYGGSSFLSRTSNGVQTGLDQFSRLLVLRIPFAVAYRPTDKLTLGASLDAVWTSLNLGTLLDVTQIGTLASQRRVSGSLVPTLLSVPGLSGGYLGFSNSAPVGGGADAWGIGGKLGLTYDITPDTRVGLAYNAKTRVGDLRGQATLAAVSTVAGNIPLSGEVRVRDFQMPAQFTVGISHQFNERLSASADYQRVFWSSVMRDINVTFTRGGANLDLSLPQNYRDTNVFGLGVAYRFDSAWTVRGGFHYAQEAIPNGMLLAVVPAIPTTTLSGGATYAFGKDDAIDFALSVVLPKTVGNASQPNTAVPLTVRHSQLNAVLAYRKRF

SEQ ID NO: 16505 - protein, 871 aa, Rhodospirillum rubrum
MVIFFSKTFVINKALELVKLKFFGFISSALYYHTAVFAADYNRNIIDYHQILTNGDSVTNSTVVSSGRLTLYSGAKSNGINIESDGIMEVNKNATDKSSIIHTGGIQYVDGFSLNTTIYGEQKISGSVEGTLIKGGYQSVYGSAQAINTTLSNGGVQYVAGIAKDTIIESGQQYIQSGGKGSDTTINNGGIQNVEGGSVTNTTINDGGTQNVTGGSVTNTIINDGGTQNVDGGTATDTTINYGGIQNVNGGIVTNTTINEVGEMYAWGGSVSNTIVNGGYLDVAGSSTIIKNTVVNNGGYVNVLDGKVKNVEVSGQNASLYIGSAGYNVKPVISGAITASDRGHIFLGYGADSSGADITLNSDAFLQLNNAGMCTTDCLYTLNSLALSGGRVFHSNGGWNTLNLSSLSGNGDFYMYTEVASGKGDLLNVTGNATGAFRLFVQDSGVSPTSDDSLLLVKTGGGDAVFTLGNKGGIVELGTWEYRLKENNSGSWLLSPELKPAPQPDPAPQPDPAPQPDPAPQPDPAPQPDPAPQPDPAPQPDPAPQPDPAPQPDPAPQPELPAENIKRRISASTAAVLNMAAVQPLVFDAELENVRERLQARKMAGRDDSLWMTQYNTRNNVSTSAGAEFKQTLGGLIMGIDRLSQYEKSSGTLGAFFSYSHSNIDFSRGGEGHVDSYSFGAYAGLQHESGFYLDSIAKANLFDNHVKGRMNSGGAADGDYRTWGIGAHLESGIRLSNNKWSATPYMAFTGFTGSAQKYALSNGMQADVDTTHMLRAEAGLGMDYRLILSNGGELQPWLKISVRQELADNNQVTINNRDRFNNDLSGMRGVFQTGVHAKITDNLTGHLSAAYGDGAGVQFPWRVTAGMSWSF

SEQ ID NO: 16506 - protein, 807 aa, Rhodospirillum rubrum
MTKTELRTSLLRGSILALGALALAPAAYAEEDAQQSAGEGQQASVQEIIVTAQRREESLQKVPVAVTAIGSEQLAALRVNSVRNLAGLAPSLQLNTQGQQSNPTIIIRGVASGTSSNSVDPKVGIYIDGVYIGRAVGSLLDFSDIQRVEVLRGPQGTLFGRNATSGAISIVTAAPKGEWGVRATGSYGNYDAWRGKVSLDLPQIGPFSVRLSYLHDEIDGDVANTMADKGLNLSLRAPEFGTQKFVKRLGYRNVDGGQVAVRGEFGNLTADYRFDYTDSHGSGRAMQSFGVIPDASGQLLAPIVALQPFFGGTTNYGVDGPLKSVAAATSDEHTVTQGHSLTLTLAANDNLTVKSITAFRKFRQDPVVFDLGSAGGMRFTFQQLGALITPGLTPEQIQAALFNPANLPGPNDYFFPLLSARATSQKQFSQELQFQVTTDQFDLTAGLFYFHERSPGTEVLGILSPAPSATIVPSALDAVFGSGITRTIGVNDSMAGYGQLTWHLTDTFDITAGLRGTIDDRELNILVISGAQGGSLGVGDYKATYKKLTYTGIATWRPTEQTTLFAKVATGYVSGGILSGIPYRPENLTSYEVGAKTQFLDNKVRLNVAAYYNDYKDLQTQNFINGRQFFDNAGKAKIKGFEAELDIVPVQGLNLSGSVGYTDFDYKTFILNGEDVASFARPTYFSKWTGRAAAVYNSPDFGNDGGHVTALVEGRYRSSYYLTSTPLRSILTGQPALEDLNRQPGYWLVNGRLGVADVPLGGARMSLSVFGDNLFDERYVGFGAPVLLFTGNYERGRTYGVELGVSF

SEQ ID NO: 16507 - protein, 774 aa, Rhodospirillum rubrum
MPLRHSPFVHALLFTTTLGLATPAAYAETRSYHIAAGSLEDALNQFGRESGALISFGSQLTQGIHTQGLDGQYDVRQGLDALLRGSGLQVRQETDNAFSLQPIDTPAAGAPVELGASTVVGDWLAEAQQDNVFEHPGARDVVRREEFERNGATTAREVLNRIPGVNAPDNNGTGSHDLALNFGIRGLNPRLASRSTVLMDGIPVPFAPYGQPQLSLAPLSMGNMDAVDVVRGGGAVRYGPQNVGGIVNFVTRAIPEQATFKAAMQNQISPSSSHDGFKNSANLLVGGTNANGLGGALLYSGTRGGDWREHSDTQIDDLILKGKLQLDEANSLHAMAQYYEGEADMPGGLSTADFAADPYQSTRLKDKFWGRRTLFNFGYDYKQDDRQFSVNSFFTKTLRSGYLDQGSFVSLSPREYWVRGIETRFSQGLALGDSWHELGIGYRYVNEAGHELRFREPVNGSLPTTASRNDRDTRGSTEAHAIYLDDRIDIGRWTITPGVRYEMIDSEQSNKLNGQRYQGSYNTALPALNVMYHLTDSWNLYANTEGSFGSVQYSQMPNRVSSGEVKPEKARTWEVGTRYDNGDLQAEIGAFLINFDNQYESNQTNDSVIARGETRHQGIETSVRYALDGLSPALAGFDVHASYAFVDATIREDGPNKGNQVPFSSRHKGNLGVGYTDGPWQLNLDGSFQSSQYADNANTSTESADGSTGRIPGYMLVSTRAGYDFGPQLSNLKVAVGVKNLFNREYYTRSYDDNNKGKYVGEPRTLYVQTSVEF

SEQ ID NO: 16508 - protein, 89 aa, Salinibacter ruber
MLRYRRMVQLFFPLSPNVDIYNLWRKTRIKFIKAQYFNMLQIILFLKHTHNKYHKHKPDKYPMNMQQSFNYSIYSSATKLQKIITNSYK

SEQ ID NO: 16509 - protein, 696 aa, Salinibacter ruber
MGGVALWVLAFNCGAAAQDLAPDAASAAPATGQDQPVSVLQQIVVSAGVPKVAIDTPQAVTVLDQERIDDLQPRSIGDVFEEIPGVTPIGSNSILGESINIRGIGEALSGDETRIIMQVDGVNKFFEQYRMGSFFSDPELYKQIEVLRGPASSTLYGSGAMGGVITFTTKDASDFLDSGDLIGGRLKTSWDSNGNGWLGSAIIAAEPVKNLELLGALNYRQSQDITDGQGNEVPDTDFNSINGLIKARYTFGENDDQSVFANYQNWSSDEDNQNYDQISWENTFGDVDRTVTDQTAIIGYQNAFTGNDLLDVKAQVSWSDTRVEQKNQDPICYGPNSCVYSLGMSSEYSYETWQGKADNVATFQLGEDWMAYVTTGIDGQYQERLNPRHFANYTQSGSNSHPEGETVNVGGYAQAELVWNDRITLIPGMRIDYSNVSVGSYVNSKGTTVDLNEDKSAVGYSPKLAAMIKMSEWLGVFGSVAHTERLPSLDEVFSNYVVNDLDKELSNNFEAGVTLSFDDLIMGGDAFRLKGTAFRNNVTNYYASYWNGSSVVTEVIPKARYEGLELEASYWTESVYGSLGASLIRGNNVSTGGYMNAVPADSAFLKIGYVYRPWNLDFGWKGDFYAAQDRVGSDEQETAGYVLHNLYAAWKPEEGFMADSEVRFNVDNVFDKSYRNHLSEDEGAGRSFKLSFAKKF

SEQ ID NO: 16510 - protein, 1798 aa, Salinibacter ruber
MDGAAVSNGLSFVDGGGTLAVQAGASYTATGGPVNVGFDAGNTGSGTLSVADTGSVIGNIFVHNAGTVDINGTSGDATTEVTGALVLFATATGNSTVAGDIGGAVTVNAGTLTVDGVSEFQSSLDVNAGSLVVSADLGVTGAAEASGGDVTVDAGATLTTATLTMSGDGALTLNGDLDGDLNITDTNNTVAVTHALNTPGGVTGTVTQNNANSTITTGDAGNTQFGTLVNTLGTVTVNTGTLQLNNASSNAGTMNVNSGTAVILNTADFTNTGTFDLNGQMGNVSLADTFTNDGGVVTLANNLAAQYVQTGAGAQTTIDGNTLVGTGTTGATMAINAGALTIDAGQTLTYGALTLADGATMTVNGSMAALTDTTTNINGAATYNDGSALNDNGSINIGATGSVTFNTGGTGIVFDADQDNNAVGTITSDGAITVNGTGNVSFGTDGDDNFTNQGSATVALLNTSSVSDIDVLTNSSTANGATAGTTAIFLASGTSLGFTTLDSSAGTIVSAGTLDGDVNLTGTAGLDLNDGTITGTLDNQSGTAITLDGTITGAFTQQGAGTQTTVDGTSSFGSTVDVDSGTLTVDADTTVTGATTVDDATLTVNAGDTLTATGNVLAGGSGGAGTVVVDGTIDGDVTAQNTATVTVNGSVDGNLQTQNTASFDINGTSGAAPAEVTGNVTQAGTSALNTLAGDIAGFLQQTGAGTITVDGDAIVTGLVNIDAGTLTVAGGATLDATGAGVDVAAGAFGNVNATGEIDGSTTNAGTFQNDGTMDGVTNSGGFTNTGTTAGVTNSGTFTNNGGTGTVGNSGTFDNNGSTLAFSNTGTLTTSGTITGDLDQTAGSTTADGNATVTGELDIDGGTLTVDPGIVLSAGSADIEDAGGVTVGAGSTLQTTTGTLANDDQIAVGAGGNLIAATTLTNESNGTITFANGGTLSAGGAGQGTITNEGQIVVNAGTVTATGNDNFVASGMGTGLQILGGHLDLGTGTVTDTGTGTLTAVTLTADASGGAMLTTGGVTFDEAEIELNANASGDATVTGPVTVGGTGFFDLNSAGGSTATITGDVIQQAGSTATSTLAGTLGGILDINGGTVTVDGTGGGGTSVVTGALTVDGGTLNVNANTDAAAGTTVGATGTVSNTATFATNVTNAGGFTNDGTVSGGVGNSGTLDNNGTVTGNVTNTGTLTDSGSIGGSLTQTAGSTTVDGNATVTGLFDMNGGTLAIDPGFTFAVGSADIEDAGGVTLGAGSTLQTTSGALDNDDQVAIGNGGTLLSFAALSNETNGVMDFLGATGALTAGAGSDITNTGRFNINSAVGQTVTLTTSGAGTFTNTGLIDMVDGETADRLVINGDAVLNGIIGMDVNVSGALVGTSPADTADQVNVTGTASGAPTLAFSNVNGVFSNVAVPIDLITAANTGGVSATQTGLPTNGAFIYNLQNTGTAVQLTATPNLAFGGVASGVAATQSLISTVVNRPSSALVTPLVAPGDDPCAIGSWSRITGGKASAGLSTSAASLPGSLSNQIDLRYRGIQVGLDRSCSGGYYNGWDLAYGAMLGTNGGDTSLPVNFGGTVTTLSTEFDQTFGGFYLSAAKGQWFGDLSIRADKTTYSIQESNSFANGGLGINTQDFDSRGKTVSGSLSYSHTLNEQLGLRLVPTAGFSFSHIESDSIAIENDPSTAADNATLQIGDIDQRIGYLGATLARTQVAESGTAATTYFVTGTYFNDFGDDLESTFTVDSNGSSQVLTSETLGGFGELSFGFNYTAILDAGSAVPARQVDASLRADTRFSDNLDSWGLTAQVRLQF

SEQ ID NO: 16511 - protein, 347 aa, Salinibacter ruber
MRAVRYLVVGVFSCALSGGSAFASSSSNTAAAPIATATTVSQSSTQNIVRTISSSVSDGLARAFSSGNLFRHSPANNKRVGLGQGETGVSTGNSPAGFGVWGSADYTYLRIVPDGDRAQRRLTDIYSGVAGLDYAINDKAVTGVAVGYGHAETDGRTARAFKLDQTSDSFTVAPYLGLSPMENMTVDVVVGYTYASIDTTDYSFNTVAKGSNNSNTVFSAVNLGYVMPVTNNVAIKGFTGFSFQHGSTDSYRDSQNNEIRGDSEDHWVARLGAKALWAVTDSTEAYVSAAYERDRQTPALSENSARMTLGTSSKLLDGLDLVAEGMANFGRETQQEYGAAVNLRLLF

SEQ ID NO: 16512 - protein, 514 aa, Salinibacter ruber
MRPASRSRFLSLTNQTANGTRMKQLSSVPRKLRVDALAALLLSLAAASAFAQASAPATEPAAGTNDAAAPAQPAADAATPAPIGLWERSNLLGNMGGLRDVLDEHGVTLSLQETSEYLYNTSGGTGRGGAYQGLTQFGFDVDTGKAIGLPGGTFNVSGLQIHGTNLTQRYLQTLQTATGIEANSTTRLWELWYQQSLLDGKVDVKVGQQSVDQEFMVSQNAATFMNATFGWPVLPSTDLPSGGPAYPLSSLGVRLRVKPADAWTAMVGVFDGNPAGRSDGDAQVLNAHGTNFNLRSGAFVIGEVQYALNAPPADPKAPQPAGLPGTYKLGFWYHSQHANDPRYGTDGLSLADPASNGMPATHRGNYGFYAVADQMVWRPSADSPRSVGVFARVMGSPGDRNLVDFAANAGVTLKAPFVGRDNDVAGIAVGYAKIGSHARGLDGDTGAYTTPGYPVRRAETVIEATYQYQIAPWWQVQADLQHFFRPGGGIPNPNAAGARIGDETVVGVRTTITF

SEQ ID NO: 16513 - protein, 1041 aa, Salinibacter ruber
MRRYIRYVLSLALLLCATHMLFAQATASANVAGTVYDKTSAVIAGAQVTITSKATGQTRTSNTDSNGAYRFDLLSAGQYSIKITKSGFASLSENVELLVGQTSTINGVLNPGSASEVVEVTEAAPLVDVAKTSVSTQITPSEVQEMPLVGRDVANLAYLAPGVKAADSYDPTKNRYAILSVNGADGRNVNVTVNGVDNKDNTVGGPVMQLPLEAVQEFQISTQRFSAENGRSQGAAINMITKSGTNMYHGSAFGFFRTSALDADEMVPDGTGGAFHSHPDYSRQQFGGSFGGPIIKDKLFGFFALEHERERQGLSESGTSFDELSLAAGAGLAAQPSAVIPRPFNETRYSGRLDWNVNSKNSAYLSYNSQVNDSLNDQSDGTGDLTNGNFTKNHLQLANLTWNTLLTSHLINQFTFGWQYWNNLIDSDISAPLVTFPNASFGTNTNVPQQSFQRKFQFKDDISWTHGKHTFKGGVDYIWNPVEGGFFEYSSTLEIDFGADPSCILAAATDDVNKCGPGYYPQQFATKGAVTGMTIANGDPQFIVPTKQLGFYFQDDWKVTPRLNLNLGIRWDKDFNTYGQSDITNSRTYQELVAINSPITNPYVASLPHASNKDFSPRVGFAYDLTGSGTHVLRGGFGLYYGNSFQNIPLFMEQQANSTIFQTLFSLSDPVNDVVPGTGIPLGQWQYGISPMPTIAPPSADLTVGSTGRLVDPNYQNPVSEEFNFGYSWGVTSNSVFETEFTHVQNLHENRTMNIDQKVPVGGVCCFRPLDDAFAAAGQPRLNSVRDEQSIGRSRYDGINFGYRQRMTHHFMFNAYYTLAWADGYNTNGNYAFRNYPFLATDPFAKYNWGPTYSDERHHVTISGLVDFPFGIQASPILQYGSARPYALTNSYNTLNTGNGTATAVIVPKGQTNNYLYGTNYIASYVAAHPGDDNATSEAQQNLQMCFYNGDCTLAQFDPLRGKPTFELDLRLAKNFKLGERFNLQITAQAFNLTNAPNYGNNFNGNIASPSTFMHPAGFINPSSTTTPRSLWSEYGVRLTF

SEQ ID NO: 16514 - protein, 800 aa, Salinibacter ruber
MSTRILVALSLLTFVVPIAEAQSTRSTVTGTVTDADGAPLPGAQIADVAFQRGTTAGPDGRYTLDGLPPGTHTLEIRFVGYQTAVREVTLQAGETREMNVSLEERVLETDGVTVTGTARARSTLRAPQDVDVMGTEDLQSGRSAALGELLQENVDGVSSIQTGAQAGKPVLRGLSGKRVVLLKDGIAQEYYQFGVRHFPTTNASEAERVEVVRGASSILYGSDALGGAINVISKPAPTTGVDAFEVGGSASTQYYTNNNERAVALDLSAAQGNVGWRVGAERRIAGNYHTPDAPTFSETKKGGTFGDPRYTGEVPFTNFEQWSTYGQVGLQGAFGTLQLYGDYWSNAQNFLLPAGGTPGQTPFPAAGLGQNLEHSNVVLKGNIVADGFVLKPRLSWQRSIRQSGAPGTNLGDIRDGGGLARFDYPLDLKTDIYTGRLEVAHPSIGSLSGTIGAEVQHQDADTRGPAELQPSARTWNTGVFFFEDLDLDPVTVSFGSRLDVRTVQAVPNDRTTESDQLENTYTTLSGAVGASYAFGDGVAIATNLSSGFRAPSVFELYASGVHGGVAAFQVGNPDLEPERSYSADLSLRVRRDRVTAEVTGYVNAIQDYIYLENTGEKGPNGNLPKFAADQTDALIPGIEATVETSPLPWLQVGGSAAVLDGTGDGLGADEGDDGELPLLPANTVSGFVRWVPADTGPLTNPQVELSLKRALDKDAAGRFEPFSQFDEGFGPPFGTASTRAYSVVNVEARTTLALGLGAPLTVSVGVDNLLDETYRDFLDTYKGYALSPGRDVQFSLSTSF

SEQ ID NO: 16515 - protein, 1604 aa, Salinibacter ruber
MGAANRDINANVNLDVVGIPGIVTGDSLTYVVQAGGPCTATATGGNDNGGNATVLFGSINMLQNGVFAVNGADIAIGSVSGTAGQLLTVNIAGNTLTLNGAPGVAAFPVNTYTNLGPVNFVDAAAVFKVSLAANGADGTKTAIFGNTATFNGTAAGKGIINIDNGNIAIFNGTIGNNNGIQGLTLTGNAQATLNANTKFDGTVGAGSVSLDNGSILNVADGVNITGITAVNNISIDGKAANDGTVNFLGDSAVSTDIGANNAIAAVNVAGELTFQGGNNGGGGTFTAQAINLTSAGSLIKFTTQDHAVTGNILNTSGTNNQGGFSVNGGDVTVTGNIGADGNSLATINFETDDSLIVHKAAINATNALFIQNVNTATANTGILKLHGTNYAINGNIGANNALKLVDLADDDNGAATNFTLKQGSSIKAQNISLADIQDNTLTLEEGTTITGDIINTKGNGNGTIVLTGNATINGGIGVDIAAGGNLGKTIKNINLGGKDLSYGGNTVKVQSAPNNGINFAANETLSLTNTTDPILIASDIITTDKQGIIDGSALTNDQTLTIAGKIGIVDIINNPAQNVALGQLKIGSSKTALNSGNVAINELVIGNNGSVQFAHNTYLITKTTNAAGQGKITFNPVVANNTTLADGTNLGSAANPLSEINFGSKGANADTLLNVGKGVNLYATNITTTDANTGSFVFNAGGTNIVSGTVGGQQGNKFNTVELDNGTTAYFLGNAIFNGETTIEANSTLQIGGNYTTDFVTSADNTGIVKFVNADLITVTVQKQAGVVDALKQITVSGSGNVVINQTGNAANPGVVTDTIAFADASLGTSLFLPSGLPFNDAGNTIPLTIKSTVGNGPEGDFNVPRVIVSGIDSVIADGQVIGDQDNIIGLGLGSDNGIIVNATTLYAGIGTVNDNQGTVTLSGGVPNTPGTIYSLGIGNGTPKLKQVTFTTNYNNLGSIIATNATINDGLTVTTGGIAGKDFDGKITLGSANGNSNVIFVDGTNSTATSMVATAKANNGTVTYLGSAAVGNIGSSNALVASVKFTGPAGSLEKLQGNIYSTATNFGNVNLNVAGSNIILGGDTTAINGNINLVTNTLTFESGTSTWGSNTSLSTTLTVSNGNIGHIVIAEGAQVNVTTIGTTTINVQDNASANFSGTKYYTLIEGGARFNGTLRDPNFAVTGSNRFVNYGLIRAANQDYVVTRTNDAANVVTNDIANGPFGGAPGVGQNVTTFVNATNTAAYNNLLLAKNSADSANFVGTITTDTSAAVTNAQLDIAKDIQAQLGNRLSALRYLGTPETAEMTGPEAGAVPAAVAAGDEAVDNVAYGIWAKPFYTDAHQSKKGGLAGYKAKTTGVVIGLDMLANDNLMIGAAVGITKTDIKHQDYKKGDKTDVNGFSFSLYGAQQLVKNFFAQGSAIFSLNQVKNKSQRYFFDANGNMSKQIAAGNYDNMTFGGNLMVGYDYNAMQGVLVTPMAGLSYLKSSDENYKETGTTVANKQVNSKFSDRTDLIVGAKVAGGTMNITDLAVYPEAHAFVVHKVNGRLSKTQSVLDGQVTPFISQPDRTAKTSYNLGLSASIRPDAKMEYGIGYDAQIASKYTAHQGTL

SEQ ID NO: 16516 - protein, 822 aa, Salinibacter ruber
MGAAPAHAQTWGTVTGTVTDSVQGAPLPGVTVLVEGTDFGTATSADGRYRLELPTGRYTLRFSAVGFATRVDSVTVAEGTTQLDATLASTVLKMDELTVTDGAVPNRPGVYKVDPADVQNMPTPFKDGFRALKTTPGVATNNELTQQYSVRGGGYNENLVFINGFEIFFPFRPRQGEQEGMGLLNPALASDITFYTGGFPPEYGGKLSSALDVQYVRPESDPLSGSVDLSTLDASAHLQSSALGGDLGWGFGMRRAQPGRFFGTQDLKGDYSPRFTDLQGTVSYRFSDRVSVEALGIWADNTFDLEPEERTTYFGVISLDPERPSDFKALRASLNGARTDGYTTTFGGVRLHTDLSDRLKLAHDFAYFGTRETESFDIQSDRRVCQVNPTGGDNPSNCTSVLQGESTVTRFADNSVEVRRRTGRGRYEWDLDRQTLKGGWHLRGLHFDDNLNERTTIDGRVEDGQDSTLVDRLDDSATFDEYQFGAHLQDAVDVLPTDGRLTITGGVRADYFSFNDEWTVSPRLSGRFVATDRLTLTGAWGIYHQKPTYRELRGTPTDTASIRGTLDQNRDIRSQRSVQYVFGGEYFFPDRRLYLRAEAYYKDLDDLISYTIEDVRVNYSGENDTYGYTYGVDFQLRGELVPGLESWFNYSYLVSRERFTDAALERYAAQAPTGFSDEFRENRTGLLPRPADQRHTFSAFVQDYVPGDKSWKVHMRLLYGSGLPYTPTSPGPKTPGGAETRIPGDRMSGRLPAYRRVDVGATKRIELVQNGIGGPVHLELTLEVLNLFDMDNTVDYSWTQGYERVPKRLTPRTLNARLHLTF

SEQ ID NO: 16517 - protein, 1616 aa, Salinibacter ruber
MPQRSQPFNSYTGHSGVRGHGVAPTVLVLALGFHGTAAWADCQTVGSAVTCDASSPNPYTGTVGSGASSGNLTITVGPGARIESGNAHAISVGTGNTISLDGNAQVSNSVTTGGPGNYNAGLNTIEFEHTNTLMIGADVRVAAEGTDPAAHAIAFTGRTNVVTNYGTVSSASGAAIWNQLEDNFVSNTIYNYGVIETTANGGDAVVIGSATGNGATDRGMTLYNYAGGRITGNVVLGEGDDTVRLEAGSTLTGSLDGGAAGTDVLYLEGTSGSGELTQDISNFDEINKIESGATWTLSGSLGANSSGKATVVNAYNGELIVTGDNSAAAAGSAMTVWGGARLQVNTTSAMAAIQSNGSGVAAFSQQTDGTYAGVLSGGGNFAKEGAGSLTLTGVNTYTGALQLKEGKVIVSAAENLGAANSRLEFDGGTLNTTSDMTSARRTTIDAGGGTFEVASGTTLNWTGRMLGNGTLVKEGAGTLALSGFNAHGGTVVNAGTVQISNDYGLGNGALTLNNSRLASTADIYAEAAATVNGNGTFDTANGTTLQWMGDIGGAGALVKTGAGTLLLGGDSLYAGGTVVNAGTVQVFKDASLGGGALTLNNASLASLGSFSTARAATLTGNGTFDTTVGTTLGWTGDIGGAGALVKTGQGTLVLGGDNQYAGGTTVNAGTVQVARDANLGGVAGTVALNGGTLAASASFSSARGVTIGAGNGAMSVASGASLDWQGLIDGTGALAKEGAGTLVLGNDNQYAGGTVVNAGTVQVARDANLGAAAGAVALNGGTLAASAGFSSARGVTIGAGNGAMSVASGASLDWQGLIGGTGALIKEGAGTLVLGNDNQYAAGTVVNAGTVQVSRDANLGAAAGTVALNDARLASTGTFSTARAATLTGNGTFDTADGTTLGWAGDIGGAGALVKTGQGTLVLDGDNQYGGGTTVNAGTVQVSRDANLGAGAGAVALNDARLASTGTFSTARAATLTGNGTFDTADGTALGWTGDIGGAGALVKEGLGTLVLDGDNQYGGGTTVNAGTVQVARDANLGAAGGAVRLQGATLASTGSFASARALTLGAAGGTFATLGATTLGWDAAIDGAGGLTKTGAGDLVLSQANTYAGPTLIKEGRLAVNGSIASPVTIDPGGVLGGTGRVLGAVANSGTVAPGNSIGTLTIVGNYAGTGGQLEMEAQLGGDASPADRLVIDGGAATGRTDVVVINQGGLGGQTDQGIPLVVARNGATTTADAFSLASPVAAGAYEYKLLRGTPDGAAANAQNWYLRSGLLVPPAEVPGGGPGGAPEPEFIPFYRPEVALYAGAPMLMRAVGLQALGTYHERTGEQGLMTRDDPDPVRRGAWTRAFGRTFERSGSGDVDPRFDGHVAGLQAGVDLYARRSDQGHADLAGVFGGYANARGHMDGFARGETGAYAGKPDLNAYYIGGYWTHIGPSGWYVDAVLAGTRYEQKAKSSNDLRTEAKGWGVTASVEAGYPVPIGEKWHIEPQAQLVYQRLTVSNGEDDVSSVSYRTPDSVTARLGARLSGQYAYNTTQLRPFMEVSLLRDFAGTDTVTFSGIDRIDSRYQATAVDLTAGLVAQVRKDVGLWGQVGYGKSIGGGDGSDRGWAASLGLRIEY

SEQ ID NO: 16518 - protein, 213 aa, Salinibacter ruber
MVCYYVYIVSKQGDMAKKSTHINNLFVHSNFKEIDMKTLQKTLLALAAGSLLSMGAQAAVSYGNGYTGQPYVGAKVGQFDLDVDGAEDPTAYGVYAGYNFDPNFGMEAEFVGSDDADYRGGDINAKSYGAYGTYRYAFPNTGLYAKGKLGVAKTEVERANTTANAFNGTDKDTSLAGGLGLGYSVNPNFSVEAEYDKLGSDADLMTVGAQLKF

SEQ ID NO: 16519 - protein, 354 aa, Salinibacter ruber
MKRLIPAVALAGMFVGTVHAETSVTLYGIADVSVRYLSTGNDNGNSRVSMENGAISNSRWGLRGVEDLGDGMKAFFRLESGFNVQNGERSDPDSFFNRHAYVGLDGGEIGAISLGRQDTPLFTILADSYDPLTVGNYAQNSWLPVAMSRARSSNSVRYRNDKLAGFDVILSYAFSDSFEDHKLGEQYGGTLSYTTGPFSIGGGYMLTHSASNSDYQQRVWNLNASYKFETAKVFIGYFNGRDETGFVNAVMGNTSLPDNGLERKDNGYFAGVTWQATPRWALTGAAYYDTSKNLVEEGDKGKRYALVGVAEYALSKRTQVYGTIDYNKVKDAATGEIQGDDKQIGAAVGIRHIF

SEQ ID NO: 16520 - protein, 799 aa, Salinibacter ruber
MHSVEFGRSRPKKYRANYLSLMGLSFTVILSITAPQPSQAQTVDVDARQINKLQHYQIKAGTLDAVLNSFALAANIDLSISSALTQGKISPGLEGQYSIEEGLQKILAGTGLQVTSRLEGQYILGKATVAIVLAPITVISAAGYEQDIKNAPASISVLSGNDLEQRKFNSLQDIAREIPGVNVIGSGAQSGISIRGMEKGYTLVLVDGKRVRSDTGNPRGLNNEDLDSNFIPPVASIDRVEVVRGPMSSLYGSDAMGGIINIITKKTPEKWSASAGYGLRVPDSSSMGNQNQQDLYITGPLVKDLLGISLWGNQAVQDEDKYYGGYQESTKKTLGSKLRITPHRDHEVILDYSKASQRYIGNPGGVLLPNARGSIDREWTRDAWSIAYNALFDLGELELKYYEEDYERLTYPAAADFTTGSTNKVSDARFITGVDSHTLTFGGQWTNDKLTNGDLGNGSPRSFGTRSVSDFSIFAEDEWELLTEKLYLTLGARLTDNEFFGHHVSPRAYLVFNHNDHWTFKGGIATGYKSPKIDQIDNTTGSQRGGGTSQFVIVGNPDLEPEQSTNYEIGALYTKDDTLNIGATLFFNDFSNKILNTNTFYFDDGNGGYIPAYCISGDVGTKDCPAWATWLNAKGAQIRGVELEGHWDMTNTLALKASYTYTDSRIDADNVIINTPAGPRPFGDTLALLDGNSLVGIPNHNGSITLDYQPTEALSAFLRGNYEGEITRVSFERNTVDKSDKDLITLDAGLNYSLNRYISFNVGIDNITDATRFKVNNDTGAYRYSERGRSYFVSVKTQF

SEQ ID NO: 16521 - protein, 321 aa, Salinibacter ruber
MSGARLHTLLPELTTRQSVMVVGAAVIDVIADAYALPWRGCDIELKQQSVNVGGCALNIAVALKRLGIEAGNALPLGQGVWAEMIRNRMAKEGLISLIDNAEGDNGWCLALVEPDGERTFMSFSGVENQWNRQWLARLTVAPGSLLYFSGYQLASPCGELLVEWLEELQDVTPFIDFGPRIGDIPDALLARIMACRPLVSLNRQEAEIAAERFALSAEITTLGKQWQEKFAAPLIVRLDKEGAWYFSNDASGCIPAFPTQVVDTIGAGDSHAGGVLAGLASGLPLADAVLLGNAVASWVVGHRGGDCAPTREELLLAHKNV

SEQ ID NO: 16522 - protein, 773 aa, Salinibacter ruber
MEAPLDNGCCDLLAIYSRTRIVVKEPDSFGGCGQLFRNVLLCKSHRPNKTKPLRAKSLSPGGVYPQSRGKGHNLRGHIRKVLISMSVRIRTKIGTYALFVLAGFQLVGGLASAQIIPTRDSLAKPSQAARDLLAAPTVGPIAQVPSTPQPDAADPDGATTLDETLVEGRLAPRRSTPVFTITREDIQKKAAVNLADALRGVPGFAINDAGRGADFHNGSYYRGATVNQSALLINGRQIKTGLNSNHGATDYNSIPVEGIKRIELLGPGAGTTLYGSDVIGGVINIITEEGPAVPTFSGSAEYGSYGESIYRTSYGGTSERLKYNFGYQSYGATNNFPVPVGSTNRGEDGRLMNADMYTASYQGSATYTFDRRNNLTFDLFKNLSRKGLIIGNSKDRLDRDGLNVGLTWRTLLGEGNDSVLVTTLGYVDDFFSTYGPVQTDYFKAVQLASKFYQARIDHTWRTSPGNTLRWGVDTRHNTLLSTQNNTSPDPIFFGLGGTTDTAITNTGIFALDTWQIVEGLQLDLGLRQTFDSKFGSYLNPSAGLRWQIIPEVALRASYASVQRNPGPDFLFLPDAAEGFLPNPDLKPERGSVYNAGFDLRFADNLRGEVTYFGSLIQDRIGNGPLPADPTLTQRTNIGAVGTNGVEAGIKWQIDPQWSSYLSYTYTKIKIEEGRSLGLLRFLPESVGQVGVGYDNQGLQVNVFVNYNSGAARTNALTSYTTPFATIDLRAAIPINRALALTVYLANLADVQYERVNTFYSPGLTYRVGLQTSF

SEQ ID NO: 16523 - protein, 194 aa, Salinibacter ruber
MDRTRTVTLVGISALCLSGAVMAQAPTAGDSYAGGQIASATYGEDDVPQLGITVDGDADLTGLVGRVGTYVSEYVSVEGRAGFGIGDDSVTVSEGATSVDVDVELDYLFGGYVRGHLPVGDALALYGIVGLTGGQMTAEANGFSYSQSDTGASFGAGVDIHVGDAASANFEYMQYLDEAGYEIDALSAGLVGRF

SEQ ID NO: 16524 - protein, 663 aa, Salinibacter ruber
MLLRRKKILAQLVSAALLLPATQVLADAAPDQDKMMERIVVTASGFEQQVRDAPASISVLTREDLDTRFYRDLTDAMLEVPGVVVTGGADRRDISLRGMGSQYTLILVDGKRQSSRETRTNSDGPGVEGAWTPPLAAIDRIEIVRGPMSSLYGSDAIGGVINIITRKVPNEWQGELRLDTTLQEKSDSGNVYQGNFFVNGGLIKDLLGVQLYGQYTQREEDSIYGGYRGRDADNLTARFALTPNQDHDIMLEVGIANQELDSTLGKTVAPLAPGASCGRSGCPASSTTEYENSTISLSHTGRWDFGTSDTYIKHEVFDNKSRKMKIKNTDAQTSLIATLGESHTTTFGAAFNKQDLTDETGNQVSDLTDISRRQWSVFSEDEWRIVDNFALTLGLRLDDDENFGDHLSPRIYGVWGLTEHTTLKGGVSTGFRAPSLRQTVPDWGQVSRGGNMYGNPDLQPETSVNYELGIYTDLTDSITTSAGVFYNEFEDKITRVACPATQCTDGPNQFGSDPTTYVNIDEAVTQGVEFSIDYKILSNLALTGNYTYTDSEQKTGAYKGSPLNQLPKHLVQLSVNYEPIDKLSTWLRVNYRGEESQPTTGPSSSSLIAPSYTLLDLGANYRVNDSIKFSAGIYNAFDKDITEEEYGYIEDGRRYWLGMTYSF

SEQ ID NO: 16525 - protein, 722 aa, Salinibacter ruber
MHESKPNREARSGDLASVSSHRQWPFNLALQAISLAALSNSAVAQTPTPEVPITQLEPIVVQGNYNNSIGSSDAASQGTVTAKLIENRPTLRPAEVLEFVPGVIVSQHSGDGKANQYYLRGFNLDHGTDFATFVDAMPVNMPTHAHGHGYSDLNWLIPELVDRINYRKGPYYAEEGDFASAGAAHIRLVDTLPKGIGSITFGENGYRRGLLANSGAVGDGQLLYALESGHNDGPWDNPENFRRLNGVLRYSFGDAQTRSVITAMGYSAQWSSTDQIPKRAVDRGLIGRFGALDPTDGGETSRYSLSYDLTHKLDDGSFKFSAYAVQSRLNLFSNFTFFLENPVDLDPTVANGDQFEQAERRKVVGLNTSRSWNTSFEGREVINTLGAQVRHDRLDPVGLYSNVARQRVSTTQESRVRETSVGVYGENATQWLPWLRSVAGLRFDRFAFDVDSSIPQNSGKKNDSIASPKLSLIIGPWSKTEYFANYGYGYHSNDARGATAKVAAKDPTVAVQAVDPLVRSKGGELGLRTELVPGLQSSLALWHLKLDSELLFVGDAGETEPNRASKRYGIEWNNHYVVRPWLLFDLDLAASRARFSEDDPDPTVGNHIPGAVNRVASLGVTVTDLGPWFGQFQLRYFGPRPLIEDNSVRSSATTLAYLRVGYKVGTDVKLALDVFNLFDRKASDIDYYYPSRLQGEPAGGVDDIHFHPVEPRSLRLTLTANF

SEQ ID NO: 16526 - protein, 878 aa, Salinibacter ruber
MKRWCLSPSIHLWFIISLCGYFNIIAVQPVWAKDQPNPQDTETIDIPSLSPKQKNNSPIPQLSEIKLPGTSAIMLVQTPSGDIVPITGVKANPTEKGVEVILETTLGEKLQITNRSEGNNFIADVPNAQLRLPSGEAFTFRSEKPIAGITEITVTNIDANTVRVTVNGETALPTVELFDGDEGLIFAVASTTTATQQPQEQPTSQTPPAEPTAQQDEPIELVVTGEQDRYRVPNASTVTRTDTPLRDIPQSIQIIPQEVLRDQRADISSALLNAPSVRNAAPSNFDSLRLQVRGFFSQPTLNGIKETNGLASNVGPDLTGIENIEILLGPNSVLLGSTSPGGTVNFVTKQPLRDPYYFVEATVGSFDFYRGEVDLSGPLDDEKKALYRLNASYRDQGFFTDLSQTRNLVIAPVLSLELSKNTNLTIEGVYKNLEQENNNLGLPAIGTIFSNPNGDIPRSRITNEGELDVTTARIGYRLEHKFNENWSLNNSFRYGYVNYDGIGLNVGTRLLADNRTLLRTANDSNDRYRDYRLTTNVIGKFTTGAIKHQLLFGIDLGRLNNSLKFTGRSGAPIDLFNPIYGQPVGAITFESDTNTVTDELGIIIQDQVAIADNLKLLVSGRFDTFTQTDKDFLAGTETSQSGSAFSPRVGIVYQPIPPISLYANYSRSFQPAIGQAFDGRTFKPTRGTQFEVGVKADLNQRLSTTLALYDITQSNVLTDDPNNIGFSVQTGEQRSQGIELSLTGEILPGWNVFASYAYNDARVTEDNSIPVGNRVQRTTPHAASLWTTYEIQGGNLQGLGFGLGLFYVGDRAGDTGNTFEVPSYLTTNAAIFYKQDRFRAAINIRNLFDVDYFENAFNRLRVSPGEPFTIQGTISWTF

SEQ ID NO: 16527 - protein, 727 aa, Salinibacter ruber
MERRSLNLHFMTCSKTALASSIALITSVVYANEAEVSQLPTITVNATQNSDALYTSKKVSLSGFQTGDVKKVPASITTITSERIADQHAKILTDVIKNDSSLGDGYAAIGYYPNFVARGFALDLGSSYLINGHTIRGEQNVALENKEQVEILKGISAIQSGMSTPGGVVNYVTKRPADVKNITVDANSEGGYTLATDVGGFVNDSFGYRINLAHESIHPNVHHANGKREFGSVALDWKINERSKLLFDIEAQHQSQRSVPGYQLLDGQEVPTNVDQDRLLGYQSWSKPVVNNSLNASLKYQYAFNDQWNGSLSASQSRVVIDDYIVFPYGSYYSSGNELAVFDKDGNYDIYDYRSPDDARITNQFAAGLNGQFNTGNIQHQIAFELQHTYKTLKHHTPLNGFIGTGNIYENTVDYNPSLESPGDRYKALQSDQTAFTVSDRVQFNDHWSTLLGGKLIHLDEQAYNSDGQQSRDTDLNKFLPQLALMYSPTATTNLYASYAKGLSDGGEAPWYTNNIKNNIGPSVLSPRSSEQYEIGIKQQIRNFLVTAAIFDLKQDNQYSKVNAEGTFDFVSQGEQHNQGIELGLTGALTDKLDISSGITYTKSRLVDIDTDSYKGHQTQNVPKVRATAQLSYKVPSVEGLRLLSGMQYSSSKYANKEGAAKVGGYSVFNIGAAYKTNFAGHDTTFRFNIDNLFNKKYWRDVGAFMGDDYLFLGNPRTAQFSTTFSF

SEQ ID NO: 16528 - protein, 659 aa, Salinibacter ruber
MSTRHATRSTRYPALFLPAAVSLLLAAPLQGIAGEPTDTTNTTDAASDRHALGTVKVSGARNTSLAGELPTGTVVIDREAIDSLPATNLADLLDTVGGLQSSRLYGINGSNASVDLLGFGATGNQNTLILLNGRRLSNIDLTTPELTGIPLAAIERIEVLPGAGAALYGNGAVGGVVNIVTRRSYRNSAGLEINSGSYNSLGGNGYATGNHGNLSGAVALSTLDSDGYRDNNALRNDSAFADLRYQQDRVEAYFTANGTRQSQDLPGGRDPMEFNNDPQGADTPDDDAEQESYWLMPGLRIAMAGNTALTLDASRRRQTQEYRYPSSGFNGESVVDSYSFTPKLEGQTATGSAMHNWTLGVDLHEYDYTSRTNFGDRELEQSQRAWYLHNLVSLTPKLSVSAGARQLESTLSGEGADKEQDGEMYEGGIRYTFTGNLALFAGAQRSVRIANVDELSPFNPPIDPQTGHSYTTGASWSQGRQHSTLTFWRAEIDNEIVYDPIAFANRNLDDRTVHKGVSINSRWRLDKDITFTANASAQQARFDGGPFSGNDVPLVPEHTMELIADWQALTWLSAQISHRYVGDRHYDGDVDNEYRKLDHYRTTDLQLTARYRKLYLKAGVYNLEDNVNADYGNYNPGSSNAVLYPLPERHYRVALGMEL

SEQ ID NO: 16529 - protein, 983 aa, Salinibacter ruber
MDGKFTLSAFPNQELEVSYLGYQNARIKVTDKSTYVIRMKPKIDELEEVTVVAFAKQKKESVIASVSTIKPAELKVPSSNLTTALAGRMSGIISYQTSGEPGKDNAQFFVRGVTTFEGETRANPLILIDGIEMGTDDLARLQTDDIASFSVMKDATAAALYGSRGANGVILVSTKQGSEGKAKVSIRYELAMSRPTRTVDLADPITYMKLHNEAVRTRDPLGALPYSEEKIASTAAGLNPQVYPAIDWKEMLFKDQAINHRFNFNISGGGKVARYYLSGSYSKDSGLLQVNGKNSFNNNISLQRMIMRATVNINMTKSTEVVVRMYGTFDDYTGPLKDGSKFYEMVMNTNPVMFQPVYQPDERYKNAPNILFGNAGTNADYTNPYAELVKGYKDYSATTIVAQVELKQNLEFITKGLNARVLANTNRYSYFDVSRQYVPFFYRLDSYDKFTNTYQLSALNEDKGSEALQYTEGPKTINTSYYLEAAVDYNRVFNEKHTVTGLLVGTMREYKEANAGSLLLSLPHRNIGLAGRATYSYDSRYFGELNFGYNGSERFAKKNRWGFFPSIGAGYIISNEHFYPESWKKVMNKLKLKATYGLVGNDAIGNTKDRFFYLSNVNVADAGKNIAFGTDLSYSHPGGGVSFVRYPNEDISWETAYKTDFGVEIGLFDKVEIIADYFSERRKNILMTRAHVPSFIGLQTNPSANVGEAKSHGFEASVDYNHSFSNGMWLMVRGNFTYATSEYSKYEEPDYSDTPWRRREGNSLAQTWGYVAERLFVDEADVANSPVQSFDNQKAMAGDIKYKDINGDGQITETDMVPIGYPTSPEIIYGFGFSAGYKGFDLSCFFQGSARSSFWIDPENTAPFIGNQRTLLKAYADDHWSEENRNLYALWPRLSATKRTNNYQKSTWFMRDGSFLRLKSVEMGYTIPEKITKKAHISMLRFYLSGTNLLTFSKFKLWDVEMGGKGLGYPVQMVINAGVQLNF

SEQ ID NO: 16530 - protein, 1588 aa, Salinibacter ruber
PQQIGTVIVPEPEINTYTPSEIREMKISNKPKASNPLKDVPIEDHYKVVARSKSDVGKARKVRPITRRKTFAGTEKTAQSQSTYTPESIEQMPQKSEIIITESSPTFSPDSNGFVTAPNTPNTTLTSPEHYTTAPGTPSSTPATPYQSTSDSKPNDSLGANTPPNINTNSKAVRRLSFSSSGPQQQAVQCSSSQVKSEVPPKPTFVPLPTKKSSTEIAAGMVSNISRINEIIGIKLAEVTQAIKDTTGKKNKKPLQKLYKQLTSAQKITEELKSRAEEIETKIKIGKNKDKIKKLEKELTSKNNKADRLFQKIEKIDIPANKVSIKSQETVPVTTASTKVSAFQAQQARINEARQGVFNKNKSSGDNARKSSARTEREKKKQEAQKQLSEIKKQEKAIKTASDKAKEVAASVKKETSRTALRAMQDKMNGDFDGPTYKAGAKKQSPTQYHLSHGVQRILGEQPEDEEGYLVPRKVQQQPYSVMLPNQEIEDPIPSHSQDIYESKVSQYINYLNSIQPNQLNQAQIDSVIDGLATEMRKFSADQFSQKLGEIAHLASIKAYEGLFEKLYEIQQARIPKTQKVYEQEEIFQSYAEYEENLRKSSTPVLSRSSSAKSVISSNFEEKSALLQTTTTDESLRSDNNWKNSAPYSSSPKLDKRGLEYLDLAGDAFVQNLKQPDTLTIEALSLITPTQNTTVAKSDSSRKNNVSGSIPEIQQLQSEKMRTETLGVQDDLELYLHYTPQETLTEESTYLVSSKNKQGNIIKRAVSKVGSILQTNYAENRKRKRDGETSKQRTVDQEGEFGHAWGNENHNVVSGFTKKATQLISLLDAKRTAILQTTSPSQRKSLSLVLQEIENDYREAIKISQELQQVLIRKPEDIKAYNSKAEKKLDAIKSRADKYFNNIETDADVGFNPNGGNSHSMPPANMDSLPKNLAVTPTINVGSLYNSPQAQQFREDHKNIIINDRSQGRLNLVDSTMVRELTDVDASIYNTAPPEVVKEAEALLDRSQGRLNLVDSTIKKGTQPLSNLSTIYESVSYENLASETIYKTEQPKPSISYTNTSKRELPIPLFRSADLDKKLEYLDLEDKLLEVEEARIVKEKQAIATLDQYQDPENPEFKRLAMEALDLSSKESQLKAKRKTIAAEFSLNEKSSSTDVSILRSYSIDDISSVISDAESNLSRSPSVSGLEDLNNSNVMKLGELKSKHKKIANDYKAKELELDTLNHDDPEKIWLEGEIKHLDTESKPKVTESKPVFSCSSSVGSINSFSNGDDLSSRDVVTSVDTLTREIDKDYVDTYIRVLSNKIQGIEELPGSSSRSEELNHIKEAMAYISNRIQDVEELDEKMLLAINARLQEHDEKISSLLLEKYTGEEAADILAQSLLQEMLVSDGKSESILPAGDEEQEDTEVNRQLSSLPALASSNESALALSDDREKECLALGDGSEDEESYDSGFEEEEETIGQLSDSDGGNLKITEVDTAIPLEQEAKKEMQTQISENAPTLNQAKVVNTIVNNMIRNRLDASMNMSNNMVAVGAGDEEESHIKRGLWMRGMYGTNNHGRVENMTGYRGTNKGATIGFDAEIDNNIVGIA

SEQ ID NO: 16531 - protein, 684 aa, Salinibacter ruber
MAALTADLPADAPTEASSSARPSRASAAAGSAPAPREPAAPRSELEEDLALYSAEDTLALATRHEAAVRTVPAIGASFSQQQLRSLGARTVADVLDVVPGLSVSRDVQGFHRTAIRGLRNDAEVLFLLNGHRLNSFFDGKALMNLPVESLERVEVISGPGSALYGAGAFLGVVNIVTDTSDGVRTAVSVGGYPGQDDRLAVTGNGHISAGHTAGNLRVFADIDVWSQAGDSTVIENDGLDDESRSQGLRDVTDPAGRTRDERFLFNAGAGVTYAMGDAGRLGASARFLTERRSALVGLFDTVGEDSKLGWNVFLADLTWERSFGPDVTLRARAAYDQQSTDRFFQITPHDFSAGTGANRLFEEGMQEQTRVSVRSLTGSVDADVALGAYNRLSLGAVVDQQSLGEYDYVTNYTLDAQVRPDGLTRPEGLVDLTSGAASRRLNVGLFAQDQWTVVNALTLTFGVRMDATQLPTVDASGAINGTRFVPTLNPRVGLVFAATDALVLKALYGRAFRAPTLQELVERIPDTEYNQGRFEGNPRLQPATVDTFELGADLIQSAGDARVRLRANAYVALFGSPIVPVDTSGNIVPLRNRELGVRVYGVEGEARLEASKRAYAWLNASISRAEDLELPAQSRLLTDTPQARFNAGVTMPIGAYVNFDVVVRTGAERRNNSRSVLELIRRYK

SEQ ID NO: 16532 - protein, 901 aa, Salinibacter ruber
MRVGSRTGIHAASRLALAIHLGVAGLLAGGGLLHAAEPVGAAPQSAQQQREMDFDIPAQALGSAVLVFAEQAGVQVLFDSLRLHGLHSSPLKGRYSAEEGLARLLGNAPVQYRFTGERQVTLNRVETGRDGALALAPTTISGNLEGRQSDWVYNAPRSVSVVGREQLDRNPPRHAADMLEETSGVYSAVSQQDPGLSVNIRGLQDYGRVNMSVDGMRQNYQQSGHQQRNGTLYVDPELLSEVVVEKGATSTMGGAGVIGGVANFRTVEARDLLKPGQEIGGRIRVTSGLGGRSNGTHFIGSTAFAIGTEVWDMLLAASERHLGDYNPGTKGGIGELRTGSWMDPSINDRVKNSKVAYSASVMRSRLAKLGLNLPQDQRLQLSYLTTQVSYDDANMMNVENKQQLWEKLGSSDVRSQNFGLDYSYTPDNPLIDFKAKLYYVDNSNDQSTLTRRSSPGYSITYQTDTYGAQAQNTSTFALGELATLKANYGLEFFYDKVRPDSSQPVPKGSAVSASPAASMTPEGDRALGSLFTRLDFDYDGWLNLNAGLRYDRYRLRGETGINTRTFVIGKTPQQISVPVAYDIDNEEGRFSPTFGLSVKPGVEWLQLFASYGKGWRPPAVTETMITGRPHGGGSESTFPNPFLKPERSSTWEAGVNVFKENLWFNDDRLGIKVAYFDTRVDDFIYMAMGVQPPGYGSPGIGNSAYVNDLSSTRFKGVEYQLDYDAGRAYGQLNYTRMIGDNDFCTKVAWLGGVTQPVKNGSGRGAIVTGMRPDDAANNASRCNAAILGSAEHMPMDRGTLTLGARFFDRKLDIGARARYSAGYSIAGSATGTVSQTGVYPADWKPYTVYDLYGSYRATEELTLRLAMENVTDRAYLVPLGDVLAFTLGRGRTLQGTVEYQF

SEQ ID NO: 16533 - protein, 825 aa, Salinibacter ruber
MSEVFKRGRLATAVKVALLAVTTVGAWSTATVEAAVATQHSAVRSFDIPGGSLTEVLGHFASAAGAAISFDARQTDGFSSSGLKGAFGVIEGFSRILAGSGLQAEPQANGTYVLREVPSAGSAMELGATNITGQVLGATTENSGSYTTGAVTIGKGEHSLKETPQSVTVMTRKMMDDQNLYTIDQVMEKTPGITVYDSTMGGKYFYSRGFRMSGQYQYDGVPLDMGNLYVQADSFSSDMAYYDRVEVLRGAAGMMKGSGGTAGGVNFVRKRGLAAAHTDITLSGGSWDNYRGQLDTGGPLNASGTLRGRAVIAEQSRHYFVDDANRKDQVYYGALDFDLNADTTLGLGVAYEDVDANPCWGGLPRYRDRSDLKLSRSTCLDPSWNTWRSQRTTVFSDVSHQLDEDWKLKVASVYTKNTQDIKYAFASGAVTPGTNTTGMLGSMYDYDQVDYGLDAYVDGTFDAFGQQHELVLGMNASRSNKDDFYSVAFLPQRQNVFNPDKFIPEPDDSYFIDNSSRGGPVKSKTTQKGLYSTLRLKLADPLTLVVGGRVSWYTSTTDSDFINTGTSEHSSTRETGQVTPFAGVLLDLNENLTAYASYSDIFTPQGNYRSEDGSALKPLVGQSYELGIKGAWLEGRLNGAFNLFRTIQKDQAQTDYNSSCPSSDGYCYVNAGKVRAQGFEAELSGEIIERLQLLAGYTYTQTKTLDDIDSSLNGAAFNSYVPRHVLRLWGEYTLSGAFERLSIGAGVNAQSDNFRVSPASGEKIDQAGYAIWNGRIGYRIDDTWSVALNGNNLFDKRYYTSIGTETFGNYYGEPRNFMVSVKASF

SEQ ID NO: 16534 - protein, 207 aa, Salinibacter ruber
MCRIAMTAAAVFAAGLVSAQAADLSYGRSYAPYTVNQPLNAYSWAGPYLGGNLGYAWGDIHNNSAKPSGLSGGIQGGYNWQSGQMVYGLEGDLQITGANDTFAQYKFSNPWFGTVRGRIGYAFNNVMFYGTGGLAYGELTAEMGGLSQSHTNAGFTVGAGAEFGLMPNWTAKIEYLYVDLGESNFSLTTRSHSYEFGIVRFGVNYHF

SEQ ID NO: 16535 - protein, 677 aa, Salinibacter ruber
MVNEPQSRWRVICAVLVLCATFRLCAQTPSDWKDQSYAYSADHTMLSTLLQDFADGHGVDLQLGNIEDTEVNGKMRADSASAFLDRLALEHRFQWFVYNNTLYISPQDEQSSERLEISPDAAPDIKQALSGIGLLDPRFGWGELPDDGVVLVTGPPRYLSLVKRFSEQRQKKEDRRKVMTFPLKYASVADRTIHYRDQTLVIPGVATMLNELMNGKRAAPVSASGAEGTIGGADNAAMMQNTQSLLARLSNHANNTNRPGDRDNNSVDDLSGRISADVRNNALLIRDDDKRREEYAQLINKIDIPQNLVEIDAVIIDIDRTALNRLEANWQATLGGVTGGTSLMSGSGTLFVSDFKRFFADIKALEGEGTASIVANPSVLTLENQPAVIDFSQTAYITATGERVADIQPVTAGTSLQVTPRAVGHQDHASIQLVIDIEDGHVETNNDGQATGVKRGTVSTQALISENRALVLGGFHVEESGERDRRIPLLGDIPWLGRLFTSTRHEISQRERLFILTPRLIGDQTDPTRYVSADNRQQLSDAMARVERRHSNVNLQDMVENALRDLAERQTPAGFKAEASGERLNDICQSTPGLLFDNARGQWYSSDSGSLRLSVGVVRNITHNTLRFNEASCAGKRTLAVAVWPHSSLAPGESAEVYMALQPHRNIAVTRESLINH

SEQ ID NO: 16536 - protein, 714 aa, Salinibacter ruber
MAQTATQIHDPSQVQQMATVQVLGTAEEEIKESLGVSVITAEEIARRPPTNDLSDLIRREPGVNLTGNSASGARGNSRQVDIRGMGPENTLILIDGKPVTSRNAVRYGWNGDRDTRGDTNWVPAEEVERIEVIRGPAAARYGSGAMGGVVNIITKRPADRATGSITYYTNQPEDSREGNTNRVNARISAPISDTLSMRLYGNYNKTNPDARDINAGHANTSDNGNPSTAGREGVINQDLSALFSWKADSRNTVDLDMGFSRQGNLFAGDTMNNANSDFSDSLYGKETNAMYRENYALTHRGVYDWGTSRASVGYDYTRNARQREGLAGGPEGAPTAGGYDTARLKNWRAAAEASVPFHLGFEQVATVGVEWLRESLEDPAGTRQTYTGGAIGGTAPADRDPKSRQTSYALFAEDNIEIDERTMLTPGVRLDHNSEFGSNWSPSLNASYAVTDALKLKGGIARAYKAPNLYQSNPNYLLYSRGNGCLASQTNTNGCYLVGNEDLSPETSVNKEIGFEYDPGTWRTSMAYFRNDYRNKIVAGTDVQYRLANGARVLQWTNSGKAVVEGLEGNLFIPLASNLDWNTNFTYMIQSKEKATGEPLSVIPEYTINSTLDWFYTPQLSFQANLTYYGKQEGPSTNVRTGVELNGDGRQTISPYALAGLSMGYEVNRNLKFRVGVSNLFNKQLYREGNASSAGAATYNEPGRAYYATATVSF

SEQ ID NO: 16537 - protein, 816 aa, Salinibacter ruber
MAQGNNLSIEEVVVTARKRSENLQEVPIAISAIDEDTIQRAGIQRAGDYVGLVPNVTLVDSANVGDTQLSIRGIISTRDAESTFAYVVDGVLSTNPNSFNEELFDVQQIEVLKGPQGALYGRNAVAGAILVTTKEPTNEFEARVGGTVGNVGTLRGNAMFSGPIVKDKLLGRIAISTSETDGFYENIFTNQDDVVDYLEDTSIRGRLKWNVTDNLSLDFRGGYSDVSAGAINFNAGFAIPAFVEAFGAPNYNQDVNDVDFRFIFNTPGENEQTTTDFAVKLDWALDFADLVANVAYSDLEESLLSDGTAATFYGYELTPSCQAGRGELNSFTRPDLFGEPFNPFGVLPPGADFQGVYGPYNPLTCDGYQYQERNQEDISIDARLVGPEDDAIRWIAGVYYADIERESLVAYGADQGEGFLKQPYVDPTGPNPTDLLFWDEFNTEVYAIYGQLEFDLSDTMELAFALRYDREEREVSNKVPNVLNSGLNVNLLDPATGAPLPINPAFGNNPNGIPDRARDFSQFQPKATWNWAATDAVNVYASYGLGFRSGGFNAIGTEDLLNFWFNAGFGGPGEVVDAQLQVTDDYDKEVSTAFEVGFKSEWMDRRLRLNAAAFRTDVEDNQFFEFYAGPFGILRTVTTIDDLYIQGIEADFTFVATEYLTVYGGLGLMDSEIEKNEHRPLSEGNDVPQAPETTGNLGAELSFPVGGNMQLVSRVDWQYTGEMWFHTLQGEETPTIWNAFFGPGFNQNFSKSSRDAFSTVDLRVGLEGDNWAITAWGRNITDEEYLQEVIPTPEFGGSFLHPSALRSYGVDFRYSF

SEQ ID NO: 16538 - protein, 749 aa, Salinibacter ruber
MHAPSPIDHHRHHHATASKRGSNVARTRGKPRETPAAPAVVEAAPAPLQGALPIVADQFATVTAVTNEEIRRSGAQTLGDLLNDKPGITGSSFAPGASSRPIIRGLDVNRVGIVENGIGSNGASDLGEDHFVPIDPLTTNQVEVIRGPATLRYGSNAIGGVVSAVNNRIPDALPCNPITPAQTWGYAVKAPPSGNGGYCGSFESRMGYSSIDNGREGAVLLDAATSNFAIHADGFGRKTDDYGVPNSPYRFEPGHPFNGTQANTGTRSYGGSVGGSYFFDGGFIGAAIQQNNNLYRIPGEEGEELGTRIDARQTKFTAKGEYRPDAAAIDTIRFWAGVTDYKHHEIGLADAGDPLSDGIRQTFTNKEQEGRVEVQFAPVNLRFAAMTSALGVQASHQELTAPSPDDIGSPLNGLWDPNSNTRIAGYSFNEFAFNNTTRAQIAGRIEHVNLKGSMPAFIPDVFDINTNPGDIGPSLSRNLSFTPASGSVGLIHDLPYGLVASITGQYTERAPKPAELFSRGGHDATTTFDIGNPNLKIESARSIEIGLRRATGPFRFEITGYATKFNGFIYRNLTGNKCEDGVCDADPTLELNQAVYAQRNAYFRGAEFQFQYDVMPLWAGQFGVEGQYDIVRATFDDGSNVPRIPPQRLGGGVYYRDANWLARINLLHAFAQNNVSGVETTTPGYNRLKAELSYTTKLAKNDWWGAQEMRVGIVGDNLLNEDIRNAVSYNKDQVLLPGMGVRLFANVKY

SEQ ID NO: 16539 - protein, 225 aa, Salinibacter ruber
MRAWAVRVWIVAGFLLASLPAQPVRAQDAASTTPQDDGFYLKSTTGWDRGLGSASGLPVSSDLNLGSALTLGSPLSGGIAAGWRPMEMLRLEVEYMHGRADRGSVTDLPAGADRLDRQSVMANALLDIDLSGWVTPYVGVGLGLTRLELDAGRLDGATLVGRDDIISYQGIVGFSMPFSEQLSFFADGRYTGFSDIALDPGRTDAGNDLQSWSALAGLRYRFGGP

SEQ ID NO: 16540 - protein, 444 aa, Salinibacter ruber
MWRAFRKISLVYFLCGVAYVGSSQAQDAEHFYLRLKQAPLVEMLQYLALQQHQDLLIDDHLEGTLSLQMKKTTFEKCLQSIARMKQLELHQEGKSYYLTSPSGVAANDTHHPTSLMTSSIKLHFAKAAEVVKSLTSGQGSLLSVGGSLSFDERTNLLLIQDEPQSIQRIKALVAEMDKPIEQIAIEARIVTMTDESLQELGVRWGLFQATEQAHTIAGSLAANGFSNIENQLNVNFSTNSAPVGSIALQLAKINGRLLDLELTALEREKHIEIIASPRLLTTNKKSASIKQGTEIPYVMKRGKDKSESVEFREAVLGLDVTPHISKDNTILLDLLITQNTLGAPVVYDKGEIVSIDKQEINTQVVAQDGETIVLGGVFHDTMTKGVNKVPLLGDLPLLKHVFSQKTERHQKRELVIFVTPHIIKPSQGSPEQKTTRVKKSAKSR

SEQ ID NO: 16541 - protein, 81 aa, Salinibacter ruber
MAYSRVSTFSGDYLRVTDNKGKTHDVLTGSDDGRHSNTSLAWGAGVQFNPTESVAIDIAYEGSGSGDWRTDGFIVGVSYKF

SEQ ID NO: 16542 - protein, 180 aa, Salinibacter ruber
MLGFNLSHAIDESEPNKLVGKKVQEALAKEKAKAKNQRADKSAFFAGLGYSGMFSWNLAYKDSFVLLRHYDFNFGGRLLERKDPSTILNGFNFKVGYQYAAPVKIKKMGFGVRGGFQYSYKAGNYMEKDKYQQHLFGVPIGIISPVSIFNGGMITMSTYSFFMDFYTMCMKMRSFSSVIL

SEQ ID NO: 16543 - protein, 730 aa, Salinibacter ruber
MAVPNKKIKKGTALAASAALVLVAQSGSLVRFGPSSAAAQLAADASQEVQLDELSVVGNGGPASGPAGGAGRRVDGYLAKDSVSATRTDTPLREVPQTVVVVPDQVLTDAAATRVDTALDLAGVGRGNNFAGLGLTEFTIRGFSTGEFYRNGFPINRGYPNSPDVVSIARIEVLKGPSAFLYGRGDPGGTFNIVTKQPLAERALSIGTQIGSFNQKRSTFDATGALDEEGRVLARVTGAVEDNGSFRNFVRGDRYYLAPVIAWKPTADTTITLEGELVSTATTFDRGVVPINGNIRALPRTFFIGEPGIPPVRNDNALGQLRIEHRLDPNWVVTAGAQALGGRLYGDGVGAMNVLGDGRTLRRTFEHRDLSWSDLDLQLNVAGKFETGPFRHTLLMGFEYDSYRYREIFNRSNANTNPFVLDLLTPRYGQVPLPQLGSITNFLQNTQSFGGYVQDQIDITPRLHALIGVRVEDLGLVSTDYRTGRTTSLQGTVATPRFGLVYDLTDAVSIYGNYGRSFRPNTGTDRAGRPFAFEHGEGYEAGAKFSLLDGTLSATAAVFDIRRTNVLTVDPVDPNFSVAAGEVRSRGFDLTVAGYLAPGWRVFGTYTHADAAVSRDNTLPVGTRIANIPADTLALQSVYEFQGPDLRGLGLGGGVTYVSQRVAGTALSTFRLPEYTVFNLISYYWVTPEVRVYLNVDNLFDTTYYDRAFQNRYATPGTPRAIMGGVAARF

SEQ ID NO: 16544 - protein, 1022 aa, Hahella chejuensis
MKHFLVFLLVFIGIGSVSAQQAKITGTVKDNTGETIIGANVTIKGGTGGTITDIDGHFSIDASTNATLVISFIGYTTQEVALKGKTNIVVTLNEDSQALDEVIVIGYGTQKKVNLTGSVSAVKIDEAIASRSISNVSSGLSGLVPGLVVNQSTGFAGSDGASLKVRGLGSINNSDPLIVVDGMPDVDINRINMNDIESISVLKDAASSAVYGSRAANGVILITTKNGLGQSKAKITYNGSYAWASPVEFYDYMNDYSRALTMHMRAAGTGNSSTNFRQGTVEQWMAMSMVDPILFPNTDQFDEMFRTGGTLNQTISASGGSDKMNFYASIGIMDQKGLQIHNDYSRYNMRFNLDYKIRDNFKIGMKSDGQWSETTAPRGSGLENAGLKYAVSGILNKHPETGEYGGAMAYGENSAAGNVAAEYEAYRTTTSRKEFNGNAYAEWEPLKGLKLNVSYALRYYNQFSKAVQNPLKQWNFQSNTVAREMPDNGGDGITDSNYEGYKTLFQGRISYDREIAPGHHITVMFNAAEEFWSDRQLGAWRKDRLHSSLEELNAASAAQQTNWGRSESEGLRSFIGRVNYAMFDKYLFEFNFRSDGSSRFAKGHQWGFFPSGAIGWRISEETFFAPLKKVISNAKFRASYGTLGNNSGVGRYEQKETMKTTNYIMNGKLVQGFSASKMINQDLSWESTRVINVGLDLGLFNNQLTAELDWYDRFTTGMIRGSSISSILSGYDAPRVNIADLRNRGIEANITWRSKVGKLDYSINVNASYNVNKLEEWGDHLDRGWTALNMPYHFLYIYEAYPGLVQSWNQIYNAPYQGNYTAPGDILIKDLNGDGQIDDKDKKAWKDKYRETPLGQFGITLTGGYKGFDIQALFQGSYGRADMWLDDLNNVSVPSDRYAFQSFHWNDTWSLDNRNASMPRLVTGSGGSYNRTESTFWAENMNYVRLKNLQIGYSIPTKLLKKISFERARIYLSAENVFTITPWKGVDPEKSISSWNQQYNRSDANDLYPLVKTYSIGINVEF

SEQ ID NO: 16545 - protein, 1508 aa, Hahella chejuensis
MKNSRKISLIFFTTLFTISNITITQTADNDPSALSSSSGGLTGSGASQSNNTTEGSNDNQGDTGSGATNSPSNPIEGASGTTPATGASDAAGDSDAAGNKEAARDDSVTDSGAAQGNNATEGSNDDQGDASSGAASNPSNPSNPSNPIEGASGTTPATGASDATEVSETTGGSATGGKVTDGKKPKKSPFKKLQEFGSTLSLSGHTKPEEQSEGATGGKGSSISTLKKIRKQLASSTLSLSSTTPEEPKAPIVLSDDTKKQVEINPNKGSGVQKVIVKQPKVAFEKMGGKNNSIEISVETSAEVIVKGEDCSKIKMANLNLTDSEFIVNNTLHSNSDLKPTSPITSSVSMPNLSDTDVSSSSSPPTRRSSSIIQHTGPQPFDLSFFSSTTHGGKTEGTDRSKFTGIGPFVVQSPTIVSSNLKICGNINVNKPLQLITVPPVVLKTLTVEQSKLVPTKKSGVLKLQSDLTANIEGKDATIVTSGNSKISFNKFGTPNHPIPVIVDGTLKLQAELQPGGSNEVNMYASITPKQQSGSEVHFLNSPKSTNLTRYNVHGFIGTPDSVTEKIVLDGQTMLNVTGNVYTGKVKINSPNKVSRGDRETHGCLVLNGEVYSKLIEPSIPNCGKIIIHGNPSKNDNPEYHKSIFYGNIGTDKNKIYAVEFAEHPNNPNGVNPHIDWFVSYDKSESKSTIFCSDIIFSNQEDTINILGNTDIKGNIGTKGNSGGKIIVRNNGTLTHSGGDIGNNKIMNHNSLQALYLCEGSSFISMPDYNSIPYSGSIKEITMSKNSNIKLNSNTDWKTNIVSSSTGATVTISQGSYSGNIGTKEKPMASVTLLPKSKRPSLIEVEGLVHTNQCSISDKSSAKSEMTLLGDYTVTAQTSDRSGSINVGNAKVDLGCNTLALVSDNIKISGHKSNKESSTNPKKFNKTSATVFSINYTTNLDGTVKTQGKLKLNKHHDPNNKIIVSVNHQGNSSDLTKHGPQTTIQPVDIADTGGENIHNLVYLCDGKCKWQKVDGSNGKFVFAGLVDKKKKDKGDDGASSSSGSSSVAPSARVSPEVSDDEEGGKGEDIQASTVSHLHSKDSAHSEQSQDKDPTEDPTEDAIEALARLLDDPAPPPQPADEQPQPDPDEHVQPVVAQPIAAGAGQQQQQQQQQQQQQQQYAYTSSPSSEDQEQSSEPSPALQPILQKISSDVHLKSGVRATVAAISSIVESKAANNKFRSDIVSSGSNINKQSWNIWADGFFSNVNQQDHENIQGYKTDISGISIGADKHLKNNAIIGAAISYAKFDTKHTDSRIEKINSNVYLLSLYGQYSFQSTTFIRGMVNVAKFSDDSKNSSLTLWQGHSYHGSLTAGHYFYPLKNNKKLTLVPTAGVKHSYFNTSCNNSVDSSSNKTIGDRSHKALEVIIGISLEQLVVNNANNNLNVLSTVYGYVHHNLYDCQDSAQLPNSNSTFNPDVITAHEQCLHKTFYQLGVKLAVKRNIMDIGIAYDVYLAEKYISHTGIIYAKASF

SEQ ID NO: 16546 - protein, 227 aa, Hahella chejuensis
MSHISLLSRVKAFNKSQGMFPALHSLLIMKKQLVAAAVLSTLLSGAALAQQATEGPWMVRARAVHLDSSNGDSTGLGLSVNNKWMPEVDVSYFFNKNVAVELVVTVPQKHTLRSSALGVDVGTLKHLPPTLLGQYHFPMNGFKPYVGAGINYTRFSSVNLLPGVDIDRNSWGPALQVGVDIPLSGNMYLNFDVKKVYIRTDVSLNGRNVGEFKVDPLLVGVGLGWRF

SEQ ID NO: 16547 - protein, 376 aa, Hahella chejuensis
MGLLAAGCIINPSAHAQSSVTLYGILDEGLTYTNNQHGSGAWQATNQNVDGTRWGLRGTEDLGGGWKAVFTLENGFSLTNGGAGSSSQLFNRQAFVGLASDGYGSVTLGRQYDSVVDYLGALALTGTGYGGVHSAHPFDNDNLDDSFRVNNSVKYTSVNYHGLTFSGLYGFSNQAGGFAANRAYSGGASYDFGGFHLAAAYLQLNNSGATVGFNSAGSVTGDATFNASRQRTFGAAATYSFDKGGVGFLFTETRLQNATGINAYASGTASGIGLSGGDVRFDNYELNGHYSVTPAITLSGGYTYTDGRLDGISPKWNQVNFLAAYAFSKRTDVYLQTDWQHVSGLSGTGIGADLIGLPASSTNQQVAVSVGIRHFF

SEQ ID NO: 16548 - protein, 1082 aa, Hahella chejuensis
MKQRLYDFIPVKHLCVGMSLCGIVAGTQTAQASPVFGQSSGLELPSPSIYQQSTKQISGIVKDQAGIPVIGANVIVKGTTNGVITGLDGDFLLEVPENATLEISYIGYMTQSIPINGKTTFNIILEEDTQKLDEVVVLGYGAGQRKQDLSASVGVLNNTEDLVARPVTSTESMLQGQLAGVTVQANGGDPTATPSIVIRGQGSQNGDNVLWVVDGVPGAPIASMNDIETIVVLKDAASAAIYGAQSGAGGVILVTTKKAKEGKTSLSYDATFGVRKASNVIEPLNAEEQLEMRKLSYANAGLTLPTGWDLTKNPWVGTTRTNWMDEIFRTAFYQRHNVALNVGSENASNRVSFAYDNDEGVLINTFNKNLSLRYNGKFKLNKWVTITEDVVWKNNESRSKDTDSGYTGVVAAAMYMPASATVYNPLDGTYGGTTTEDPDYIAKYGSNFADIHGDAVNPVRLLEAENRYDRTSDIWSTTSLELANIVTGLKFTSRFTYNLKNNLYKNFSPIRDEVGKPSLTNNLDETTYRADAWKTENTLTYDNTFNDMHTVGVLLSTTADHYSKRGLEVNGKDLSDESAYLQYLSYANSVSATDYLTGPDANVSLIARLAYSFNDRYFVTASWRRDYAGRLPKDNNYGDFPAVTAGWKISNESFFPKSETLNLLKIRASWGRVGNLGSIGYNYKSALLGKNYWSEQAQYGVESNKIWGNFVYNSTALNPNLTWETSEQWDLGLDVNMFDNRLSMAFDYFDKRTFNLIQSQTMNWPGTIGIDAMLVNQGEVRNRGFEAQINWNQQVNKDWSYFVSGNFSYLKNWVSDIGVKNADGTPGVWTGITKNDAYFDGSYRNLPYMYQTAEGEPLASFYLIKTDGIFQSDAEAAAYVNKDGKRIQPDAVAGDLKFVDANGDGVINDEDRQYCGSATPKTTFSFSGGFTWKKLSVSAMFQGVGGAQALYVGKYMALSDVEGNFNRSKEIMNAWSPSNTGSNIPRLSKNDPNSNFSTPSDWYLENASYLRLKNFTVSYDLSDVIRKCAHLQERNSMMSVYLSGENLFTITNYSGMDPETGGWDALKYPVSRVFSVGVKLTY

SEQ ID NO: 16549 - protein, 369 aa, Hahella chejuensis
MTLRLKHLGWLIAAAAPAAAFAQTSVTLYGRIDGGVEYLNHIATPNGSSTRWSAEGGDWGTSMFGLKGFEDLGGGMSTVFNLETAFQVMNGTTGGGRMWSRRAYVGLKSDTWGQLQAGRNLFIDSDGVWEFDPFVQQAFSSASLVRGRNWQQSSNNIEYHSPVIGGFDVQAQYAFGNQSRGFNYGAADDFGRSDGIMISYHSPVLDVRGIYDELRDNNGKFSNIFTASREYFVGANVKVSKFKIQGAYTHYQAPDSPAGVADRADHYWLGATYTATPQWAVTGGGYYVKVGDGGGDASHDPSGHAIMYVLGTTYNLSKRTFLYGTVAYVRNGGNSNFSLLASPRDATSGTSPMTGESQTGAYVGMMHTF

SEQ ID NO: 16550 - protein, 671 aa, Hahella chejuensis
MQRMTLAPSRRIAMLWSAALALSASASPALAQQAITTPILATDQNFRDLAGISENAGGSGFVDPTTHGGAMRTGVFYRSEALTTLSTTDWRTLSSLRIGLDVDLRTPSEIDGPTSITAPNAGHDWLPAGARYINVNIYGTDAPPSSASVATPGEASAYLIATYQNFVSDATQRGGFRSALLALANEPSAALFHCAAGKDRTGWTSMLLQSIAGVAPETILTAYLASNIYMAESISAALAQIRAAVGNGPAGDLAVATAATMLGVQESYLHAGLAQIVAQYGSMQAYLIQGLGLTQADIYVLRAKMVYFANLPGQDGMTGNAASGATLLNALQNSPLSGRYTAFNYYLQSAVDAGTLGGVESLVGGQLHADTVAFLARQPLWIDAALAPNASGRDLGVGETKAWLAGVGGYFSSDGGSGVSRSIERSGGPLAGVTWRIDAQSSAFVGVGYNAGSVSSAGGRADLDTMLATFGGRYGLSSLDAGPFAEARASVGWFTYHSSRILGGGLGGTSGDASGGVVSGRADIGSVIRAAQWTFTPQLGLRATRVGLGRIEERGSELALAVDRIGYTATSAIAGLDVALDPRQVYGWQIAPSLSLGYERALSNPSVETTAALYGYTVSQVSAYDSRNLVRAGFAIAARQDAATFKAGINAIRGDNASAGFDARVSIGYQF

SEQ ID NO: 16551 - protein, 1138 aa, Hahella chejuensis
MRLIIRKTLLMFLLLSLSNVLTGFQLSAQEQNKKFSVKADNVTLKEAIEVVRKQGNYSFLIRNNDIDLNKKVSVNVDKGTINDVMAQLLTGTGISYEVNGNRVVIFHAAVPEKEQGKAFVLKGKVTDPSGEGVIGANVKVLNSTEGTITDMDGNFSLSVTPNARLSVSYIGYATQEVVVKNQTPLHIALKEDSRLIDEVVVVGYGVQKKANLTGAVSSVKMDEVLGDRPVVSVSDALKGAMPGLQITGNSGRPGEEMSFNIRGVNSLDKNGKPLVLVDNVEMDINMLDPNDIESVTVLKDAASSAIYGARAAFGVILITTKKGSDSTRLSINYSNNFSFSRPANMPRKATPLQTVQAYKDMGTINYQSGQNVDTWLDLLKEYNANPSAYPDGYAMVDGLRYSLAETNLFDDMMETGFQQTHNLSVGGGTKDISYRFSFGMVDENGVLASDKDAYKRYNVSSYIRSDVFSWITPELDIKYTNSKSELPETSGGYGIWGAAVAFPSYFPIGTMNIDGEELPINTPRNLINLAYPTTIQKNNIRIFGKVTITPLKNVKLVGEYTYNHLSNEKTKFEKKFYYAHGGNFVKETSTANSKYENSNGITDYNALNFYGNYNNTWGKHEVTVMGGFNQESSDYRYAEMSRMNMINEDLPSISQATGDYFAKDKFERYTVRGLFYRINYSFAGKYLIETNGRYDGSSKFPKDSRFGFFPSVSAGWRVSEEAFMKPLTSVLSNLKLRASWGNIGNQSITPYAYIPGMDAEQAYWTVSGIKVTTLKPAALVSNSFTWEKVTTVDVGFDLGLLNNRLNLVFDWYRRDTKGMLAPGAELPAVLGASAPLQNTADLRSKGWEITVDWNDQIGKVKYNLGFNLYDAKTKITKYNNETGLFGKDKNDKDTYRVGMELGEIWGYVTDRLYTVDDFDADGKLKAGIPKVEGYNPNPGDILYKDLDDNDIINGGTSTTKDPGDRKIIGNSTRRYQYGIHGGANWKGVSLSFLLQGVGKRDLWIMNDLFYPHYDAWTTVYDTQLNYWTPERTDSYFPRLYEKAAGNTAANTRIQTRYLQDGSYLSIRNITLSYNFPSKWMTKIGVNNLAVFFSGENLYTFDHLPKGLDPERSVTDDLGQRGFTYPYMRQYSFGINLSF

SEQ ID NO: 16552 - protein, 93 aa, Hahella chejuensis
MFLANLQKEADMRKKLTALVLSALPFAAVADVSLYGEVKAGVEGRNIRLQLTEPPSEGQTGNTVTKAKSRIRTKVSDFGSFIGFKGVGIWAAG

SEQ ID NO: 16553 - protein, 756 aa, Hahella chejuensis
MHKLNPITKSLWLALALTGGTFSQDLLAAETTGTDTTGNSSEPALKTVTVTAQHREETLQEVPVAVSAVQGTSLVTDGVRNMGDITTFIPNASAKNPDGDGRPRWYIRGLGTGDTGAATVFPVGIYADDVYLNAPIAGGGPLFDLERIEILRGPQGTLYGKNTTAGAVNVISKKPTFDTDGYATLGIGSKSERILNGAIGGALVDDRLAARLSLYSEERDGFQKNLTDDHTYGDVDKKAVRLQFLARLNPDLDALLKIHAREYKGDGSNGSLPVGRYYNVGYQRPDGRNIALNVNEDAKLDHDGTSLTLNWHLGDYTLTSISAYDYIRGQSTSDADYTPYEVNGAAISDNRYNQYSQELRLASPQQETLRWLAGVHYFHEDLDSSAKRLITPGPTPNGTGSNQTGGATDFRDLNYQHTTDSYALFGNLTYDFTDNFTVTGGLRWTQEKKDIDLDLTQLTRATANGPLIPLGAAGSNGSRDESKTWEAWTYDLTPEYRINDNVRVFFRYAHGFRSGGFNTGLSTSLAQLTTVDPEKLDAYEIGLKSEWFNHRLTANANVFYYDYSDIQVNLLTVNNGVLTTALTNGAKGKVKGAELELEGQPTDYLHLRAAISFLDTEYTDFKNTNPNTGAVTGDYSGNSFVRSPRNVVSLGADYTIPLEIGGKLVAGGDVSFRDKEYFLADRQSSADKTLSQPHYTLANTRLTWFSPDEKLSVTGFVNNLTDRRYQVHGRPNGTLGQYVITYGDPRTVGLSVTSRF

SEQ ID NO: 16554 - protein, 389 aa, Hahella chejuensis
MRLNPLVLALAIAAAPAAHAATSIENWPTKYTFGDGTEVGLTGNYAYDDNNFSGDDRLEDRTDFRRKEFGATLKKKGVYDAMVYFDFEAKLWLDVFFRFETKALLGQDYGRVRLGYMKVPVGLEAVQSSRAGSFMELGLPVQAVFQGRRTGVEWTLERPQYLLQAGAYGGQDLQGDNPGTTQAVHAAWTPFKAEGNVLHLGIAGSVENPRGFSDGRGVSFSPRVRLRARPEAGLTDVRLIDTGTILDVDHVIRTGVEAVWIHGPFSLQSEALRAEVARNAGQPHFIAQGQYVYGTWSLTGESRSYAGGVPGNIKPAHDYGAVELTARYSRLNLEDNNVHGGRQHDTTIGANWYLTSHFKMQANYSWVDSSRNGVHETPHVMELRAQVMF

SEQ ID NO: 16555 - protein, 821 aa, Hahella chejuensis
MLSKLAVAISAITLAAPAFSQSVLEEIVVVAQKREQNLQDVPIAISAFTGAQMDALGVSESFDIATFAPGVHISGNLAGQNTQFSIRGVTQNDFNDIIEAPNAVYLDEGYIAVAQAQTFAVFDIDRVEILKGPQGTLFGRNATGGLVHFISNSPSFDETSGYLDVEVGQFDTANNANRYVVEGAVGGPLSDTIAARAAFRYSKQDPYLKNLYSNADQLPFLGDPGPGSGADLGDDDTMAARLRFAFQPSDDLRMDLSFNYSDSEVATGPYQSKSTLGIAQDHDNNPDTPPELINVINTPSNETRLTALLDASGNDTGLDAGADIEDGDSFLPGGGGGLPGRLAPGADFFGYIDPDGDDFTFSGDFAFADQGSTENSGVNFKLAWDLSDSTTFTSITDYKNYEKLLFIDVDSAPVNQLANYAAVDADSFTQELRLNGENDRSRWVAGFFYLNIDSQSENGLKGPQASFADVFGGVPIDVGTTAQLETDSYSIFGQYEYDISDRLTVIAGLRAMREEKDFGLVLGVAPSESSFVVNTSPCFSGQLDQCFPGTGVSYTDERSENLWAGKLQLTYQVNDDLMLYGGVNRGVKAGSYNAPLLGAYFGSGGDAGLPYDSEELTSYEGGFKATLGGGKTRINGTAFYYDYADYQAFLFVGVGGVVINKDADNYGVELEIQTNPVEGLDLILSGSYFDATVKDVSLRNGSPLPASDVDPTYAPEFQVTGLARYSFDAMGGQMAIQGDVSYSDEYYYNLRNFDADVFDSYTVINAQISYANNGWLATLAARNLTDERPGIQGFDLATLCGCNEVAYKAPRYYALSLRKEF

SEQ ID NO: 16556 - protein, 1222 aa, Hahella chejuensis
MTLSQTNTSATTVNLTRSGTATSGTDYTGAVTSVMVPANTASASFSVTPVADTTVETDETVTFQVASGTGYSTGSPSSATATIVNDDFPSASIAVSPASVTEDGATNLLYTVTLNQPSPTALSIGFGVGGTATSGTDYAAVNSPLVIAAGQTTGTITINPTADSTVEPDETVVISLNAGSGYTVGSPNSATGTILNDDAVVTISPASLPAATAGSAYSQTLSASGGTPGYTFVVSAGTLPAGLTLSASGVLSGTPTASGSFNFTVTATDSGAPTSGSRAYTLTVAGANVTLPATTLPAGTAGQAYSSAITPATGGIAPYSYALTAGALPAGITLNTSSGTLSGTTTSVGSVNFTVTATDSTSGTPSQGTRGYTLNIAAPTIAVAPSTVPTATRGTAYSQTLTASGGTAAYTYAITSGALPAGITLASNGTLSGTATLEGTFNFTVQATDANSFTGTQAYSLTVAGPNLVLPASTLPAGTAGQAYAAAIAPATGGTAPYSYAVTAGALPGGVVLDAATGGLSGTPTVSGTFTFTLTVTDSTPSPAAQASRSYALTVNAATLVLGQPTLPAAVRGTAYSQVLTASGGIAPYRYSIASGTLPAGLTLASDGTLSGTPTVQGTSSFTIAVADAGNATATQAYTFTVNDAAPVAVADVAATMTDTAVTAAVTANDTGSITAIAIASAPTNGTAVVSGLEVVYTPNAGFTGTDVLSYTATGAGGTSAAVTLTITVNVRPVAVSVTAAAVPGEAQRVDITRHATGGPFVAAAVVAVLPASAGTATITRVGGTATAAAARASGLSPAATAMAEAPTFTLTFTPNPAFVGQATVQFTLSNAVATSAPASVVFTIAPRRAPSVDAEARGLIDAQSESTRRFARAQIDNFQRRLEATHRGGGSFTNAVSFQPTSHCRQAERGISGQLCSPDTQDADNDFRDAPAVASSTGSSAQTPGDLGLWVGGAIRSGSLNRQTNSNGVEFQTDGLSVGADYRVASSLAIGAGLGWGRDDSDVGSNGSHSKATAYTMALYASFRPGKAFFFDTLVGYQMLSYDLRRFVTDDSSLAEGNRDGKQWIASLSTGADLQRGTLQITPYARVDVARATLDGYAEEGVAPFALRYADMDVATTTGNLGLRLEWRREVAWGRLSPQLRVEYQRDFQGRGDAILSYADLTGGPFYRTAQSAFDRNRLMVGIGAALLTEQGLSTRLEYRGITDGDSNNDQTWMINLEKKY

SEQ ID NO: 16557 - protein, 425 aa, Hahella chejuensis
MKFSKTLIAASLAFVSADSFAAAFQLAEQNASGLGRAYAGEASIADDASVVARNPALMTLFKNKQLSVAAIAVVPDVSLEGTGTNNGIDPNALDDDSIAPSAVIPATYFTMPVNDRVSVGFGAFANFGLATKFDDDYAAGQIAGETEIVTVNMNASVAYKVSEQFSFGIGLNAIYAEAKIIRKFGASALPIPASTDAVNLEGDDIGYGLNVGLMYQLDENSRFGFNYRTETDITFEGEYSNELPSAFIPGGLDGQLELPGSVEITLPAIAEFSGSHQLDEKLGLHYSVLWTGWSSFDSLEAQVTAPTGDKFSAFEKTEDFSDALRYSVGTDYQYNENLLLRAGIAFDESPVSQQHLSISIPDTDRFWFSFGGNYIIDKNSNVDLGVSIIRGKTQNYTEKDNLGSQWSFESKGHATLIGAQYNYTF

SEQ ID NO: 16558 - protein, 223 aa, Hahella chejuensis
MITTQMEWIMKKTTLVVLAAMMAPMLASAHQAGDFLFRAGAATVRPNAGSDDVLGQGSFSADNNTQLGLTFGYMVTDNIGVELLAATPFRHKVGLNGGAVNGNIATVHDLPPTLMAQYYFGDKQDKLRPYLGLGVNYTTFFDEKFNDNGKSAGLSNLSLKDSWGVAAQAGLDYNLDEHWMLNMSVWWMNIETKARFDDADGNHHSIDTRLDPWVFMFGAGYRF

SEQ ID NO: 16559 - protein, 652 aa, Hahella chejuensis
MSLNICLSLYGHIKMHHKLKLIALALSVTSFTSFADEIEKITVHGLQHYEDGTYTNVYLGSDVTVISNEMIHAAGGVDINKILSQFVPGLFANGRAGRHTDTDYSLQGSRPQDILWLLDGNRLNNRLYGSTYTDSINPMLIERIEVIKGPQSVLFGSEAIAGVINIITKSYQGSDAGELSFAADTLPSYDLSGFVSTEVDSVQLSLAASSSQSEGYALWPDEEYSPTAVLDKERGYQMNNLNAKLRWSLSDAQQLTVFAQYSDGLLERPLAYDAILSENERKQTIAYADWQLEVSEQLLLQAKVNYQHWDSQYSEITLDEKGNATVTYWQKYWGFKDLGATVSANYQTQAGSQWVFGGQYEEYEGADEVMLFTAEKDHSYSLFSQYQPKFEALPDTQLSIGARVNRLANEETIWVANLALTQELTPRLQLKGSLGNGYRQPTASELHSQVGTLGNAELVAETSQSINLGLHYQGDVSLTVDGFWRSIDNLIEPRAMTEVEFIYDNLDARVESYGIDLHLVSELTPQLLMELSGSYASAARQDTGEQIERVPEYTGFAKLNYDVNDDISVWMSGQYVGEFVDYGLIAGDYLLTNIGIQAWITAEQEQQLSLTVDNLFDSEVIQSIFKHGHKAQYPIASLGAPRTLQLQYRYLF

SEQ ID NO: 16560 - protein, 719 aa, Hahella chejuensis
MATHKRTTYWAVAAVGGLTSLLNVHQLALAQEVDSSNRLNTITVEGNRLYEMLSSEMTGGYTVDAATVGTKIPASLRDIPQSVSVITREAIEDQNFQTLDELGRRTPGMRVLSNDNGRSSIYARGYEYDEYNIDGLPAPMTSINGSVPSLAAFDRVEIMRGPSGLFNSTSEMGGVVNLVRKRPTREFQGHVSGSLGSVGQRNLQTDLSGPIDAEGRARGRLVIDHTGHPEFVDHNDNEQNDIYAALDIDLDASTTLGLGFLHSNKDIVVNNGQPVDSDGDLLYGRRSAFYGAEWNNFESRSNDWIAELTHRFANGGYGRVATRYSDRHADYNYAFGGSSLDDDGTLSVAGTAAHVDQQALSLDASYSQPFSVFGNVSEFVIGSDYKHYATDTESGRSRGLTSDPVTLDELNGLAYVDILASARASGRGYSHSETTLEETGVYSKLTLRPVQSLALIAGGRASRYDVDYADRVADDRQSRSDTEFTPYAGLVYDVDAHHSLYASYSQVFKPQTSYDADGDLLKPREGEQYEAGIKGSYFGGDLNARISAFRLYDENRAASPADPGASYSEAVGKMRIQGTEFEVTGGLTDQWDVIAGYTYMDTEVQEASTTRDDGIFLLMPRNIVNIWTQYGFVGGSLDGLHIGGGVTAMSDFNSSSGVEAPGYAVVDAMLGYDFTSHVSGQLNFNNILDREYYNRVGGVNTFNMVGAPSNVVASLRYDF

SEQ ID NO: 16561 - protein, 772 aa, Hahella chejuensis
MSFHKRAGAAALKRTLVCRAALALSAAAPLSAFAAEDAASVPAPVTQELAPTVVRANANPAPFARNTPAVVQSVTADQLADRNVVTAEDAVKYQPNVMVRRRFIGDRNSIFAGRDFNEIQSARGLLYADGILLSNLLGSSYSYPPRWSMVGPDELARVDILYGPFSALLPGNSMGTTIAMTLRRPEKFEAAAQTQIMSQHYNDAYGFSRNVTGNHESASLGDRIGKFWYALSVDRLENDSQPMQYATPNSRFTAGGTPVPVTGARQDLGPNGQPRVILGPQMLERTQQLQETLRFGYVFSDSLEASLTLGHWENHFNDQALSFLRDAAGNTVTGGNVLINGTPYTIAPNTFAPQNGDQENWLYGLGVKGKIGGWKIDTNASAYNVSRDILRASNTAAGNGPGTVFYGDGTGWSNFDIKATSPTVSGHTFTTGYHYDQYHLRNQTFNASNWSTETLSTLKSSYQGDTQTQAVFLQDAWAFAPRWLATLGLRYESWRAYNGQLGNGTSALGYASRTEDAFSPKAAIQWQATQDTLLRLSYGCAVRFPTVAELFQGTISGNTIVNNDPNLKPERANDFDFTVEQAVPYGVLRTSLFQSDVRDSIYTQTNITVTPNVTNVQNVDRVRTRGIELAYSGQEVLQDAGVRGVDVEANVAFTQSKTLADAANPTYVDKTWPRMPRVRANLFASWHATPDWTVGAGVRYSGRQYGTLDNTDVLPNVYGGTSSFFTVDLKASYRIDKHITLALGVDNLTDRRYFVYHPYPSRTFYGQLKWRL

SEQ ID NO: 16562 - protein, 352 aa, Hahella chejuensis
MKKTLIASAIAAISFSGTALAMENASELAARLDSMPSVYGNIQYVLKQTDVDGAGSSVEHADNGTTLGVKHEHKIAPGLTGFFKLELEGINADNKSKSSGINNLDEAYIGVKSDSFGQIWVGSDDGVYERAVVKIGNFHEVGSDIFTAGKTSEGDQIQYQSPSFGGLVLGAGVQINGDGESTTEQFIDNTVNPAVLATRDVKGDKAYPYQLSATYSVDALSLAVAMDSNEAAAGSNENTYGLLATYNMGDLSVSGEYQTRSDDRDIFGVIGIYTMGANQFSLSYQVQDIDATNDKNDTVVLQALHNLSDNMYVYFEGYLSNADGATYYADPDGITAGGDEQTIASVGAVYYF

SEQ ID NO: 16563 - protein, 165 aa, Hahella chejuensis
MRLVSLVIVFCCFLRAVELPGIYQTQEFLYMKSSFVEFFEHNGKFYAYGISDVDGSKARKDKLNPNPKLRNRSDKGVVFLSDLIKVGKRSYKGGKAYNFYDGKTYYVRVTQNSNGDLEFTSSYDKWGYVGKTFTWKRLSDEEIKNLKLKRFNLDEVLKTIKDSPI

SEQ ID NO: 16564 - protein, 752 aa, Hahella chejuensis
MSTERHSRARARPAWNWLLFAIAYGWIPAVPSLALPTVADLLPDMSTRAGDLLVQSSGDASPAEPTSPGNDSDLLPAVTVTATRRSEPILDVPTATTIVPSAQAQERTQTDLADLLRGETGVYVRATNPSAGSPVIRGATGRDVLLLVDGFRLSPAFARPNVQYQSLVDPFFIDQIEIVRGPVSTLYGSDAMGGATNVITPSFKAGEPAFRLHTDYNTNPAGSSTYFQYQGGSERAWAMMGLTYRSFGDLAVGAAPDLQVIFPNPTARIGRSGYEYYGANFKGEVRLADNQFLTLTTQYSRIPTVQRQDGIIQGYGENVTSAQRGFSPQGRTFFLGEYRAVFNHSWLDEVRVRLGYQQIQDDRFQRNFARPRPSFPDYGSGTPSPDITLESNFSDLIGTSAVLKSTWGNNVFTYGAEAYFDLVGSTRSIRNDTTGTIPDPNGSRYVDGSTFNQYGLFVQDEIDWSTQFKTLLGLRYSLVDVSVPFSAVRPNSSGFGRRFEALTANAGFLYRFERELQFVMNLGTGFRAPNINDLGNAGERRASDINLPNSSLNPEKVFSVDGGLRWAGSDFKGEVIGFWSRYTDRITSQSVGTVVNSDGSTSEVFQSVNRDNETIWGIELGGRYRLGDVWSLFATGTFTYAEAPLVGETVIPPFNGVLGVRFEPTAGAYIEPYLRYATYQGRLSENNLTDTRINPNGTPGFVVPNLRAGFPLSGATTLRVNVNNVLNTNYREHGTTLDAPGFGVNVGIDALF

SEQ ID NO: 16565 - protein, 808 aa, Hahella chejuensis
MTLKDFSILSILCLFSISLAAQQKISGTIISAENNKPIPNVDIYDQGSGKLATTNESGYYEFTTEEKQLKIIFFSFEYEVFEKQLVVAEDIVLNVSLKPLGEQLSEVELNVRKTKIFALKRLKDVEETAIFAGKKTEVVLVEQSMANLASNNARQIYSQVVGLNIYQNDDAGLQLNIGGRGLDPNRTANFNTRQNGYDISADVLGYPESYYSPAAEGLQEIQIIRGAASLQYGTQFGGLVNFVMKKPNQAKPFEFITRNTIGSNNLYTNFTSISGTVDKFSYYSFFNYKKGDGFRPNSEFESKNAYAHIGYQFNERTKLEAEVTYLRYLAKQAGGLTDAMFTENPFQSNRARNWFQIDWLLYNVKLSHKFSEDTNFTFNAFGLNASRNALGFRTNRVNQVDPGTERDLIKGDFNNFGFEARLLSNYEVFGKKSTFLIGSKFYKADNTSAQGPGSAGSDPNFEFQLDDYPNYQNQSAYDYPNLNVAIFGENIFYLNDKLSITPGFRFEHIKTESDGFFKRINTDGAGNVILNETVDNSETRERSFVLFGLGASYKPSDALEIYGNVSQNYRSVTFTDISIINPAFAISPEIDDEKGMTIDFGVRGNYKNMISYDLGAFGLFYNDRIGFVQRAFADGSVKSERGNIGDAIMYGFEGLLDFNLNEIFIKNNDYSFNYFINAAITDSEYTKTEESGVEGNNVEFVPNVNLKTGIRFGYKNFLSNIQYSYISQQFTDASNAVESNLSGVIGEIPAYDILDISFSYTYKNFKLETGINNLLDNEYFTRRATGYPGPGIIPSVNRNFYATLQIKL

SEQ ID NO: 16566 - protein, 763 aa, Hahella chejuensis
MIRFSQKHKLMAVLAATTYLFALPVVVRAQAADQSTGQSAGRADGGLGEIVVTAQRRQQNVQDVPIAITAVTGEALRDSGVRDPRDLTLLVPSLSMQAGTAASTTSLFIRGVGIGDFNSNTTGAVGVYVDDVFLGANAGKLFNVFDSEGIEVLKGPQGTLYGRNTTAGAIRFSSRKPTDTLSGDVSALYGRFNEVRIEGGVGGPIAGDVLTARISGLYHRNDGTTFNRVTGHRVNNINLWAGRGILDFKPDADTLVRLTVHGGANNGGARQFQHRGQGVDFFGDPAFLPDGTPTDGFGYADTDGDPYAGDYDVEGKERIRVFGASLLGQFTFGGVQLTSITAYEQVNRATLEDTDASPNQVITAYYEDRPRQFSQELRLQSVGENTFNWIVGGFYFHDNLKTDSAFDLLRGLRDPSAPLEGFDPANSLGLLRYPYTQKTDSYAVFGQGDYKLTDRLTATLGLRYSHDRIGMKFASLFDALGTVNPRKAFSDVVVPLIDFNESKGFNDLSWRAALNYKVDNALIYASFSKGYNSGGFAGGASTDAAQLTPFGSERLYAYEVGFKTDLFDRHLRFNASGFYYDYRDLQVFIFDLSGPVPVQRKLNAGNARIYGLEAEITAVPVRNLELFTAFTLMDSKYKTFTALGGASLAGNRLVNAPEFAGAAGIRLTVPMANGSEVRAKVDGTYTSSFFLYPDNLEANKVKGYGLLNARVGWAAPGGRYEIALWGKNLTKTEYITGIFPIITQDQLNYNEPRTYGIELSAHF

SEQ ID NO: 16567 - protein, 399 aa, Burkholderia thailandensis
MKKALATSALGLVALGAHAQSSVTLYGIVDTGIGYQSSQTSLGSTSGGRSVVKMVNGIWAGSRFGLKGAEDLGGGTKAIFQLEEGFNSATGAQSVSGLGFNRQAYVGVTNSSYGTFTAGRQYTSYYTMLSPYSPTTWLTGAYGAHPGDIDSLDTVYRVNNSLVYTTPSFYGLTASGSYALGGVAGSFNAGSTWSAGLQYLNGPFGIAAGFQRINNSTSGGGAWGADSTASNNGAQPGVSGINNGYQRAQAQQRFAVTGGYAFSPSWDVSFSYSNVQYIPGINSPFRTTAIFNTGGAVLHFKPVTSLDLAAGYSYTRATEANGISSSARYQQFNLSQYYSLSKRTGLYALEAYQRASGQTLGTNGVSIINATADIGDGQNGAPSSSRSQFAAGVGIIHKF

SEQ ID NO: 16568 - protein, 243 aa, Burkholderia thailandensis
MKQKMAITGAVALAFAAAATGAHAQSAGSFYVTTGWFHLAPQDSSDPLKIMNVGGSPVNHEVPNTGAGIDNADTIGLAAGYFLTDHIATELVAGIPPRFNLNGKGSLEQFGVLGHAYQWSPALLLKYYFNDAKAKFRPYVGIGASYIWFTGAKITNTAFERGALGGPTSVQTSNQWAPVLNAGFTYNFTDHWFGGLSVSYIPVSLTATLTTQRPTPIGNVTQTSQAKITLNPIVTYLNIGYRF

SEQ ID NO: 16569 - protein, 409 aa, Burkholderia thailandensis
MKKPTLLAIAVASTAASAVHAQSSVTLYGLIDQGLNYVSNVQTGRVDGALVGKRQIAMSDGATGIGGSRWGLKGNEDLGSGLRAIFTLENGFNINTGGLAQGGLLFGRQAFVGLANQAGQVTLGRQYSIVSDMLAPLSEAGEIPGHMGANPDDFDDLGHSIRLNNTIKFKSTSFSGVTLGALYSLGGVPGATGRNQVWALAATYANGPFAAGAGYLNARDPNLSYFGTNGNSGNSSTNNLGSFGSDTTAQSNPVYAGFASATTLQLIVAGMKYHFGPVSVGATWSHAGFGGLGNTSAGPNPLHYAGTAALNNGALNVSYTFTPAFNVNAAYSYTHKGSVGEFGSANYHQGTLSAAYYLSKRTQLYALAIYQKASGTDSLGQSAVASITQLTPSATDHQALVRLGILHTF

SEQ ID NO: 16570 - protein, 745 aa, Burkholderia thailandensis
MEWATGTRRSATAVTASVAFYAAAAASAQAQQSAQQPAQSEGNAQQGARSGQPAATQPATLPSISVNGLAGNDGTVGLVARRSNTGTKTDTPLKEIPQTINVVTAQQIEETGATSINEALRYIPGFSTYGADVRSDWYSVLRGFTPTVFVDGLQVPNTLNLASWRVDPFMIDSITVLRGPTSVLYGQGDPGAIIDVQSKLANGERIREVEMQLGDYARKQIAFDVGDKVDQAGTLSYRFLGVGRDGNSQTGPNPEQRVALAPSVKWQPNAKTSLTVEASYLQDWGDASNNFLPAQGTVLPNPNGKISPDLYTGDPEFSHYRKKQWSVGYQFEYKFDPVWTFRQNTRLMHLSLDQGQVFGGGLDPADPTEASLLRYVGLYQLNYSRFDVDNQALARFGTGPLDHTVLLGFEYNRQATTDSESMATGPSLNMYNPVYTPITNAIFSGPDAFPRTDTKSTMNAFGVYAQDQIKWQRWVLTLGARQDWSNTTQNDIAGGSRLEQNDHAFSGRVGVVYLGDYGLSPYISYSTSFNPLVGVKIVGGGIAEPTKGKQIEAGLRWQPAGKNLMLNAAVYQINQTNVVTPDFGIDPTGGTSVQTGEVRSRGIELSGVGNVTRNFSVIAAYVYQDVKNIKAGDDTLGKWPVDIPRPRQMASLWGDWTWHAGPLAGLGFGGGIRYQSGAAGAADNSLYVPSYTVYDAAVHYETRNWRFAVNGQNIFNRRFVSGCQSVNTCFYGNPRTVIATARYDW

SEQ ID NO: 16571 - protein, 372 aa, Burkholderia thailandensis
MHNQAPIQRRKSTRIYVGNVPIGDGAPIAVQSMTNTRTTDVEATVNQIKALERVGADIVRVSVPTMDAAEAFKLIKQQVNVPLVADIHFDYRIALKVAEYGVDCLRINPGNIGNEERIRMVVDCARDKNIPIRIGVNAGSLEKDLQEKYGEPTPQALLESAMRHVDHLDRLNFDQFKVSVKASDVFLAVESYRLLAKQIDQPLHLGITEAGGARSGAVKSAIGLGLLLSEGIGDTLRVSLAADPVEEIKVGFDILKSLRIRSRGINFIACPTCSRQEFDVIGTVNALEQRLEDIITPMDVSIIGCVVNGPGEALVSTLGVTGGNKKSGLYEDGVRKDRLDNNDMIDQLEARIRAKASQLDEARRIDVQQVEK

SEQ ID NO: 16572 - protein, 402 aa, Burkholderia thailandensis
MRRPSTWATKISQSVDKESVDMKMKLFAAAVAALAAGGAYAQSSVTLYGVVDAGIEYQNNQPANVSQGVGSGHSVTRMISGGQSGSRWGLRGVEDLGGGLKGLFVLESGFTVDDGKMGNDSRLFGRQAYVGLGSQYGQLTLGRHQTPFYDFGLQFDPMAIASNYSITAQDGAFAGRADNSIKYIGTFGGLTANALYSFGSNTGGATGVFQGNQGEVPGTWKIGREYSLGLTYAAGPFAVGAVYDETNLGFTANPDATVRRASLAGTYAFGPAKLFAGYRWAKGVDLGTIPFLANTSLQAISGAKASSNLYWLGAGYQITPAFSLTGAAYYQDFRGAKADPWLFVATADYALSKRTDAYLSLAYAYNRDNSNLGVSGFGKTNVDSTGKGDSQFGATVGIRHKF

SEQ ID NO: 16573 - protein, 742 aa, Burkholderia thailandensis
MNTIPSHRHPFSHSLRPLALLVPLLAIATSAVANEVEEVVVTATKRDQRLQDVAGSVTVITRLDAINNLSDIAAQVPGFTVLDAGSRNPSSLTIRGLRFDEVGDNDFGGDGGSVATYVDNIPLQGFFVPPQFTLKDLQQVEVLRGPQGTLYGNASTGGLVRYVTAKPDLSQSYVRLGAGISQTAESDDLNYDTDLVVNSPLTDTVGLRLLLSQTENQGFIDNPYALTGPTKDINDDKTEAVRLSALWQATDAFSLAGSYHYQKVNVDDRQAANEAFTGDEYQASHRFPQFMEGKWHLYGIDAEYQFDTATLTASVNRYDYETVTASDQTDLFLSYYDAGSGYFSSYDDFIGVGAGNVEVKKDSAEIRLASDNDQPLRWLIGGFYSQDDLDVLIADFLPGFADFWEENRPLDLDYIATQSETLKEFSTFGELSYDLTAQWEVTLGARHFRYDDKLDSCYALFPLEEGETEIPLDCSASDDVQTGTLGKFSTRYRFTEQHQAYFLVSEGYRRGGANLVPAGAEDYAAYDPDTALNYELGTKTAWFNQRLLVNAAVFYMDWKDIQVQSYIEDFRATVNAGDARSQGVELETKAILSDRWSVNLGYSFTEAELTETVESITGSYENAYSGDRLPGSPKQQWNLGVSYAQPIGEAALDASLQLSHIGDVYTALNDEFYNYSRLDAYTTANARINVSLRNWHFGAFVTNIANERGVTGIRTDEFYGERGQFEYVTRPRTVGVSARYQF

SEQ ID NO: 16574 - protein, 862 aa, Burkholderia thailandensis
MSTGQTRPSSTSRRRGQLSLLTLALLASGAISLPTLAAEPAQASSPRMGDYRFAIAQQPLVSAVNAFSQVTGWQVGFSAELAEGVASPGVQGSLAPEAALQRLLHGTGLSYRKIGNGNVVLERQAAGNAIALQQVTVSATRSAQDVSQVPSTVSVQTREQLDRQNVNDIKELVRYEPGVSVGGVGQRSGLNGYNIRGIDGERILTQVDGVSIPDSFFYGPYAQTQRNYVDPEIVKRVEILRGPASVLYGSNAIGGAVSYFTLDPDDIIKPGKDVGARLKTGYSSADDSWLTSATVAGRQGDFDGLLHLSQRNGHETESYGEHGGTGLDRSEANPEDVRTTNVLAKLGWNYADDARLGFTYEHYKDDRDQNILSAVGGPFIPGRGASNMYRMRQGNDTVTRERFGINHEFGLDSLVADHVKWSLNYQIAKTDQRTDELYFASGRQVFRDRQTTYKDRQWVFDGQFDKAFSIGATEHLLTYGTTLKHEKVTGSRSGTGTCLNVGGSCRAIGQNSPSDGQVLVSDFPDPTVNTYSLFAQDEIRWNNWTFLPGARYDYTRMEPKMTAEFLRGIQGTGAAPGSIDDSDKKWHRVSPKFGVTYAFNDNYTWYGQYAEGFRTPTAKAMYGRFDNPTLGYSVEPNPNLEPEKSKSYETGLRGNFEAGNFDVAVFYNKYRDFINEDAVQSANLGSTFQANNIKHATIKGAEFKGRLNLDHFGAAQGLYTQGSLAYARGRNDDTGQPLNSVNPLTAVLGLGYEQQNYGGLVSWTLVKRKDRVDDTTFFAPDGASKQFRTPGYGVLDLTGYYKVTDDITVNAGLYNLTDKKYWQWDDVRGYDALGEAGVTQPANLDRLTMPGRNFAINLVWDI

SEQ ID NO: 16575 - protein, 783 aa, Burkholderia thailandensis
MHTIKKTALAAAVAACLPNLALAQLEEVLVTATKREASVQDLPFSINAQTAADIQRQNAFNLEDLARNVAGLTIQNLGPGQSQVAIRGVSAGQVVRDQPGVKEQVGVYLDETVISLSLFTPDLDLYDLQRVETLRGPQGTLFGSGSVGGTVRFISMQPDFDEVNGSLELNANTLKDGGAGGHVKGHVNIPISDTLALRAVGYGTQYGGWVDALGEDGFTRDNVNSGDRVGTRIALAWQPTDALSITPRVVYQEIQADGFNREEDYNLFANPYTTTRPAIQLGEREQYLLQGEDFSDETLIADLVMNWDMGGATFTYAGSYTDRSILVSRDASALTGSVSVDLGYPDAAVLLPSNLRDTTELTQYTNEFRLASNGDQRLSWVVGIFYSDVERNYSQRLPTPGYDDVTDQVLGDGTADAVANGFATDSPYNADLPYDIEQLALFGEATYAVTDRLDFTFGGRWYDFDETRRFTSGGLFSNGDDQTDTTSSDGFNPRLMASYNFSDDITVNAQASQGFRLGGVNDPLNAGLCDPGDLESFGSFQQYDDESMWNYELGFKSQFSRIQLNAAVFYTQIEDLQVTLDAGSCSSRIAFNVEDASTVGAEWELAAYPTENLMLTFNGSFIQAEFDSTVRDSSGRVLGGVEDGNRLASVPELQLSASATYTFTSGMFGSDETYVNAMVQHVGDRYTQPGDQVPGAGVFQSGLPFGGATGSEVTFLDLELPKYEIVNLSMGATWDSWDAVLYVNNLFDENALLSFDRERGGRARLGFRVSQPRSIGVTLRKQF

SEQ ID NO: 16576 - protein, 340 aa, Burkholderia thailandensis
MSGYTYAQSSVTLFGTVGGGVRWTDGVQGGHQIGFDSNSISGNSFGIRGVEDLGAGWRAIFMLQSGFITGTGGTKASSTFFSQRAYVGLEGGFGRLMLGRQLNAAEDIGVQLDPIEANGPSLATVPGIVWGGNFFTLDARFNNTIKYVGRSGGFTLRASYSPGGVAGNTRAGTNFAVGTSYQFRTLLLAAAYQKTYNASASQHAETAMGGATWQLGPTRMYLSYSALKVSAATAAGAERRDHVPSIGLVYRVTPTLQFTGATYYDIATNLKNVAGADGRKMTTYAMVEYFLSKRSELYVEFDRNGFSGAYKKDPTNVSALNLRPDGRAVTGVSIGMITQF

SEQ ID NO: 16577 - protein, 361 aa, Burkholderia thailandensis
  misc_feature (127)..(160): Xaa can be any naturally occurring amino acid
MKKTLIVAALSGMFAASAHAQSSVTLYGLIDAGITYTNNQHGHSAWQQTTGSINGSRWGLRGTEDLGGGMKAIFTLENGFGINNGTLKQNGREFGRQAFVGLAHNGYGSLTLGRQYDSVVDFLGPLXXXXXXXXXXXXXXXXXXXXXXXXXXXXXXXXXXDNLNNSFRIHYSVKYQSANYGGLKFGALYGFSNSTDFSNNRAYSVGASYSFMGFNLAAAYMQLNNNINSLALAASDPGAVAGDWTFAASRQRTWGAGLNYAFGPATAGFVFTQTRLTDSAGISAGQSGVSAGIPLTGSTRFNNYEVNGRYALTPAFSLAGSYTYTDGRLDGQKRAGTSSICRPTTLCRSAPTCTCRANTSA

SEQ ID NO: 16578 - protein, 274 aa, Burkholderia thailandensis
MKKLIAACVVAGASTGAFAQQAGDLVATLGWLHVMPQDSTNGLTTNVVNSPINGPLRLPGSFTSPGTSLTVNNADTVGLTFTYFFTDHIAVTSVLGIPPEFALTGHGVIRPPGPSGSLGNVDLDKPANQPAVKNARQWSPTIILNYYFNAPTAKFRPFVGIGVAYSWFSNIELNGNFAKDINDNLGSVLAAGAGKPGPTSVEGKASSSFTPVYNIGASYAIAKHWALTATLSYMPLKTYSSLVIKAADGTTLATTRTRLKADPLITFVGISYKF

SEQ ID NO: 16579 - protein, 820 aa, Burkholderia thailandensis
MQAGPGSRVPMIGVRPRAMSSRLRESTSSEQSEAGGKRSEPRGADDSGACGVRSGVGGGRGDPPMSRAPHAPSRRRAFGRGFAAAARAAHGAPVAHGAHACFAAASRRATAVERCVTALACAVTASGALAAEAEPADAARGPHRELPTVRVTSDGAHASPLSTPLAAGSRLKLASLDTPASVEAITSAQIAARGDRTIVDAVTRATGFSTAAAPGNGGTALSVRGFAGQESVTTLVDGVRLYPGAGTVTFPFSTWSAERIEVLRGPASVLYGEGAIGGVANVVTRRPRRERSTTLQAGIGTQGEKRVALDTTGALGPRLSYRFHLSDERARGFVERGDAHVTAVGGALKLDVDSRLSITLDYDYGRQKPATYFGVPATNGVLERALRERNYNVGDATIAYHDTWTRLAATYRAGNGVTLDAQLYYLATRRHWRNAESYALDPAARTVARSDYLEIFHRERQFGERFTARIDSRVFGRANRLVLGAEFNQIAFDGANNAPYRGESTVAAAGFDPGAFASPDPTLPRFRTRTHQAAAFIENRLEVLPRLAWVSGLRYDHLSFHRDDLIAGGAFDKTFAHTGWRSGLVYEIAPGLAAYAQYTTGAQGVGSLVTLSASQANYTLATGRQWEAGIKHEIDGARAYWTLAVYDIVKRGLVSVDPLNPARAQQIGRQSSRGVELAGGVRLPGGVTVDANAALLRARYDAFGQRVGDTVVQRAGNVPHDIAQQSANLWIGWAFAPGWRANAGLRYVGPRYGDDANRVPVPSYTVFDASLAWRATRDVDLAFYARNLANRTYAASTSNGGAQWLLGPSRSVELVATLRF

SEQ ID NO: 16580 - protein, 685 aa, Burkholderia thailandensis
MECRAFKKSAIAVMVSSLVMSSAYAAVDAESSEPIEKITVYGEKIERSLKDTTSSISVIDKDALDSGQYQSTSSALSEVPNVVVLTGSVPDIRGVSGNGSASGFNSFTGGARARVSTLVDGVAEPFVADLTGDTGLWDIQQIEVYRGPQSTINGRNSIGGTVFIKTEDPTFDWQGAARVGYRNQDNFIDSAVMLSGPILDDELAFRVSGQNVTGNTFNKGLEYETNPVPFDLNELITNRWRGKFLWQPSAIEDLKVLYSFSYNDEKGDSGRNYFTSDDPWAFKPIFQRYIETKSTTHSVKVDYDLGEGRAFDLIVAYMDYDWGFESYEALATAQQYVDMNDQSYTVDGKYSFGLKDKDFNGFVGLAYFKRDQDFGSTGSSVYSGDDSTESTSIYGEMTYGLAESLWVTFGGRVMREEQLRNFNMLYQGSQLQEKLDNANTVTLPKLVLQYALNDSTTLAASVRRGYNSGGGALSLAESEYYYYDKEYVNTYEISSRSAFMDGDVNFNANLFYNDFEGYQASNSARKITNIDKAVSYGIEAEFSAMLTENLQFISGVGLLDSEIKQADPSYGDIIGNQLNSAPHVTANAGLKYWLGDAFSFGFSGNYVGEYYADINNTESRVAGDYVVARLSLDYQTDSWRISGFVNNLFDEQALTVNEPASRSYPDGYAAIIDPRNLGVSVMYRF

SEQ ID NO: 16581 - protein, 173 aa, Burkholderia thailandensis
MKKVLTLFGLLFVLLGSAHAQKGKQAIGFGLSYGTEIESIGLGIKYQYNITNPIRIEPSFNYFFENDNVSMLDLNVNFHYLFPVAKSVKLYPLFGLTLSNWMFDMHDFDIDMDEGHVHIDDNGNHNECRFGVNLGAGAEFALPRNWAMNFEFRYQLVSDFDQGVINIGAAYRF

SEQ ID NO: 16582 - protein, 685 aa, Burkholderia thailandensis
MRTPFVRAALAALSGLPCIALAQGDASASSASFASSVSYAPAAASPADADSALSTAPAAAAASPASGAARGAEAVSADAASAVASGASSASPARAASAAQLAPVVVTARRGPQRLADAIPQTTLFDARDIADSGATDLPGLLALASGAQIVRNGGPGASASLFLRGAQPTQSLVLIDGVRVDSASLGQSQIAQLPLDQIERVEVVNGNVSSLYGSGAIGGVVQVFTKNGGNHPPRFDFSAGYGSYHTQTQSAGASGRLDPDGRTTFSVSLARLKTDGFSALDPARKPQANPNANGYLNESASASLRHTFSDKWNAGVTYFQANGRNSYDDAYGSPADLNDLYSRVQQLSAFANGALADGWTTRVSVSSGKDRNQSALNGAYTDHFNTDNRQYTWQNDFAIARGHKIQAGYERLDQSFESNKYSAPERHVNSGWLGYTGRIGDSRFQANVRRDQYSDFGGANSYYLGYGFDVTEHWTVSASYSSAFRAPSFNDLYYPNSGNLSIRPERSHSVEAAVQYASDDVGVVRVTAFQTRYTNLIDYRPGASGPYYVAQNVGRAKVQGVEGSWQGHVGGTDVRIAATLQNPVDETAGRDLNRRARRFASISANRSFGGWRVGGEWLASGARDDFGDRLGGYGIVNLSARYDITKSWYVSARIDNLFDKDYELAYAYNTPRRGAYVTLGWQQR

SEQ ID NO: 16583 - protein, 283 aa, Burkholderia thailandensis
ADGINQSGDKAGSTVYSAKGTSLEIGGRAEARLSLKDGKAEDKSRVRLNFLGKAEINDSLYGIGFYEGEFTTADSTATKTDNGSDLDNRYTYAGIGGTYGEVTYGKNDGVLGVITDFTDIMSYHGNSAADKIAVADRVDNMLAYKGQFGDLGVKASYRFADRTENTVTDKYEDNGKDGYSLSAIYAFGDTGFNVGAGYADQDEQNEYMLAASYRMENLYFAGLLTDGEKAATNGDYTGYELAAGYKLGQAAFTTTYNNAETNDETSANNFAIDATYYFKPNFR

SEQ ID NO: 16584 - protein, 729 aa, Burkholderia thailandensis
MKSSTPAAALIAASLLVPALPALAQQADPATLDGVRVTGSKRDTPYLKSDLSVTVLDRQALKEAGVTEFRDLDKLAPNVKFNAMGQLSNMFISIRGIESNPFLVNRASVYIDGIPFRELSNAVLNQVESVEVLRGPQGTLYGANSESGLVLVRTRGPADKREGEVNLRSTWFGNGNGTAIDGFLAGPLSRDGSLSGSVAFMGSDEDAYLKNLTPSGARGKVGEGYLQGKLRWRPSDYVSVNALAYHLRTRAPGMFEYEYLPLDTGLYNRTYGTSLNGGRRAGDFTYINDAPKRTEKDETVAGLSAQWQLQAGTLDVAASWRDEEVTSAGYDFDMTNSPALAGRIYDRKKEWTAEARFSSLSDQALTWMAGVSTYRNSKDSILGTFVGPALHGLDSYNLAPRQTSKGEDYSVFATASYTFPAVPKLTASAGLRHEQARRATEQRAGALDLGAGGRVLYRDAALAHTFSATLPRVSLRYDATDDLSFYAASAKGYIPGGFNLAAAQSDVVNDKVLRYESERMWSHELGFKMNLAGGRGHIGGALFHITSDNWQEIQVATDANGRPISSDYVGSDASIRSRGAELEGVFEVLPGFTLMANVGYVDAKYTKLWVSVDQNLDGKRVKLTPHYTGYLAARYQFDSGIYARLESQFTGSSALDERNRAFQPAVAVLGAQLGYETGPWSARVFVQNLTNKRRINGLIFDNLAFGRDGNYYGPVDSPRIFGAEVGYRF

SEQ ID NO: 16585 - protein, 1409 aa, Burkholderia thailandensis
  misc_feature (710)..(710): Xaa can be any naturally occurring amino acid
MKKTVFRLNFLTACVSLGIASQAWAGHTYFGIDYQYYRDFAENKGKFTVGAKNIEVYNKEGQLVGTSMTKAPMIDFSVVSRNGVAALVGDQYIVSVAHNGGYNDVDFGAEGRNPDQHRFTYQIVKRNNYQAWERKHPYDGDYHMPRLHKFVTEAEPVGMTTNMDGKVYADRENYPERVRIGSGRQYWRTDKDEETNVHSSYYVSGAYRYLTAGNTHTQSGNGNGTVNLSGNVVSPNHYGPLPTGGSKGDSGSPMFIYDAKKKQWLINAVLQTGHPFFGRGNGFQLIREEWFYNEVLAVDTPSVFQRYIPPINGHYSFVSNNDGTGKLTLTRPSKDGSKAKSEVGTVKLFNPSLNQTAKEHVKAAAGYNIYQPRMEYGKNIYLGDQGKGTLTIENNINQGAGGLYFEGNFVVKGKQNNITWQGAGVSIGQDATVEWKVHNPENDRLSKIGIGTLLVNGKGKNLGSLSAGNGKVILDQQADEAGQKQAFKEVGIVSGRATVQLNSTDQVDPNNIYFGFRGGRLDLNGHSLTFKRIQNTDEGAMIVNHNTTQVANITITGNESITAPSNKKNINKLDYSKEIAYNGWFGETDKNKHNGRLNLIYKPTTEDRTLLLSGGTNLKGDITQTKGKLFFSGRPTPHAYNHLDKRWSEMEGIPQGEIVWDYDWINRTFKAENFQIKGGSAVVSRNVSSIEGNWTVSNNANATFGVVPNXQNTICTRSDWTGLTTCKTVNLTDTKVINSIPITQINGSINLTNNATVNIHGLAKLNGNVTLIDHSQFTLSNNATQTGNIKLSNHANATVNNATLNGNVHLTDSAQFSLKNSHFWHQIQGDKDTTVTLENATWTMPSDTTLQNLTLNNSTVTLNSAYSASSNNAPRHRRSLETETTPTSAEHRFNTLTVNGKLSGQGTFQFTSSLFGYKSDKLKLSNDAEGDYTLSVRNTGKEPVTLEQLTLIESLDNKPLSDKLKFTLENDHVDAGALRYKLVKNKGEFRLHNPIKEQELLNDLVRAEQAEQTLEAKQVEQTAEKQKSKAKARSRRAVLSDTPSAQSLLNALEAKQVEQTTETQTSKPKTKKGRSKRALSAAFSDTPFDLSQLKVFEVKLEVINAQPQVKKEPQDQEEQGKQKELISRYSNSALSELSATVNSMFSVQDELDRLFVDQAQSALWTNIAQDKRRYDSDAFRAYQQKTNLRQIGVQKALDNGRIGAVFSHSRSDNTFDEQVKNHATLTMMSGFAQYQWGDLQFGVNVGAGISASKMAEEQSRKIHRKAINYGVNASYQFRLGQLGIQPYLGVNRYFIERENYQSEEVKVQTPSLAFNRYNAGIRVDYTFTPTNNISVKPYFFVNYVDVSNANVQTTVNSTMLQQSFGRYWQKEVGLKAEILHFQLSAFISKSQGSQLGKQQNVGVKLGYRW

SEQ ID NO: 16586 - protein, 377 aa, Burkholderia thailandensis
MKQTTKITGLIGGAVLAIAGQQAMAQSSVTLWGVADVSLRYLSNSNAQNDGRFFMTNGAITNSRIGLHGSEDLGGGLKAIFNLESGVNLQDGAFSDSKRIFNRAAYVGLTSQYGTVTLGRQKTVLFDLLSDTYDPLTVGNYLENAWLPVALGAGLYADNSVKYRGTFGGLTIGAMYSFGTDSTATGAGGFSGQLPGHMGAGNMYGFSLSYVAGPVSVAAGVQQSSDNSNRKQTIYHANVVYAFSKAKIYAGYLHSKDDTGFVDTVLAQQPGLFTSGAPKRTGRIDDGPFAGVSWQATPALTLTGAFYYDRMRNATIANGQLDSGNRYTVVGLVEYALSKRTEIYGTVDFNKVNGAAMVEMPGRSNQTGVAIGLRNIF

SEQ ID NO: 16587 - protein, 366 aa, Burkholderia thailandensis
MKKFAVAAAGLAVATGAHASDGSVTLFGLIDAGVSYVSNEGGKRNVYFDDGIAVPNLWGLRGTEDLGGGAKAIFELTSQYALGNGAALPTPGSMFSRTALVGLWSERLGSVTLGQQYDFMTDSLTFGSFDGAFRYGGLYNFRQGPFSKLGIPDNPTGSFDFDRLAGSSRVPNSVKYTSANLNGLVFGLMYGFGNQAGGGLAANSTVSAGLKYETGSFALGAAYVEVKYPQMNNGHDGLRNWGLGARYALSAFDLNLLYTNTRNTLTGAAIDVIQAGVRYVGAPWTIGANYEYMKGNAQLDRNYAHQVTATAQYALSKRTSAYVETVYQYAGGSAGAHAWINGVMGPDAQSSSRSQFLARIGMLTRF

SEQ ID NO: 16588 - protein, 684 aa, Burkholderia thailandensis
MKRQYFGLTPLASLVLIALTAKAAWASEQHDHAKMADDSVMIVTAPVASPLEIVTSPKTPRQPVPASDGSDYLKTIPGFSQIRNGGTNGDPVFRGMFGSRLRILTDNGEMPGACPARMDAPSSYISPESFDVLTLIKGPETVLWGPGNSAGTLRFDREQPRFDKPGIQGTASVLAASNNRWDENADISLGSEDGYLRLIGNKSRAGDYKDGNGDRVPSKWDKWNGDMALGWTPDKDTLLEMTAGKGDGEARYAGRSMDGSRFRRESLGMRFEKSGIGEVFDKLEANIYYNYANHVMDNYSLRAPGMNMSGSMGSAMGSAMEHGSAMHSMSMPMAMQLDRRTVGGRMMGTWLWSDYELRSGVDTQLSTHRSKDDDRWDKDARFHDYGLFSELTWLATEQSKVTGGARLDRVLVDNFTDTGSSQRTDLLPAGFVRVEHNLAEMPVMFYAGIGYTERFPDYWELFSPTYGPGGSADVFDNVKTEKTTQLDIGAQYTGKRLNGWVSAYIGRVNDFILFRYDPHHPRISQVDNVNATIMGGEAGIGYQLTETWKTDASLAYSWGRNTDDHQPLPQIPPLEARLGLTWERGDWSSTGLLRLVSSQHRVAINEGNVVGKDFDSSAGFAIFSANAAYRLNKSVKLSAGVDNLFDKAYSEHLNLAGNSSFGYSANTSVNEPGRTFWGKVNVTF

SEQ ID NO: 16589 - protein, 755 aa, Burkholderia thailandensis
MNRERSIMTVRLAALAAGASLLAFGNPSYAQTGASEDVEGVEAITVTARKREERLQEAPISITALSSATLERAQVGTIAGISNFTPNLILNESAAISGNNAATTTFIRGIGQYDFTPTTEPAVGLYVDGVYVARSVGALLDVADVERVEVLRGPQGTLFGRNTIGGAVSITSLRPSDDAFEGYVDVRTGSFERFDAKAAVNIPIAEGLAVRASGSRRSREGYVRRVSDGVRNGNQDSWSGRIDMLAETEGGFRARLIVDGTRRRENMAANQLVAVYPNAGFVQVYNTQVAGAACTPNPGPVGNSLCYNSQWIPQKGERITYGTFPSQSDLDLWGVSLNLEQEIGKVTIKSISAYRDMKSISSRDGDHSPLRIFETVDDYDQWQFSQEFQVLGTSFDDRLKWIAGAYYFKEKGGDANMVYTSRIDFMSGGRIDNDSAALFGQATFDVTDKLSVTGGLRYTKDWKRFLPDQYVTNSGLTPFPVGSRLAPYVKYRSTYHDLNPTADVSYKFSRDIMTYFRFSEGFKSGGYAFRFFPPTTTVPDYQPEYAKVYELGFKSTMFDRRLQFNAAVFRTDYTNIQVSGIPTGRVGAITFNAGDARIHGGEVEISARPIPPLRFQFGAGYLDAGYRNVPTNLGAIDVNNDSRFAYAPTWSLTGNASYEIETGIGTITPQLDWSYRTKVYGNPANTPAAIQPGYHLVNGSIAWRDPSGVWQVTAGVTNLFDKRYFTTAYASPSVGYSEVLFGRPREWFLGVRRSF

SEQ ID NO: 16590 - protein, 359 aa, Burkholderia thailandensis
MDKRLSALCGLGLASAGACAQTSVTLYGVADAYVEYATNQADAKGKPAALARMGSGGKSGSRWGIKGTEVLGGGWRAAFRLESGVNLNNGAGTGAGGFDRSAWVGLEHPRWGALRFGRQYTTMFDIMEHYSPTGAYSTLYEPDGAIVGISFRENNVVKYLATAGPLTFEAHYAFSNEPGAFQASAAHGAGFEYTGGALSFAFAYDDVHTPQAGGFAHLRRYAAAAMLTVEATQLIAGAAHGQGNVATPSVVTRYTFWWIGVRQAITPVVQLIGALYAERVRAQNPASPPAARHASGTPQQATLQLNYFVSKTTTLYAATGYARHAALDFDNYNYGFLHYSLAGARAGSAGVAVGVRKLF

SEQ ID NO: 16591 - protein, 1200 aa, Burkholderia thailandensis
MRGRRTGALLAAVTLFAPLWALAEPVPRPSPAAGSVIARKSGEEVRFVDVSNWRVVDLAQDLLPGDVLRTNATGALAVLFRDHTQIRLGRNTALRVKQIGAGDTNLGLESGTIWARAERGGEGLVIDTPAAAAAIRGTDWTLTVGADGKTSLVVLEGVVELSNAYGSVTVKQGEGAVAAIGSAPAKIVIVTPKDREQMLFHLSLRNAFVWMPATPFSVPEMRRERARIEASPAASRPAEEWLTLAEIYLSLNGRDKAQAALAEAASRGLTRSQAARADLVKALIAGSSNRYEEAARLFARAERGLDPSRLTIAAYGGYFARGLADPARVEEPPRNASGRYAGMARAWTAGFREDIPAAIAVIKKAEQQYPDDPTLPAARAQLALLLDDRDELRDGVERALSIDPDDPTALEARAHYRYHIDNDLEGALADLERALKTAPGSSSIWNSLGLVQGARGDNRAAEAAFKQAIALDPLDPVSHANLAIQYMDEMRMAEAKREIDAALSVDPSFDVALVARGRYHMQNGEADKAVEDLLAGSTANPAYSNAQLLLAAAHYEKGDRIPAAQALDNADRLDPNDPVVATVRTAIAIDAYDADAAIRNAQEALRRTRAKGGDTAALGANQEQGSTLNDAFRLQGLDAWGQYYGDAVFDPFTGASYVDQAVRGSVNPFFNAYDFAANAVTNTVNTASFSALIQGLLIEPHMLASRERTVNLLRSPFFETELGGGFTANEDQVGWISEAAVRGYTVSPFPMSVFGTLQWEEPRDTVERDAGPAIDREVRLIGGNGYLTATPSPDDRIVAYLNMVDTEDSQNIFDEFDTDRLNDNESKSLVSGVAWSHTFGYRNVANAAFFFSDRQIVDLSRAVLSDVPFPDLVRIRSEQNETSYIGALNHLYGNGDLTWRYGIEAGQVDSDFRTDISLVSVPLPPEFESSTRPVAKAYVDGLYEITPDLKVEGALFARYIEDVNDNNIRLEPKFGLAWAPAEGHWLRAAVQREGYNFSSATLAPVGIVGLQPNQFLIGMDGYADTLALRWDAEWTDWLFTAVDYQHQEIRNGSIDLPFSLDDFPFDKGRVDRVALTTNLALGHGLGLSATVARMESDDLSAGSDGDLPFLPENSGQVALTYVSTANMKTTVAANYVGERTDGTTTLDDFWTLDAALQWEPFDKRFEVELAGFNLLDEEFDIRDGLPGWGPTVKGTVKVRF

SEQ ID NO: 16592 - protein, 220 aa, Burkholderia thailandensis
MHQPLAFMPALPVSRHRSDVVGCAQPSERSARRIAQPIPSVLASDATPRCASMASADRQMIGDATLACACAAQAQSSVTVFGALDAALTHSKGSVASGTTLSNNNWAASKLGFRGVEDLGGGLEAGFWIEGAILPDSGAGDATNTNNPPGGQGSVGGLTFGRRSTVSLFGPWGELRAGRDLQPHYLNIGLFDPFAHIGIGQARLPTSTVAGVAIGIEHTF

SEQ ID NO: 16593 - protein, 462 aa, Burkholderia thailandensis
MTAIALILTTAHVPAAAQAISQQEAAALRAEIAALKAQINRLEARIGGGDSAAVMAATQGGTPAPPPLAAATEPAPPAQTPTAVRWKGGPVFSQGKMTFHPKGRIQYDAGLLMTPDSVADRARGYSNELRRLRLGGEGTIGGGFGYKLELELSDNSVDLVDSFITYEKGPWLVTLGNHNGFQSLDELISDTGGAVMERAAFTDAFNFERRLGLSVQYRKGILLAQAGLFSDSADSLTNDADGADGGDENNSYSLDGRIVLAPKWGDTQLHLAASGHWRDFQRLSSVGQRYRQRAYLHSANSRFLATPQIVGKSESHYGLEFAGERGPFWWASEAHWLRVSQAGVADPLFFGGYGEVGYVLTGEQRGYKNGIFGTVTPDGPVGSGGWGALQATLRYDYLDLNDKGIVGGTQKAVIAAMVWTPVEFLRFNVNYAHLRFGDAAILAGDDRDYSVDVIGWRAELDF

SEQ ID NO: 16594 - protein, 770 aa, Burkholderia thailandensis
MARRRCRTRPLRVVPCLSALALSAPGSAAAQQATGEAAADQVRNLQEVTVVAPTPLPGFTIERQAFAGNAQTATDGDLERVKAPNLTSFLAETMTGVVVNDAQGNPFAQDLLYRGYRLSPTLGSAQGLSLYLDGVRQNAALGDVIQWAAIPEAALSTITLVPGSNPLYGLNTLGGALALQTKSGETHPGVEADLSIGSYGRARLDVSAGKALGDGWHAYMAGTGWREDGWRDRSDSDLGNLFFKLGRSTSGTQWNVSVLGSSSRLSGNGLTPDSLYAADRRAIYTAPDETRSRSLQVVLNGAHQFNAQDQLQLTLYLRQTRTHANSGDISDAYLDTVLDCQGQAGSGDCEADDAPPNAVLNSATVRETGYGASAQWSHDGDTHRFAFGAALDLNRSHYTQTTQQASFDSARNAVADAGAPVVTQAALDGRDSTVGLFATDTMRLLEGTFLTLAARWNQGRRHTLLNLPTQSDESFTYSKLNPSVGLTHRLLDRLVVFGSASQGTRMPTAIELGCADPANACQLPTGLQADPFLRQVVTRTLEFGGRWQPADATEVTLALYRSDNRDDIVFQRSPVSPLGYFSNFPKTRNEGVELGLRQRLGRLTLRAGYSYTRATYQAQGELQTPFAAPVAVQPGTRMAGIPLHSFRLGADWRATAALSVGGDLLVSSSRPVAGNEDGALSAQNPALSDTGGYLLLNLRASWQFSPRWQVYGRIDNVFDRRYATYGQAGYNLFAGGSLLQPGAAVPVERFVAPGAPRLFLVGVRYEWDGR

SEQ ID NO: 16595 - protein, 354 aa, Burkholderia thailandensis
MQWKTKRTVALAVAAASGAMSAAAHAQSSVTLYGQVDAWVGAQKGFDSSRAGVVNPGGMSTSYWGLKGSEDLGNGLKSLFALEAFFRPDTGRAGRFDGDNFFARNAFVGLSSNAWGTIKLGRNTPPYFVSTILFNPFIDSYTFSPAVFHTYLGNGLSGAAGISGLVGDSGWNNSILYSTPDFNGLSANLIYGAGEQAGHNGQNKWGGSLLYFHGNFAATAAYQQVRFDANPGDLDTIVAGFRRQDAALLGATYDFGVVKLYGQYQHIKNTISTGDTKANGGQLGVSVPVGAGSILASYAYTKTSGAVDVKRNTWAIGYDYALSKRTDLYAAYFRDKVTSLSTADTFGVGMRAKF

SEQ ID NO: 16596 - protein, 689 aa, Burkholderia thailandensis
MSCTNCDFACGPVLRAHEGSSSYAALAMATLLALNASSVQAQKAEKIELLNPVVVTATPFEDRTELDIAQPVSVLKGDDLRRKREASLGDTLSHELGVTSSFFGPGAGRPIIRGLDGPRVRVLENGIGTLDISSISPDHAVTAESLNASQIEILRGPSTLLYGSGASGGVVNVVNGRIPKQLFKSIKGNIEARGNTATEERAGAFNASGSIGQASWSVGGFKRKTDDYHIPGRANESDPGSRKGIVGNSAINSGGLSGGGSYVGERGFVGGSISRMDNEYGIPGPEGSKIDLKQTRYDLAGELDKPMAGLEKLKVRMGYNDYKHNEIESTGEVATRFKNQGLESRAELTHATVANWNGVFGVQFRNRHFSALGEETVVPVTNSHSVGVFLVEERNWNRWRLELGGRGEYAAQNPKDGHPSRSFGLYNVSAGILWKFLDGYGLSLTGIRGQRAPSTEELYIHGAHRGTATFQSGNNGLRSETTNNLDLALRKTSGMVTWKINIFHNWIDNYIFVQSADTNGDGVADRVNQEGMLEPTGEFLVQNFAQGGARFYGAEAETVLTLKPDEIDLRLFADYVRGKLDNGGNVPRITPLRFGLEFNHRTGPWTSNISATRVMRQNDLAELETSTPGYTMVNMEVSYRIKKTRSNGIRIFLQGRNLLDEEMRVHTSFLKNFAPLPGRALVAGLRGEF

SEQ ID NO: 16597 - protein, 742 aa, Burkholderia thailandensis
MKKHPLAIAVLAGIVSATATVELKAQEMALEEVVVTARKRSENLQDVGFSVSALTKSEIEGQFARDITDLANISPNIVIDDTAQGPGGVAAIFIRGVGVADVEKNFDPAVGVIVDGMFIGSNAGSLLRSIDIESMEVLRGPQGTLFGRNTIGGIINITRSKPTGELGGKIRAGYEEYDTYYMDGIFNFGLGENVGVKLSAAKRDQSKGYYDNDEIGRDVGRNDYQSFGANILWTPTDNLELEYTGQFEETDQDTPPLLNTGQARHVFCSGYGYCSPSVDSTITGDRRKTANVGYIPPDPGDQIIAFSSPDQAVEADMAATFDADTHIIEARWQATDAISVDYVFGSYESDETIISNWDGTPDFLYGTTRPATYEQKSHELRLAWDNGGAVNAVVGAYLWDSEYEIPLRSWVGFVVPGTILDILQKTRQESESQALFADVDWRITDALTLNFGGRYTKDEKSTEQTGNVTANADESWSEFTPRASLRYELSDSLMTYATYSSGYRSGGFNGRVNSPEEATQPYDPETVNNFELGFKHQSSDNRLRFNGAVFYMVYDDKQEELQLPSDTGTGQKTVVTNASEAEIWGVELEAQAIIGEGLTLRANVGYLDTEYDSFGYTDLQSGQEVDFSYLEFRRAPDLTGTVDATYEWPTASGRVWVRGAYHYLGEHYVNVTNAPELKNDGQHLLDASVNWEINDLRLSVFGRNLSDEDGYTHGYDVAGLWSYAATRPPRTIGAEIVWNFGE

SEQ ID NO: 16598 - protein, 400 aa, Burkholderia thailandensis
MKKRTAVAMTAAGLAAVATAHAQSSVTLYGIVDNGIAYQSSSTSLGSTTGGRSAVKMSTGVWAGSRFGLKGSEDLGGGSKAIFQLESGFSTANGTSQFAGGIFTRQAWVGLTNPTYGTLTAGRQYTAYYTLLSPYSPTTWLTGYFGAHPGDIDSLDTSYRTNNSLVYLSPKFYGFTFGGSYAFGGQPGSVNAGSTWSAGIQYMNGPLGIAAAFQRVNNSTSGGGDWGANSTTSNGGAQTAVSVINNGYKTAQAQQRVAVTAGYQFSSAWDISVSYSNVQYIPGVNSAFRNTAIFNTAGAVLHFKPSAQWDFAGGYAYTRATQSNGITSAAQYHQFTLSQYYSLSKRTGLYAVEAYQRANGKTLAGGKIIDATASIGDGFNTSPSSSRSQVGVGVGLIHRF

SEQ ID NO: 16599 - protein, 384 aa, Burkholderia thailandensis
MKNIRFACATAGVLAATAAHAQSSVTLYGLIDAGIMYTNNVASGNSHGGLVQATTGAVNGSRFGVRGTEDLGGGLKALFVLENGFNAENGKLGQDGRQFGRFAYVGLSDNRFGTLTIGRQYDSLVDFVAPLSATAGTFGDASFAHPFDSDNLNHSLRINNAIKYTSNTYAGLKFGGMYAMSNSTDFATNRAYSFGASYTRGPLNVAAGYLQINGSKGTTAGSPGAVDIVESAANGKGGFSLGADRMRSYGGGLNYAFGPATLGFVYTRAEYENTASFGSTGGTVRFNNYELNGKYQLTPAFSVGGAYTYTDGHVENTVKYGSDPKWHQVDLMAVYRLSVRTDVYLEGMYQHASGRNYVAMINTAGGASSTGNQVVAAVGLRTRF

SEQ ID NO: 16600 - protein, 941 aa, Burkholderia thailandensis
MKIRTRSTDNGLEGALRRRCLAGAALVALVVPLTALPALAQEGTQGGIEEIVVTGSRIQRSNLTAPTPVQVIDAATIQLKGSTNAADLINELPAAGVPGVSTTNSNFLVSATGLNLVDLRNLGTDRTLVLVNGRRHVGGIEGSTSVDLNSIPSDFIERVEVVTGGASAVYGSEAIAGVVNIILKRDFQGASFSAQSGVTDEGDGENYNASATFGSNFAEDRGNIIVNFTYDKTNEVESKDRAISEVDAFSSADGVISRPALSSYGPGGRFIIPGVGNRNPDGTPFVTAVNGYNRNQDRLIAVPIERYLLSTITRYDLVEDVTFFFEGTYARTETSSRSEPIAFGDNTTIGVGIDAPVLSIPVTNPFIPAGLRSLIPAGTDEILFARRFNEIGPRESDITRQTFRFATGFEGELANGWNWQTYYQFGKVTQDQISTGVFNVVRMQEALNAEAGPGGALQCSDALARAQGCVPIDIFGTGTATGAGLDYVTANSTFDSTIQQQTAGAFLSGDVVELPAGPLGAAVGLEWRKEESEFRPDALSIAGISSGNQSAFTAGEYDVWEAYAETVIPILSGLPFVESLSVEGAVRYADYSTIGNVWAYKAGAEYQPVPDVRLRGVWSRSVRAPNIGELFTPPRQTFVSVNDPCAGVVAGATDTVSANCLATPGIAQAVAAGGFNPTQLDLSSIPGFNSGNSTLQEEKADTLTLGVVFTPSFIPGLALTVDYFDIDIEDAIQGFGTQTTVDQCVQQPTYPDNIFCNLIRRDPTTGLIVEINSQQENVATQTAKGVDVELDYRFDLADGSLNLNLIGTYLIENENVPFEDADPVESAGSVGLSKYRFNLRTTYDQGPLTFSWLLRYIGAANIDNESEFPSNRIGSHIYNDIQARYRVAEGYTVFAGIDNLLDEKPPLIASPFDANVTGTETAADVYDPVGRFFYVGVRAEF

SEQ ID NO: 16601 - protein, 732 aa, Burkholderia thailandensis
MFQHFLFFHPGQAAFKYSVLSLMILQTQHVMATDTSEASKITAVLPTLKIEAMSELDPIKSYIDYDQANVTRSGLKKKDVPQTIDTIDVQKYKIYGANDLSVMLQGTPGISTNYDTRGDGIVLRGFNADTSDIYRDGIRDSGQIRRSTANIERIEILKGPASVLYGRSGGGGVINMVSKYANFDSKSSIGVYAGSWNNHGTTLDLNQAINENWAVRLTSEYAEADSFRRGIEQRQVMVSPSITYRNDDQTLLWTTQYTYDKLHRVPDRGPSYFDLAKNNVFPSIRQGFAHQGDFIDDESQVIRTDLKYEYVPNWNFHWALSYRQAYQNFDNYFGGTYCTVQSATCLYQGFIRQSYAWQQTMNKTITNTFDITGELNTGPIQHNVMLGTDVTKEIREPKLGNYSSGSISLYGYFNPYTGQVIETFDRNNAQMTTHNLSEGLNLGFFAQDLISFNDQIKLLLGGRYDVYDSSTQVKVKNKLDVDEYYAKQEGTFSPNVGLIWQPVSAHSFYTSYSRSFAPFGGSVAVNSVSSNVVNAEPQFNDQFEIGVKSDWLDQRLNTQFSVFDIRKHNIRYQPDRDNQPDLWAVAGEHQSKGLEFGFIGRMLDNVFVRGGYGYTDAKVKDNVQYPNTVNAPLDKVSKNTGNLFIRYLPIESVYVESGVTYQGSFYSYQNGNLNSTPVHIDGFSRVDAAIGYSADPWNVTLAINNLTDKKYWRSADLPGTPRNVLVRLNYQF

SEQ ID NO: 16602 - protein, 613 aa, Burkholderia thailandensis
MPRLYYTPIAFALTTLFSATSIAAAPPISEQDTRDDIVISASRVETKRIESGSSVTVLDEQYIKENQARTVAELLQDVPGVSVASNGGLGQATSVFIRGANSNQTLVIIDGIEVNNLGNFEGGYDFAYLMADNIERIEVLKGSQSALWGSDAMGGVINIITKKGKAGFHPTASIEVGGNNYHKENVTLSAAQGNSHYSLSASNMKTDGISATDTDPDDDGYKNQSVSLKAGHQFTDIFSMDTVLRYNDAETEYDSGYTTNSQRQAKLSSHLNLLNNQWKNRLSVAFSDSNTEDFSSWGDSKYEGKKIKTDLQSDYYISAINGYTQRISFLAEHESDKYQSLSMTQDERIEASGVVLGYGVDWAKTIFVNVAVRSDFNNKFDDTTTYHIDTSVWVNDGTRLHASHGTGLKNPNLGQLYGENASWGYVGNADLKPEKSRSWDAGVEYNFVGTDAYIDLTYFDSLYTDMHTWSGSFPNSTYINLNNKATARGIEFTGKVKVSNKLRVNTGYTYMETNDGNGNELARRPKHAASINANYKYTPELSANIGARYVGKRLDSDDSTLSSYTVVNISTAYQIQEHITLSARIENALDKDYQEVSGFNTDPLTAYIGFSFK

SEQ ID NO: 16603 - protein, 5585 aa, Burkholderia thailandensis
MARRKSDLMFWGRDLTRLLRGRTARLSAGVAFLSLILPAGGAREVRADSVIVTDQSGFTTAVDSAITVGQPTSITAQGGSTFVASPGWNFPGTASTLLLTFNTSPFAIGTASGDADITVGSSTTLTLNTTSGTSAGRMEIGNGGAGTLNLAGGTIQVNLADTSTAPGTSIGRIWVGGGATNTTGGTGTLNMTDGELLYVANAGSLNYGGLAIGRGSSVTGLFNQSGGTVRFSSAGSLDLGTQGGTGTYALSGNAVFDAASGGMTAYIGSRTSGAGGSGTASSGTLTISDNAQFSMTTGSFAGGQLYVGDSKGSGTITQDGAGSVVTLALSNPIRFGSDVSNYGTGGSGVYNLSAGTLSVQNAGGSAQIIFGASSGGTGSFNISGGSATVATTLVLASVSGSTGTVNLTGGSLTLSGSSYLNFGSGTGTFNLSGGSFTVGGTNGIRGTGQFNFGDGTLIAGSALTTSNAMTLVNGKTATINTSGTTATLSGVLSGAGALRKSGAGTLTLSASNTYSGGTLIDAGTISAGASTALGSGIARFTGNSTLAFTSGTSLANAVVVDSGITGTLSLASGSATLSGNLSGAGNITKSGAGTLVLTGTDSRTGATSVTAGTLTAGAAGALSSSSAVDVSAGAILTLSANQTIAALTGSGQVQTNTSTLVVSGNGDTTFQGTITNGGQAWDSSYGIFTKQGTGTLTLSNATITGGETHVENGGLAVTSGTSSVDYLAIGTGNGNTGTLTVSGGTLNIGTALQVGDWSGTGTVNQSGGTVNVQPTCGDLTHCASLNIGNQGGTGTYNISAGTLNLVGGINNLGRSTGSRPASAGTLNISGSGTVVVQTDANGPASLILGNRESGATNQGTGTIIQTGGALTISQSSHLYLSAYGNGRYDLLGGTLQVGGSDGLVGNFAGSGTYQFNFGGGTIQVIGADLNTSVNAALVSATTSTIDTNSFNAALSGVVAGAGALTKTGTGTLTLSGTNTFTGGLTINTGTVSVASEANLGDGASALTLAGGTLAATSSFTTTRAIHLDTAGGTFSVASGQTLTLDTQVDGGGALTATGGGTLVLNAGNAYTGGTTISGATVQIASDDAMGDTGSALTFSNGTLQTTATLSSNRQVSLSGTGTVSPGSGTTLTLNGVLSGTGGLTVNGAGTLLLTGTNTYSGGTTISAGTLQIGSGGAAGSITGDITDNAALIFNRSDSVTYGGTLSGTGTLTQAGSGTLILTGTNTYSGGTTISAGTVQVEADAGLGSGVLTLAGGTLSTTGTLSSTRNVTLSSGSSISAAADTILTLGGVISGTGALTVNGPGTVVLSGTNTYSGGTTVSAGTLQVGAGGTSGVVAGDITNNSAVVFSRSNNVTYSNVISGTGSVTQAGSGTLTLSGTNTFSGGLTIAAGSVSVGSDGNLGATSGEVTLFGGGILSTSADFSSGRTFHLGAGGGTINAATATTLTLTGTVDGTGTLTKAGSGTLILSGTQSYTGGTTVSAGTLQINATSFSSDIVNNATVTFNSGLTYAGAISGSGAVRKIGTDTLILSGTNTYSGGTTISAGTLEVASDTALGTGTLSLGGGTLSTTSTFTSTKNVALTSSSSVSVATGTTLTLSAIVSGTGFGLTANGAGTLVLSGVNTYTGGTTIAGGTVQIAANSGLGTSGGVTFSGGTLVATGTFTNSRATTLSTGSGGTFAPAAGVTVTWNGVISNGGALTMSGAGTLVLGGINTYTGGTTINSGTVSINAETRLGNTSGALTMAGGTLATTASITIGRAISLTGAATISPSGTTTISSGMTGSGGLTKSGAGTLILTGANTFSGGTTISSGTLQIGNAGTTGSITGDVTNNATLTFSRSDTLTYGGTISGTGAVSKVSGGTLTLSGTNTYSGGTTVSAGTLQVSADANLGDASGSLTISGSSTNLVTTASFSSGRAVILGNGFIKPDAGTTLTLSGVLSGTLLRMGGGGTLILSGTNTYTGTTSISGGGTLQVSADANLGAGTGISFTNGTLATTGTFSSARTVSLNSAGTFAPSTGTTLTLSGDISGSGGLTQAGAGTLILSGTNTNTGGTTVSAGTLQVSSDANLGDSTGALTLAGGTLASTATFSSSRSVLLSGSSVVSAATGTTLTLSGVVSGSGGSLTKAGSGTLVLSGANTYSGGTTVSGGTLQIATANNLGSGALTLSGGTLATTSSLTYGSNVSLAANSGVAPSTGTALTLAGVLSGTGGLNMAGPGTLVLASSLNSYSGGTTLSGGILQLSSDGNLGASTGGLTLDGGTLAVVADITSARTVSVTGNSAINTDPGLTLTLTGSISGSGAYSKTGDGTLILAGADTHTGGTAVTSGTLQVGDGATSGSLAGDVLLDGNSSLVFNRTDAAIFAGEISGNGSLTQAGTGTLTLTGENSYGNGTFISTGTLQIGNGGTSGHISGDVSNGGALVFNRSDDVTFDGTISGVGSVTQAGTGTLTLTADNSYTGGTAISAGTLQVATDAKLGDASGGLTLSGGGTLAASGTFSSNRGITITGSGSFAPAGIATLTLNGVIAGTGSLTLSGDGVLALTATNTYSGGTIVSAGFLQIASDAALGNAAAGLTVSGGTLQTTADLTSARAVTLTGTGIFAPDSGTALTLSGTISGSGALLMAGAGTLILSGTNTYTGNTTISSGTLQVAADNALGDLSKSISLSGGTLATTATFSSTRAFALGAAGGTISTANGTTLTLGGVVSGPSGALTKAGAGTLVLTGTNTYAGGTTISAGTLQIGDGGTTGRILGNVVNSAALAFNRSDAVTFAGVISGSGAVTQAGTGTLTLSGTNTYSGGTTISAGTLQISSNANLGDAAGGLTLSGGTLSATADLTTARAVSLTGSGTFAPAAGKVLTLSGVISGTGSLTMTGAGRLTLSGANTYSGGTMVSAGTLVISSDGNLGDAAGSLALTSATLNTGNSTFTSARAVSLSGSNSIFTTGAGTLTLSGIVSGTGSLNKGSAGTLVLSGTNTYSGGTTLSAGTLQVASDSNLGDASGALTLGGGTLATTASFSSARAITLTGTGAIVPASATSLTLSGVLSGTGDLTMSGAGTLILTGANTYSGDTTISAGALQVGNGGTSGSISGDLVNNAALVFNRSDALTFGGAISGSGTLTQAGSGTLTLSGTSTYSGGTTVSAGALLVSGSIAGAVSVASGATLGGGGSIGGAVTLASGARLAPGVSGTPGTLSVGALTVSSGATLAFDLAQPNSPSSGLNDRIAVSGNLTLAGGLLTVNGGGTFQTGSYRLIDYSGSLILTGGGLTLSGAPPALASSVIQTAVAGQVNLVTLADGVSTQWWNGAGTAGSGTISGGAGTWSGTASNWTNVNGTIAQSWIDGGIGIFTATAGTVDVSGAVSASGLQFATSGYVLSGTGTLSLVAQAGGDAPYVQVDSGSAEIATVVAGTAGLTKTGAGTLVLSGTNTYSGGTTLSAGALQVASDSNLGDASGALALAGATLATTASFSSARNATLTGSSAIAPASATMLTLSGVLSGTGALTMSGAGTLVFTGANTYSGGTTIASGTLQIGSGGTSGSISGDVVDNAALVFNRSDAFAFGGAISGSGTVTQAGTGTLTLSGTNSHTGGTTVTGGTLRVSSDANLGDASGALALSGGTLATTASFTSGRAVTLSGSSAFVPASATSLTVGGAISGTGALTLSGAGTLILSGTNTYSGGTTIASGTLQIGAGGTTGSIAGDITNASALAFNRADTAVFAGIVSGTGSLTQSGSGTLVLTGASTYSGGTTVAAGTLQIGNGGTSGSIAGDVVDNAALAFNRSDAVTFTGSISGTGTLTQAGSGTLTLTGANSYSGGTILSAGTLRVAADANLGAAAGGLTLAGGTLATTASFTTNRAVALTANGTVSPAASTTLTLSGTMSGAGSLTQVGAGTLVLSGTNTYSGGTTVAAGVLQVASDASLGTAAGGLSLTGGTLLSVASFASDRAVTLTGNGIFTPASGTTLTLGGTISGSGQLTQAGPGTLVLDGTSSYVGGTTVSAGTLRIGGGGTSGSLAGAIANSGTVMFNRSDDVTAGGAITGTGALIQQGSGKLTLAGANSAGAGTTVSAGTLELPNGVTLASTILVQSGATLQGATDGTGGPSVNGTVTVQNGGILNAMVAGVSGLNGLSMAGLSLSDLANVNVTLGANTGTAAFSADTLTLDGILNVADGGAMSLGVYRLLSYTTLSADNGLVLGTTPTSFAYEIQQAPGEVNLAVLSGDMLYWNGNATTPDGTVHGGSGTWTAAGSSQNWLTSPLNQSRAWNSQFAVFSGTAGTVTVDGSVTTTGMQFMVDGYAVNGGSIALAATSGRTPVRVGDGTSAGAGFTAAIGSELTGTTGLEKTDLGTLVLTGANSYGGGTAVTQGRLQIGNGGTSGSITGDVAVASGASLAFNRSDAITFGGAISGTGGLAQLGTGTLTLTGSNTFTGGATIASGTLQVGDGGTSGAIAGNVADNGRLVFNRADAITFADAISGSGSLTKLGAGTLTLSGANTYSGGTDIAGGALALTGSLAGDVSVRDQTTLSGTGAIAGTVRVLTGGVLAGTQPTGLTMGGLDLDAGANVNVTLGNPAGGGVFTVNGDVTLDGTLNVTQSTGFGSGLYRIVSYTGALTDNGLDLATLSGGFSGEVQTSVGGEVNLVVAQSGGSVRFWNGAQTTPTGTVVGGSGTWTAGAQTNWTTAGGDISLPWNGTFAVFQGAAGTVTVDNSAGQVSVAGLQFVETGYVVGGGALALTGTGPAIIRVGDGTAASATRVATIQSALTGSTGMEKTDLGTLILSGANTYTGGTTISAGTLQIGNGGAAGSILGDVVNNAALVFNQSGTTRFDGVISGTGSVTQAGTGTLTLGGANSYAGGTTVNGGTLRLLSAQALGQGGLTLNGGGTLQASDSFTYAGGILLGGAGPAAGIAVDADKTLTLSGALSGTGALAKTGTGTLVLTGNNTYTGGTTVSAGTLSGNAASLQGNIVNNAALVFNQTGTGTYASVISGIGSMTKTGSGTLILTGNNTYTGGTLISEGTLQIGNGGTTGDIVGDVVNNASLVFNRSGTYTFTGAITGSGTVVFSGGGQVQFSAPYTGAVAVDNTFLRMAPGTTSASSFTVNAGGVIGGTAQIGGLTVNAGGTAAPGYSPGTLTVNGSVSFNAGAIYAVDVTPQGAHDLIVATGSVSLSSSASVQVAAVPGTYPLRSTVTILTTSGTLIGTFGSVTSNYAFLQPELSYDQQNVYLNLVYTGTQFIDYAQTPNQGSSAAAAQALGAGNAVYDALLAQPATGVAPALNQLSGDIYPSLSTLAQQESIYLRDAVGTRLRQAAATGSGALSSAARLGGPGTAALSRDLAPTLWAQGYGGWGNLFSNGNAASLSSSVGGFLAGLDATVLDTVQAGIVGGFSQTRFDANARNASGTMDNYSVGLYLGTQQGPIGLRGGVSYTWHDLQVARTVAFSGFSAAQSAGYTLGTTQVFGEASYRMGLAGYELEPFAGLAYVAVSGGSAIETGVGGANLTMQVGGQQALYSTLGARAATSLTLGGRTLTPSLTLGWQHAFGDTASTADMAFVGSTAPFQVQGLPIARDTLLTGAGLAYALSDLATIQVNYSGQIAAQASQNAVSAQFSLRF

SEQ ID NO: 16604 - protein, 371 aa, Burkholderia thailandensis
MGFQSRKMMVALVAAGPALACAQTSVTLYGRVDGGVEYLNHIAKPSGGSASRWSAESGDWGTSMFGLKGAEDLGGRTSAIFNLETAFQVMNGTTGGGRMWSRRAYVGLKNDTWGTLQAGRNLFIDSDGVWEFDPFVQQAFSSASLVRGRNWQQTSNNVEYHSPVFGGFDVQAQYAFGNQSRGFNYGAQGDFGRSEGVMVSYHSPLLDVRGIYDELRDSNGRMSNIFSSSREYFIGANVKVQKFKIQGAYTHYSAPDTPAGLADRADHFWLGATYQADPQWAVTGGGYYVRVRGGDGGDASHDPSGHAIMYALGTTYNLSKRTFLYGTLAYVRNGGNSNFSLLATPRDATPNTSPLAGESQTGAYVGMMHTF

SEQ ID NO: 16605 - protein, 530 aa, Burkholderia thailandensis
  misc_feature (82)..(82): Xaa can be any naturally occurring amino acid
MQSPATKGTLALAVLAVSLIMAGCASMGDNKPQSARIEANALDAGAAIRAADRDAGWPAADWWRAYRDPQLDTWIAAAQAGXPDARGRRGRVREAQAMARVARSAELPQINGNLSLMRQHWPDNVYYGPGPLANTDTWNNTGTLGLSYHLDLWGKDKNATERALDTAHATAADARAAKLELEVNVVRAYVGMSMNYALLDLAHETFERQRSLADLARKRLQAGLGTQLEVSQAESTLPDYERQIDSYEEAIQLARHQLAALAGKGPGAGDAIKRPRLSLDAPAGLPSAMPADLLGRRPDVVAARWTVDAQARGIDVAKASFYPNIDLLATVGGFGVTAPFTDFLRAMNGGWTAGPALSLPIFEGGRLRAQLGAANAGVRPGGRAIQPDDRRRAQGHRRPGRADPFARYAEEGRRTLGGRQRPQLPAVARRLPPRPDRLRQRAGRAAAIVGAHRKRPPHRSERLAAHAQLMAALGGGVETGTDVPGSQSSHGESAAGAAAPAAASGAKPVAAAARPAQVAAAGAAGVPAAR

SEQ ID NO: 16606 - protein, 817 aa, Burkholderia thailandensis
MGGTGVLNISGGASFSTATTTVVGGSFEGHGTVSIDGNGTTYSNGGTFAVGVGSEGQLEVTDGAALNTQRFYLSFSGATGLTTVSGSNSTLTTSGETIIGRRGRGELTLSNGGRVIVGSDGSGTLDIAKPDIGGTNSRGTLNIGAAEGSAATSPGFISAKNVVFGRSTGEIVFNHTSDNYSFAPNISGPGSVRFVAGTTILNGTNSYTGTTTVQGGTLSGNTASLQGDITIDAGATLEFNQSTNGSYEGDLTGSGALEKTGSGTLTLDGDEHAFTGIATIRQGMLLVGSSPVSSGAVLPGSVVIGQDGMLGGHGSINGNVSNNGGRIAPGSSIGTTTINGNYSGAGTLEIEVQGEADPTLDASDQLIVNGTFDASDTVLEVLFLQRRYGQNFVPTSTLVIVENDGADSIIGTFADVEDNLAFFDSSLDYATGTGNDIALSLVRNSVSYADLAQTRNQSATVAAIESLGSSNPLHMALLAANANGSDAREAYDLTSGEINASARAILIDDARYVRQRINDHLFAIGKQRDDGLVEPEKTAAIGSLSFWTEVYGSYASFGGDGNAATTDRNVGGMLFGADGEVHEFLRLGLVAGFSRSDFNVSSRLSSGDSENYTVGGYAQLPQINALPVSLQGGAVATWHQLRFDREVTGLIADELESDQNATTLQVFGELGYDWQLGEARMQPFVGVAYVHLFSKGYREQGNDAALSADNQNEGITFTTLGLRSDWDFSIGGLSTTLSGLAAWQYASQDTINFTQAFISGGNPFTITSVPISQNVALLEAGLDAHLTDTARLGAAYYGLLSDDAQDHGFNIRLLWQY

SEQ ID NO: 16607 - protein, 839 aa, Burkholderia thailandensis
MRVLRGSLIASVALLPGQVMAQAAGGGQAVTLDEISVVSNTPVAVSRRVVATPTASGLREVTVLDGIDRNKLPQNTSVLTSGDVSRVGFPSTVRALDERVGSISINNAQGNPFQPTITYRGFEASPLGGSPQGVAVYLNGARFNTSFGDTVQWDLIPDIAVDRIELEGSNPAFGLNALGGSLAVTLKNGFTYQGSEINVLGGSFGRGAVAFQHGQRIDNIGLYVAGTKLGEEGWRRHSPSRLNQIYADLGVQGERSEFHFNVIGASNSLTGNGTAPVELLKVDRSDVFTYPDQTKNDFLRFQLSGTYDVTPTISVQGNAYYGLFRQRTANGDAADVENCEADERFVCSEGADDNQFFLRDRTGNPVAANRLRTFDFGGINPVFADRFDEGGPYAFLNQTRTDTDNFGATVQTVIREPLFGLPNRFVLGGSYDGGRTRFTADNSIGGLTLDRGFSPPGIVVSSDDGIITPVSVRTSNDYGGIYFNNNTDLTDRLTLTLQGRFNMAKIVLRDQIGTALNGDHYYQRFNPGIGATYKVIPDYLVAYGGYTEANRAPTPAELSCADPLAPCSLTNFFVGDPPLKQVVARTVEAGVRGRIPQPDEFFGGILSWKAGFFSTRNDDDILFVPAPDTIGRAYFRNVGSTKRQGVEASLFYNAPRWNAFIDYAFVDATFESPVELAAPGNPFNSAGGDESGVVLVRPGNRLPGVAPHQLKVGVQYQVTPEWRVGALARFATGKFLVGDPTNQNKTTGDYAVFGFNTSYRVASNIEIYGYVENAFNANYATFGTFSPVDEVPIVRVPNATSNRSLAPGAPVAAFGGLRILFEPPPPAPVVEPLPLVRKG

SEQ ID NO: 16608 - protein, 429 aa, Burkholderia thailandensis
MTIIRTSGAVAGLCGLAVALSGGSAWASGFQLKEQSAEGLGNAFAGATAKAYDPSTAFYNPAGLTRLKGTQADSVLTYIMPKAHFSGSGTNALGGSTGSIEGGDAVADAAVPSFYGVYSYNDDLKFGIAANVPFGLRTDYDKNWAGRYQAIESDLQIVTLTPSVAYRVVGDSSFGDFSIGGGPVVQFASVKLTNAVNNFGLVAGDGRAKVSGSDIGYGFNIGALWEPTETTRIGVNYRSRVEHNFDGDAKYTNVARPLAISRGLVNSGASADLTTPDVVSIGAYHEFDPQWAVTADVAWTNWSLFDELKIENDKGGVITRVDESWEDTMFVALGGIYKPVEDVALRIGVAYDQAPVGKKHRTARIPDTNRYWLAAGVSYAVTDSFSLDASYAHIFADRVSINETTAQGNLTGTYDSSIDILSASATLRF

SEQ ID NO: 16609 - protein, 203 aa, Burkholderia thailandensis
MIRWMNEPLWPFIERKKSMRNLVKYVGIGLLVMGLAACDDKDTNATAQGSVAESNATGNPVNLLDGKLSFSLPADMTDQSGKLGTQANNMHVWSDATGQKAVIVIMGDDPKEDLAVLAKRLEDQQRSRDPQLQVVTNKAIELKGHKMQQLDSIISAKGQTAYSSVILGNVGNQLLTMQITLPADDQQKAQTTAENIINTLVIQ

SEQ ID NO: 16610 - protein, 238 aa, Burkholderia thailandensis
MNNVKLLIAGSAFFAMSAQAADRVSIDVKVTLEAAACTPILSNGGVVNFGSHSVNRLSTQHYTQIGTRNINMTITCESATGIAITARDTRMDSMTTGKDSGGQSGVKYTLNGGGYISQTTRLFGLGKTKDNKNIGSYAVLIDSNNISASNGSQTLAVSIAGADAVITGQKRAWQTLTAYPLAVDQSYYYTFVKPGETTPTPVTNAIIPLQVSASIANDLGGSEKIELDGKAVISVVYL

SEQ ID NO: 16611 - protein, 381 aa, Burkholderia thailandensis
MNKRWGIIVPAALLATAAHAQSSVTLYGKIEDGINYTSNARGHGTVQLQSGYDYGSRWGIKGTEDLGGGYQAIFQLESGFDVNTGKMSQGGREFGRQAFVGIASDRYGTLTFGRQYDPSVDIFSPLTANGNWTGYLFAHPYDNDNTDYSFRVNNAVKYVSPVWHGITAEAMYGFSNQSGFANNRLYGAALQYQQGGLTVGASYLKINNAHNGDSNGAITGDNTFDASSQQNIGIGVNYAFANALIGFTYSHVDVYDPTANAYFTGTTQPAGGSWNAWKFDNFEVNGLYHFTPALYLGAAYTYTQARVSSTVGSFNPKWHQLSTKLNYDMSKRTSVFVEGVYQHAMNAHTGTDFDYAYVPGAADISSGPNQYVVRVALLHHF

SEQ ID NO: 16612 - protein, 935 aa, Burkholderia thailandensis
MELPLGTTASGTEGSQGHFNNVWTKSELTMLMNLPGCTLKPLALAVRRHPRALLCALAMGMSGAQAADAVDADTSGSAVSTSAAVVPATTQLQRVEVTGSAIRRVDAETAVPITILRADDLKKQGVTTTQEMVQRITGSQSINNSAGSVGAGTGGASFADMRGIGANKTLVLLNGRRLANNALSGVGTPNGSAIDLNMIPFAAIDRVEVLRDGASALYGTDAIGGVINFITKKSLTDGSLTLGGETPTASGGGATKDMSASWGFGDLEQDRFNVMGVFNYNKQQNLDANDRSFARDYVPGRGLNQTSGTAYPGNYFQGDNSANPLGRNCSGPNLIASNGICRFSTREYIDLIPQTEKTSFFGKATGKLADDHNVSLEYFWARNNNHTDIGPAPLTGLSLDSSSPFYPGNGITPAPTDFTLDPTQPISTAWRETAAGPRGSSDQNTSQRFLLNFDGLVGGWDYNVGASYNQNKVLSSLTNGYVSDAAMLNGLANGTLNPFGPQTTAGQALIDASEYHGQYSSAVGRVAGLDARISREIGDWFGAGPAGLALGGEYRKEKMHQQYEAYVNDISSLGADAAGSVEGDRSVKAQYAELNVPVLDSLELTAAVRHDKYSDFGSTTNPKYSFRYQPFKQLVVRGAYSEGFRAPSLYELYAPRSTTFTQGYYNDPVLCAGGVVQPGGNAGRDCQQQFLNNGGGNTELAPEKARNMTLGFVYQPVNNLSMGLDFWWIHISNQIQAFPESTVFDDPNTYADRYVRAADGSIANIVTGNANLGIVKTSGVDVTLDYRFPNTPYGQFGLGMTGTYVTRYDFQNIIDGPYTDKVGDFQGDGVISRWKHVLTGTWALGDTRASITSRFTSGYNDYDRTTNARVASYALWDMSVGHTFDKVLDIDAGVRNMFDRNPPFSNQAYNFQSGYDPRYADPLGRTLFARATYHF

SEQ ID NO: 16613 - protein, 1016 aa, Chlamydia trachomatis
MPFSLRSTSFCFLACLCSYSYGFASSPQVLTPNVTTPFKGDDVYLNGDCAFVNVYAGAENGSIISANGDNLTITGQNHTLSFTDSQGPVLQNYAFISAGETLTLKDFSSLMFSKNVSCGEKGMISGKTVSISGAGEVIFWDNSVGYSPLSIVPASTPTPPAPAPAPAASSSLSPTVSDARKGSIFSVETSLEISGVKKGVMFDNNAGNFGTVFRGNSNNNAGSGGSGSATTPSFTVKNCKGKVSFTDNVASCGGGVVYKGTVLFKDNEGGIFFRGNTAYDDLGILAATSRDQNTETGGGGGVICSPDDSVKFEGNKGSIVFDYNFAKGRGGSILTKEFSLVADDSVVFSNNTAEKGGGAIYAPTIDISTNGGSILFERNRAAEGGAICVSEASSGSTGNLTLSASDGDIVFSGNMTSDRPGERSAARILSDGTTVSLNASGLSKLIFYDPVVQNNSAAGASTPSPSSSSMPGAVTINQSGNGSVIFTAESLTPSEKLQVLNSTSNFPGALTVSGGELVVTEGATLTTGTITATSGRVTLGSGASLSAVAGAANNNYTCTVSKLGIDLESFLTPNYKTAILGADGTVTVNSGSTLDLVMESEAEVYDNPLFVGSLTIPFVTLSSSSASNGVTKNSVTINDADAAHYGYQGSWSADWTKPPLAPDAKGMVPPNTNNTLYLTWRPASNYGEYRLDPQRKGELVPNSLWVAGSALRTFTNGLKEHYVSRDVGFVASLHALGDYILNYTQDDRDGFLARYGGFQATAASHYENGSIFGVAFGQLYGQTKSRMYYSKDAGNMTMLSCFGRSYVDIKGTETVMYWETAYGYSVHRMHTQYFNDKTQKFDHSKCHWHNNNYYAFVGAEHNFLEYCIPTRQFARDYELTGFMRFEMAGGWSSSTRETGSLTRYFARGSGHNMSLPIGIVAHAVSHVRRSPPSKLTLNMGYRPDIWRVTPHCNMEIIANGVKTPIQGSPLARHAFFLEVHDTLYIHHFGRAYMNYSLDARRRQTAHFVSMGLNRIF

SEQ ID NO: 16614 - protein, 1014 aa, Chlamydia trachomatis
MPFSLRSTSFCFLACLCSYSYGFASSPQVLTPNVTTPFKGDDVYLNGDCAFVNVYAGAENGSIISANGDNLTITGQNHTLSFTDSQGPVLQNYAFISAGETLTLKDFSSLMFSKNVSCGEKGMISGKTVSISGAGEVIFWDNSVGYSPLSTVPASTPTPPAPAPAASSSLSPTVSDARKGSIFSVETSLEISGVKKGVMFDNNAGNFGTVFRGNSNNNAGSGGSGSATTPSFTVKNCKGKVSFTDNVASCGGGVVYKGTVLFKDNEGGIFFRGNTAYDDLGILAATSRDQNTETGGGGGVICSPDDSVKFEGNKGSIVFDYNFAKGRGGSILTKEFSLVADDSVVFSNNTAEKGGGAIYAPTIDISTNGGSILFERNRAAEGGAICVSEASSGSTGNLTLSASDGDIVFSGNMTSDRPGERSAARILSDGTTVSLNASGLSKLIFYDPVVQNNSAAGASTPSPSSSSMPGAVTINQSGNGSVIFTAESLTPSEKLQVLNSTSNFPGALTVSGGELVVTEGATLTTGTITATSGRVTLGSGASLSAVAGAANNNYTCTVSKLGIDLESFLTPNYKTAILGADGTVTVNSGSTLDLVMESEAEVYDNPLFVGSLTIPFVTLSSSSASNGVTKNSVTINDADAAHYGYQGSWSADWTKPPLAPDAKGMVPPNTNNTLYLTWRPASNYGEYRLDPQRKGELVPNSLWVAGSALRTFTNGLKEHYVSRDVGFVASLHALGDYILNYTQDDRDGFLARYGGFQATAASHYENGSIFGVAFGQLYGQTKSRMYYSKDAGNMTMLSCFGRSYVDIKGTETVMYWETAYGYSVHRMHTQYFNDKTQKFDHSKCHWHNNNYYAFVGAEHNFLEYCIPTRQFARDYELTGFMHFEMAGGWSSSTRETGSLTRYFARGSGHNMSLPIGIVAHAVSHVRRSPPSKLTLNMGYRPDIWRVTPHCNMEIIANGVKTPIQGSPLARHAFFLEVHDTLYIHHFGRAYMNYSLDARRRQTAHFVSMGLNRIF

SEQ ID NO: 16615 - protein, 1012 aa, Chlamydia trachomatis
MQTSFHKFFLSMILAYSCCSLNGGGYAAEIMVPQGIYDGETLTVSFPYTVIGDPSGTTVFSAGELTLKNLDNSIAALPLSCFGNLLGSFTVLGRGHSLTFENIRTSTNGAALSNSAADGLFTIEGFKELSFSNCNSLLAVLPAATTNKGSQTPTTTSTPSNGTIYSKTDLLLLNNEKFSFYSNLVSGDGGAIDAKSLTVQGISKLCVFQENTAQADGGACQVVTSFSAMANEAPIAFVANVAGVRGGGIAAVQDGQQGVSSSTSTEDPVVSFSRNTAVEFDGNVARVGGGIYSYGNVAFLNNGKTLFLNNVASPVYIAAKQPTSGQASNTSNNYGDGGAIFCKNGAQAGSNNSGSVSFDGEGVVFFSSNVAAGKGGAIYAKKLSVANCGPVQFLRNIANDGGAIYLGESGELSLSADYGDIIFDGNLKRTAKENAADVNGVTVSSQAISMGSGGKITTLRAKAGHQILFNDPIEMANGNNQPAQSSKLLKINDGEGYTGDIVFANGSSTLYQNVTIEQGRIVLREKAKLSVNSLSQTGGSLYMEAGSTLDFVTPQPPQQPPAANQLITLSNLHLSLSSLLANNAVTNPPTNPPAQDSHPAVIGSTTAGSVTISGPIFFEDLDDTAYDRYDWLGSNQKINVLKLQLGTKPPANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTQQALCGSYLFGDAFIRASYGFGNQHMKTSYTFAEESDVRWDNNCLAGEIGAGLPIVITPSKLYLNELRPFVQAEFSYADHESFTEEGDQARAFKSGHLLNLSVPVGVKFDRCSSTHPNKYSFMAAYICDAYRTISGTETTLLSHQETWTTDAFHLARHGVVVRGSMYASLTSNIEVYGHGRYEYRDASRGYGLSAGSRVRF

SEQ ID NO: 16616 - protein, 1013 aa, Chlamydia trachomatis
MQTSFHKFFLSMILAYSCCSLNGGGYAAEIMVPQGIYDGETLTVSFPYTVIGDPSGTTVFSAGELTLKNLDNSIAALPLSCFGNLLGSFTVLGRGHSLTFENIRTSTNGAALSNSAADGLFTIEGFKELSFSNCNSLLAVLPAATTNKGSQTPTTTSTPSNGTIYSKTDLLLLNNEKFSFYSNLVSGDGGAIDAKSLTVQGISKLCVFQENTAQADGGACQVVTSFSAMANEAPIAFVANVAGVRGGGIAAVQDGQQGVSSSTSTEDPVVSFSRNTAVEFDGNVARVGGGIYSYGNVAFLNNGKTLFLNNVASPVYIAAKQPTNGQASNTSNNYGDGGAIFCKNGAQAAGSNNSGSVSFDGEGVVFFSSNVAAGKGGAIYAKKLSVANCGPVQFLRNIANDGGAIYLGESGELSLSADYGDIIFDGNLKRTAKENAADVNGVTVSSQAISMGSGGKITTLRAKAGHQILFNDPIEMANGNNQPAQSSKLLKINDGEGYTGDIVFANGSSTLYQNVTIEQGRIVLREKAKLSVNSLSQTGGSLYMEAGSTLDFVTPQPPQQPPAANQLITLSNLHLSLSSLLANNAVTNPPTNPPAQDSHPAVIGSTTAGSVTISGPIFFEDLDDTAYDRYDWLGSNQKINVLKLQLGTKPPANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTQQALCGSYLFGDAFIRASYGFGNQHMKTSYTFAEESDVRWDNNCLAGEIGAGLPIVITPSKLYLNELRPFVQAEFSYADHESFTEEGDQARAFKSGHLLNLSVPVGVKFDRCSSTHPNKYSFMAAYICDAYRTISGTETTLLSHQETWTTDAFHLARHGVVVRGSMYASLTSNIEVYGHGRYEYRDASRGYGLSAGSRVRF

SEQ ID NO: 16617 - protein, 1013 aa, Chlamydia trachomatis
MQTSFHKFFLSMILAYSCCSLNGGGYAAEIMVPQGIYDGETLTVSFPYTVIGDPSGTTVFSAGELTLKNLDNSIAALPLSCFGNLLGSFTVLGRGHSLTFENIRTSTNGAALSDSANSGLFTIEGFKELSFSNCNSLLAVLPAATTNSGSQTPTTTSTPSNGTIYSKTDLLLLNNEKFSFYSNLVSGDGGAIDAKSLTVQGISKLCVFQENTAQADGGACQVVTSFSAMANEAPIAFVANVAGVRGGGIAAVQDGQQGVSSSTSTEDPVVSFSRNTAVEFDGNVARVGGGIYSYGNVAFLNNGKTLFLNNVASPVYIAAEQPTNGQASNTSDNYGDGGAIFCKNGAQAAGSNNSGSVSFDGEGVVFFSSNVAAGKGGAIYAKKLSVANCGPVQFLGNIANDGGAIYLGESGELSLSADYGDMIFDGNLKRTAKENAADVNGVTVSSQAISMGSGGKITTLRAKAGHQILFNDPIEMANGNNQPAQSSEPLKINDGEGYTGDIVFANGNSTLYQNVTIEQGRIVLREKAKLSVNSLSQTGGSLYMEAGSTLDFVTPQPPQQPPAANQLITLSNLHLSLSSLLANNAVTNPPTNPPAQDSHPAVIGSTTAGSVTISGPIFFEDLDDTAYDRYDWLGSNQKIDVLKLQLGTQPPANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTKQALCGSYVFGDAFIRASYGFGNQHMKTSYTFAEESDVRWDNNCLVGEIGVGLPIVITPSKLYLNELRPFVQAEFSYADHESFTEEGDQARAFRSGHLMNLSVPVGVKFDRCSSTHPNKYSFMGAYICDAYRTISGTQTTLLSHQETWTTDAFHLARHGVIVRGSMYASLTSNIEVYGHGRYEYRDTSRGYGLSAGSKVRF

SEQ ID NO: 16618 - protein, 1013 aa, Chlamydia trachomatis
MQTSFHKFFLSMILAYSCCSLNGGGYAAEIMVPQGIYDGETLTVSFPYTVIGDPSGTTVFSAGELTLKNLDNSIAALPLSCFGNLLGSFTVLGRGHSLTFENIRTSTNGAALSDSANSGLFTIEGFKELSFSNCNSLLAVLPAATTNNGSQTPTTTSTPSNGTIYSKTDLLLLNNEKFSFYSNLVSGDGGAIDAKSLTVQGISKLCVFQENTAQADGGACQVVTSFSAMANEAPIAFVANVAGVRGGGIAAVQDGQQGVSSSTSTEDPVVSFSRNTAVEFDGNVARVGGGIYSYGNVAFLNNGKTLFLNNVASPVYIAAEQPTNGQASNTSDNYGDGGAIFCKNGAQAAGSNNSGSVSFDGEGVVFFSSNVAAGKGGAIYAKKLSVANCGPVQFLGNIANDGGAIYLGESGELSLSADYGDIIFDGNLKRTAKENAADVNGVTVSSQAISMGSGGKITTLRAKAGHQILFNDPIEMANGNNQPAQSSEPLKINDGEGYTGDIVFANGNSTLYQNVTIEQGRIVLREKAKLSVNSLSQTGGSLYMEAGSTLDFVTPQPPQQPPAANQLITLSNLHLSLSSLLANNAVTNPPTNPPAQDSHPAVIGSTTAGSVTISGPIFFEDLDDTAYDRYDWLGSNQKIDVLKLQLGTQPPANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTKQALCGSYLFGDAFIRASYGFGNQHMKTSYTFAEESDVRWDNNCLVGEIGVGLPIVITPSKLYLNELRPFVQAEFSYADHESFTEEGDQARAFRSGHLMNLSVPVGVKFDRCSSTHPNKYSFMGAYICDAYRTIFGTQTTLLSHQETWTTDAFHLARHGVIVRGSMYASLTSNIEVYGHGRYEYRDTSRGYGLSAGSKVRF

SEQ ID NO: 16619 - protein, 1013 aa, Chlamydia trachomatis
MQTSFHKFFLSMILAYSCCSLNGGGYAAEIMVPQGIYDGETLTVSFPYTVIGDPSGTTVFSAGELTLKNLDNSIAALPLSCFGNLLGSFTVLGRGHSLTFENIRTSTNGAALSDSANSGLFTIEGFKELSFSNCNSLLAVLPAATTNNGSQTPTTTSTPSNGTIYSKTDLLLLNNEKFSFYSNLVSGDGGAIDAKSLTVQGISKLCVFQENTAQADGGACQVVTSFSAMANEAPIAFVANVAGVRGGGIAAVQDGQQGVSSSTSTEDPVVSFSRNTAVEFDGNVARVGGGIYSYGNVAFLNNGKTLFLNNVASPVYIAAEQPTNGQASNTSDNYGDGGAIFCKNGAQAAGSNNSGSVSFDGEGVVFFSSNVAAGKGGAIYAKKLSVANCGPVQFLGNIANDGGAIYLGESGELSLSADYGDIIFDGNLKRTAKENAADVNGVTVSSQAISMGSGGKITTLRAKAGHQILFNDPIEMANGNNQPAQSSEPLKINDGEGYTGDIVFANGNSTLYQNVTIEQGRIVLREKAKLSVNSLSQTGGSLYMEAGSTLDFVTPQPPQQPPAANQLITLSNLHLSLSSLLANNAVTNPPTNPPAQDSHPAVIGSTTAGSVTISGPIFFEDLDDTAYDRYDWLGSNQKIDVLKLQLGTQPPANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTKQALCGSYLFGDAFIRASYGFGNQHMKTSYTFAEESDVRWDNNCLVGEIGVGLPIVITPSKLYLNELRPFVQAEFSYADHESFTEEGDQARAFRSGHLMNLSVPVGVKFDRCSSTHPNKYSFMGAYICDAYRTISGTQTTLLSHQETWTTDAFHLARHGVIVRGSMYASLTSNIEVYGHGRYEYRDTSRGYGLSAGSKVRF

SEQ ID NO: 16620 - protein, 511 aa, Chlamydia trachomatis
MQTSDTRALPLLCARSVYKQYSGVNVLKGIDFTLHQGEVHALLGGNGAGKSTLMKIIAGITPADSGTLEIEGNNYVRLTPVHAHQLGIYLVPQEPLLFPSLSIKENILFGLAKKQLSMQKMKNLLAALGCQFDLHSLAGSLDVADRQMVEILRGLMRDSRILILDEPTASLTPAETERLFSRLQELLATGVGIVFISHKLPEIRQIADRISVMRDGTIALSGKTSELSTDDIIQAITPAVREKSLSASQKLWLELPGNRPQHAAGTPVLTLENLTGEGFRNVSLTLNAGEILGLAGLVGAGRTELAETLYGLRTLRGGRIMLNGKEINKLSTGERLLRGLVYLPEDRQSSGLNLDASLAWNVCALTHNLRGFWAKTAKDNATLERYRRALNIKFNQPEQAARTLSGGNQQKILIAKCLEASPQVLIVDEPTRGVDVSARNDIYQLLRSIAAQNVAVLLISSDLEEIELMADRVYVMHQGEITHSALTERDINVETIMRVAFGDSQRQEASC

SEQ ID NO: 16621 - protein, 1013 aa, Chlamydia trachomatis
MQTSFHKFFLSMILAYSCCSLSGGGYAAEIMIPQGIYDGETLTVSFPYTVIGDPSGTTVFSAGELTLKNLDNSIAALPLSCFGNLLGSFTVLGRGHSLTFENIRTSTNGAALSDSANSGLFTIEGFKELSFSNCNSLLAVLPAATTNNGSQTPTTTSTPSNGTIYSKTDLLLLNNEKFSFYSNLVSGDGGAIDAKSLTVQGISKLCVFQENTAQADGGACQVVTSFSAMANEAPIAFIANVAGVRGGGIAAVQDGQQGVSSSTSTEDPVVSFSRNTAVEFDGNVARVGGGIYSYGNVAFLNNGKTLFLNNVASPVYIAAEQPTNGQASNTSDNYGDGGAIFCKNGAQAAGSNNSGSVSFDGEGVVFFSSNVAAGKGGAIYAKKLSVANCGPVQFLGNIANDGGAIYLGESGELSLSADYGDIIFDGNLKRTAKENAADVNGVTVSSQAISMGSGGKITTLRAKAGHQILFNDPIEMANGNNQPAQSSEPLKINDGEGYTGDIVFANGNSTLYQNVTIEQGRIVLREKAKLSVNSLSQTGGSLYMEAGSTLDFVTPQPPQQPPAANQLITLSNLHLSLSSLLANNAVTNPPTNPPAQDSHPAIIGSTTAGSVTISGPIFFEDLDDTAYDRYDWLGSNQKIDVLKLQLGTQPSANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTKQALCGSYLFGDAFIRASYGFGNQHMKTSYTFAEESDVRWDNNCLVGEIGVGLPIVITPSKLYLNELRPFVQAEFSYADHESFTEEGDQARAFRSGHLMNLSVPVGVKFDRCSSTHPNKYSFMGAYICDAYRTISGTQTTLLSHQETWTTDAFHLARHGVIVRGSMYASLTSNIEVYGHGRYEYRDTSRGYGLSAGSKVRF

SEQ ID NO: 16622 - protein, 1013 aa, Chlamydia trachomatis
MQTSFHKFFLSMILAYSCCSLNGGGYAAEIMVPQGIYDGETLTVSFPYTVIGDPSGTTVFSAGELTLKNLDNSIAALPLSCFGNLLGSFTVLGRGHSLTFENIRTSTNGAALSDSANSGLFTIEGFKELSFSNCNSLLAVLPAATTNNGSQTPTTTSTPSNGTIYSKTDLLLLNNEKFSFYSNSVSGDGGAIDAKSLTVQGISKLCVFQENTAQADGGACQVVTSFSAMANEAPIAFVANVAGVRGGGIAAVQDGQQGVSSSTSTEDPVVSFSRNTAVEFDGNVARVGGGIYSYGNVAFLNNGKTLFLNNVASPVYIAAEQPTNGQASNTSDNYGDGGAIFCKNGAQAAGSNNSGSVSFDGEGVVFFSSNVAAGKGGAIYAKKLSVANCGPVQFLGNIANDGGAIYLGESGELSLSADYGDMIFDGNLKRTAKENAADVNGVTVSSQAISMGSGGKITTLRAKAGHQILFNDPIEMANGNNQPAQSSEPLKINDGEGYTGDIVFANGNSTLYQNVTIEQGRIVLREKAKLSVNSLSQTGGSLYMEAGSTLDFVTPQPPQQPPAANQSITLSNLHLSLSSLLANNAVTNPPTNPPAQDSHPAVIGSTTAGSVTISGPIFFEDLDDTAYDRYDWLGSNQKIDVLKLQLGTQPPANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTKQALCGSYVFGDAFIRASYGFGNQHMKTSYTFAEESDVCWDNNCLVGEIGVGLPIVITPSKLYLNELRPFVQAEFSYADHESFTEEGDQARAFRSGHLMNLSVPVGVKFDRCSSTHPNKYSFMGAYICDAYRTISGTQTTLLSHQETWTTDAFHLARHGVIVRGSMYASLTSNIEVYGHGRYEYRDTSRGYGLSAGSKVRF

SEQ ID NO: 16623 - protein, 1013 aa, Chlamydia trachomatis
MQTSFHKFFLSMILAYSCCSLNGGGYAAEIMVPQGIYDGETLTVSFPYTVIGDPSGTTVFSAGELTLKNLDNSIAALPLSCFGNLLGSFTVLGRGHSLTFENIRTSTNGAALSDSANSGLFTIEGFKELSFSNCNSLLAVLPAATTNNGSQTPTTTSTPSNGTIYSKTDLLLLNNEKFSFYSNLVSGDGGAIDAKSLTVQGISKLCVFQENTAQADGGACQVVTSFSAMANEAPIAFVANVAGVRGGGIAAVQDGQQGVSSSTSTEDPVVSFSRNTAVEFDGNVARVGGGIYSYGNVAFLNNGKTLFLNNVASPVYIAAEQPTNGQASNTSDNYGDGGAIFCKNGAQAAGSNNSGSVSFDGEGVVFFSSNVAAGKGGAIYAKKLSVANCGPVQFLGNIANDGGAIYLGESGELSLSADYGDMIFDGNLKRTAKENAADVNGVTVSSQAISMGSGGKITTLRAKAGHQILFNDPIEMANGNNQPAQSSEPLKINDGEGYTGDIVFANGNSTLYQNVTIEQGRIVLREKAKLSVNSLSQTGGSLYMEAGSTLDFVTPQPPQQPPAANQLITLSNLHLSLSSLLANNAVTNPPTNPPAQDSHPAVIGSTTAGSVTISGPIFFEDLDDTAYDRYDWLGSNQKIDVLKLQLGTQPPANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTKQALCGSYVFGDAFIRASYGFGNQHMKTSYTFAEESDVRWDNNCLVGEIGVGLPIVITPSKLYLNELRPFVQAEFSYADHESFTEEGDQARAFRSGHLMNLSVPVGVKFDRCSSTHPNKYSFMGAYICDAYRTISGTQTTLLSHQETWTTDAFHLARHGVIVRGSMYASLTSNIEVYGHGRYEYRDTSRGYGLSAGSKVRF

SEQ ID NO: 16624 - protein, 1013 aa, Chlamydia trachomatis
MQTSFHKFFLSMILAYSCCSLNGGGYAAEIMVPQGIYDGETLTVSFPYTVIGDPSGTTVFSAGELTLKNLDNSIAALPLSCFGNLLGSFTVLGRGHSLTFENIRTSTNGAALSDSANSGLFTIEGFKELSFSNCNSLLAVLPAATTNNGSQTPTTTSTPSNGTIYSKTDLLLLNNEKFSFYSNSVSGDGGAIDAKSLTVQGISKLCVFQENTAQADGGACQVVTSFSAMANEAPIAFVANVAGVRGGGIAAVQDGQQGVSSSTSTEDPVVSFSRNTAVEFDGNVARVGGGIYSYGNVAFLNNGKTLFLNNVASPVYIAAEQPTNGQASNTSDNYGDGGAIFCKNGAQAAGSNNSGSVSFDGEGVVFFSSNVAAGKGGAIYAKKLSVANCGPVQFLGNIANDGGAIYLGESGELSLSADYGDMIFDGNLKRTAKENAADVNGVTVSSQAISMGSGGKITTLRAKAGHQILFNDPIEMANGNNQPAQSSEPLKINDGEGYTGDIVFANGNSTLYQNVTIEQGRIVLREKAKLSVNSLSQTGGSLYMEAGSTLDFVTPQPPQQPPAANQLITLSNLHLSLSSLLANNAVTNPPTNPPAQDSHPAVIGSTTAGSVTISGPIFFEDLDDTAYDRYDWLGSNQKIDVLKLQLGTQPPANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTKQALCGSYVFGDAFIRASYGFGNQHMKTSYTFAEESDVRWDNNCLVGEIGVGLPIVITPSKLYLNELRPFVQAEFSYADHESFTEEGDQARAFRSGHLMNLSVPVGVKFDRCSSTHPNKYSFIGAYICDAYRTISGTQTTLLSHQETWTTDAFHLARHGVIVRGSMYASLTSNIEVYGHGRYEYRDTSRGYGLSAGSKVRF

SEQ ID NO: 16625 - protein, 1013 aa, Chlamydia trachomatis
MQTSFHKFFLSMILAYSCCSLNGGGYAAEIMVPQGIYDGETLTVSFPYTVIGDPSGTTVFSAGELTLKNLDNSIAALPLSCFGNLLGSFTVLGRGHSLTFENIRTSTNGAALSDSANSGLFTIEGFKELSFSNCNSLLAVLPAATTNNGSQTPTTTSTPSNGTIYSKTDLLLLNNEKFSFYSNSVSGDGGAIDAKSLTVQGISKLCVFQENTAQADGGACQVVTSFSAMANEAPIAFVANVAGVRGGGIAAVQDGQQGVSSSTSTEDPVVSFSRNTAVEFDGNVARVGGGIYSYGNVAFLNNGKTLFLNNVASPVYIAAEQPTNGQASNTSDNYGDGGAIFCKNGAQAAGSNNSGSVSFDGEGVVFFSSNVAAGKGGAIYAKKLSVANCGPVQFLGNIANDGGAIYLGESGELSLSADYGDMIFDGNLKRTAKENAADVNGVTVSSQAISMGSGGKITTLRAKAGHQILFNDPIEMANGNNQPAQSSEPLKINDGEGYTGDIVFANGNSTLYQNVTIEQGRIVLREKAKLSVNSLSQTGGSLYMEAGSTLDFVTPQPPQQPPAANQSITLSNLHLSLSSLLANNAVTNPPTNPPAQDSHPAVIGSTTAGSVTISGPIFFEDLDDTAYDRYDWLGSNQKIDVLKLQLGTQPPANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTKQALCGSYVFGDAFIRASYGFGNQHMKTSYTFAEESDVCWDNNCLVGEIGVGLPIVITPSKLYLNELRPFVQAEFSYADHESFTEEGDQARAFRSGHLMNLSVPVGVKFDRCSSTHPNKYSFMGAYICDAYRTISGTQTTLLSHQETWTTDAFHLARHGVIVRGSMYASLTSNIEVYGHGRYEYRDTSRGYGLSTGSKVRF

SEQ ID NO: 16626 - protein, 964 aa, Chlamydia trachomatis
MKKAFFFFLIGNSLSGLAREVPSRIFLMPNSVPDPTKESLSNKISLTGDTHNLTNCYLDNLRYILAILQKTPNEGAAVTITDYLSFFDTQKEGIYFAKNLTPESGGAIGYASPNSPTVEIRDTIGPVIFENNTCCRLFTWRNPYAADKIREGGAIHAQNLYINHNHDVVGFMKNFSYVQGGAISTANTFVVSENQSCFLFMDNICIQTNTAGKGGAIYAGTSNSFESNNCDLFFINNACCAGGAIFSPICSLTGNRGNIVFYNNRCFKNVETASSEASDGGAIKVTTRLDVTGNRGRIFFSDNITKNYGGAIYAPVVTLVDNGPTYFINNIANNKGGAIYIDGTSNSKISADRHAIIFNENIVTNVTNANGTSTSANPPRRNAITVASSSGEILLGAGSSQNLIFYDPIEVSNAGVSVSFNKEADQTGSVVFSGATVNSADFHQRNLQTKTPAPLTLSNGFLCIEDHAQLTVNRFTQTGGVVSLGNGAVLSCYKNGTGDSASNASITLKHIGLNLSSILKSGAEIPLLWVEPTNNSNNYTADTAATFSLSDVKLSLIDDYGNSPYESTDLTHALSSQPMLSISEASDNQLQSENIDFSGLNVPHYGWQGLWTWGWAKTQDPEPASSATITDPQKANRFHRTLLLTWLPAGYVPSPKHRSPLIANTLWGNMLLATESLKNSAELTPSGHPFWGITGGGLGMMVYQDPRENHPGFHMRSSGYSAGMIAGQTHTFSLKFSQTYTKLNERYAKNNVSSKNYSCQGEMLFSLQEGFLLTKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATHRPQAWTVELAYQPVLYRQEPGIATQLLASKGIWFGSGSPSSRHAMSYKISQQTQPLSWLTLHFQYHGFYSSSTFCNYLNGEIALRF

SEQ ID NO: 16627 - protein, 964 aa, Chlamydia trachomatis
MKKAFFFFLIGNSLSGLAREVPSRIFLMPNSVPDPTKESLSNKISLTGDTHNLTNCYLDNLRYILAILQRTPNEGAAVTITDYLSFFDTQKEGIYFAKNLTPESGGAIGYASPNSPTVEIRDTIGPVIFENNTCCRPFTWRNPLTAVNKIREGGAIHAQNLYINHNHDVVGFMKNFSYVQGGAISTANTFVVSENQSCFLFMDNICIQTNTAGKGGAIYAGTSNSFESNNCDLFFINNACCAGGAIFSPICSLTGNRGNIVFYNNRCFKNVETASSEASDGGAIKVTTRLDVTGNRGRIFFSDNITKNYGGAIYAPVVTLVDNGPTYFINNIANNEGGAIYIDGTSNSKISADRHAIIFNENIVTNVTNANGTSTSANPPRRNAITVASSSGEILLGAGSSQNLIFYDPIEVNAGVSVFFNKEADQTGSVVFSGATVNSADFHQRNLQTKTPAPLTLSNGFLCIEDHAQLTVNRFTQTGGVVSLGNGAVLSCYKNGTGDSASNASITLKHIGLNLSSILKSGAEIPLLWVEPTNNSNNYTADTAATFSLSDVKLSLIDDYGNSPYESTDLTHALSSQPMLSISEASDNQLRSDDMDFSGLNVPHYGWQGLWTWGWAKTQDPEPANSSAITDPQKANRFHRTLLLTWLPAGYVPSPKHRSPLIANTLWGNMLLATESLKNSAELTPSDHPFWGITGGGLGMMVYQDPRENHPGFHMRSSGYSAGMIAGQTHTFSLKFSQTYTKLNERYAKNNVSSKNYSCQGEMLFSLQEGFLLAKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATQRPQAWTVELAYQPVLYRQELGIATQLLASKGIWFGSGSPSSRHAMSYKISQQTQPLSWLTLHFQYHGFYSSSTFCNYLNGEIALRF

SEQ ID NO: 16628 - protein, 1033 aa, Chlamydia trachomatis
MIKRTSLSFVCLSFFYLSTISNSQANETDTLQFRRFTFSDRDIEFVLDPFSLITAQNITLSNITSWGEGACTISGNTQTQIFSNSINTTSAAGGAFDMVTTSFTASDNANLLFCNNYCTHNKGGGAIRSGGAIRFLNNQDVLFYNNTSAGAKYVGIGDPYEKNRGGALYATTITLTGNRTLTFINNMSGDCGGAISADTQISITDTVKGILFENNHTLNHIPDTQAENMARGGAICSRRDLCSISNNSGPIVFNYNQGGKGGAISATRCVIDNNKERIIFSNNSSLGWRQSSPASNGGAIQTTQGFTLRNNKGSIYFDNNTATHAGGAIDCGYIDIRDNGPVYFLNNSAAWGAAFNLSKQRSATNYIHTGTGDIVFNNNVVFTLNGNLLGIRKLFHINNNEITPYTLSLGAKKDTRIYFYDLFQWERVKENTSNNPPSPTSRNTITVNPETEFSGAVVFSYNQMSSDIRTLMGKEHNYIKEAPTTLKFGTLAIEDDAELEIFNIPFTQNPTSLLALGSGATLTVGKHGKLNITNLGVILPIILKEGKSPPCIRVNPQDMTQNTGTGQTPSSTSSISTPMIIFNGRLSIVDENYDSVYDSMDLSRGKAEHLILSIETTNDGQLDSNWQSSLNTSLLSPPHYGYQGLWTPNWITTTYTITLNNNSSAPTSANSIAEQKKTSETFTPNNTTTASIHSIQASSGSSRAAPNTTEVSVTRHTLTVNWAPVGYIVDPIRRGDLIANSLVHSGRNMTMGLRSLLPDNSWFALQGAATTLFTKQQKRLSYHGYSSASKGYTVSSQASGAHGHKFLLSFSQSSDKMKEKETNNRISSRYYLSALCFEHPMFDRIALIGAAACNYGTHNMRSFYGTKKSSKGKFHSTTLGASLRCELRDSMPLRSIMLTPFAQALFSRTEPASIRESGDLARLFTLEQAHTAVVSPIGIKGAYSSDTWPTLSWEMELAYQPTLYWKRPLLNTLLIQNNGSWVTTNTPLAKHSFYGRGSHSLKFSHLKLFANYQAEVATSTVSHYINAGGALVF

SEQ ID NO: 16629 - protein, 1034 aa, Chlamydia trachomatis
MIKRTSLSFVCLSFFYLSTISNSQANETDTLQFRRFTFSDRDIEFVLDPFSLITAQNITLSNITSWGEGACTISGNTQTQIFSNSINTTSAAGGAFDMVTTSFTASDNANLLFYNNYCTHNKGGGAIRSGGPIRFLNNQDVLFYNNTSAGAKYVGTGDHDEKNRGGALYATTITLTGNRTLTFINNMSGDCGGAISADTQISITDTVKGILFENNHTLNHIPDTQAENMARGGAICSRRDLCSISNNSGPIVFNYNQGGKGGAISATRCVIDNNKERIIFSNNSSLGSRQSSPKSNGGAIQTTQGFTLRNNKGPIYFDNNTATHAGGAIDCGYIDIRDNGPVYFLNNSAAWGAALNLSKSSATANYIHTGTGDIIFNNNVTFTFDANLLGVRKLLHINNNIVTPYTLSLGAKKDTRIYFYDLFQWERVKENGNNNPPSPNSRNTITINPEKEFSGAVVFSYNQMSSDVRTLIGKERNYIKEAPTTLKFGTLAIEDGAELEIWNIPFTQESTSLLALGSDATLTVGKNGKLTITNLGVILPAILKENYIPPCIRVNPQDMTQNTNANQPPPSTKDVSIQMIFFDGDLALVDENYESVYDSMDLSRGKAEQPILSIETTNDGQLGSNWQTSLNTSLLSPPHYGYQGLWTPTWLTTTYTVTLSNNSSNPTSATSIAEQKKTSETFTPSNTTTASIPNIKASAGSGSGSASNSGEVTITKHTLVVNWAPVGYIVDPIRRGDLIANSLVHSGRNMTMSLRSLLPDNSWFALQGAATTLFTKQQKRLSYHGYSSASKGYTVSSQASGAHGHKFLLSFSQSSDKMKEKETNNRISSRYYLSALCFEHPMFDRIALIGAAACNYGTHKMRSFYGTKKSSKGKFHSTTLGASLRCELRDSMPLRSIMLTPFAQALFSRTEPASIRESGDLARLFTLEQAHTAVVSPIGIKGTYSSDTWPTLSWEMELAYQPTLYWKRPLLNTLLIQNNGSWVTTNTPLAKHSFYGRGSHSLKFSHLKLFANYQAEVATSTVSHYINAGGALVF

SEQ ID NO: 16630 - protein, 1034 aa, Chlamydia trachomatis
MIKRTSLSFVCLSFFYLSTISNSQANETDTLQFRRFTFSDRDIEFVLDPFSLITAQNITLSNITSWGEGACTISGNTQTQIFSNSINTTSAAGGAFDMVTTSFTASDNANLLFYNNYCTHNKGGGAIRSGGPIRFLNNQDVLFYNNTSAGAKYVGTGDHDEKNRGGALYATTITLTGNRTLTFINNMSGDCGGAISADTQISITDTVKGILFENNHTLNHIPDTQAENMARGGAICSRRDLCSISNNSGPIVFNYNQGGKGGAISATRCVIDNNKERIIFSNNSSLGSRQSSPKSNGGAIQTTQGFTLRNNKGSIYFDNNTATHAGGAIDCGYIDIRDNGPVYFLNNSAAWGAALNLSKSSATANYIHTGTGDIIFNNNVIFTFDANLLGVRKLFHINNNIVTPYTLSLGAKKDTRIYFYDLFQWERVKENGNNNPPSPNSRNTITINPEKEFSGAVVFSYNQMSSDVRTLMGKEHNYIKEAPTTLKFGTLAIEDGAELEIWNIPFTQESTSLLALGSDATLTVGKNGKLTITNLGVILPAILKENYIPPCIRVNPQDMTQNTNANQPPPSTKDVSIQMIFFDGDLALVDENYESVYDSMDLSRGKAEQPILSIETTNDGQLGSNWQTSLNTSLLSPPHYGYQGLWTPTWLTTTYTVTLSNNSSNPTSATSIAEQKKTSETFTPSNTTTASIPNIKASAGSGSGSASNSGEVTITKHTLVVNWAPVGYIVDPIRRGDLIANSLVHSGRNMTMSLRSLLPDNSWFALQGAATTLFTKQQKRLSYHGYSSASKGYTVSSQASGAHGHKFLLSFSQSSDKMKEKETNNRISSRYYLSALCFEHPMFDRIALIGAAACNYGTHKMRSFYGTKKSSKGKFHSTTLGASLRCELRDSMPLRSIMLTPFAQALFSRTEPASIRESGDLARLFTLEQAHTAVVSPIGIKGTYSSDTWPTLSWEMELAYQPTLYWKRPLLNTLLIQNNGSWVTTNTPLAKHSFYGRGSHSLKFSHLKLFANYQAEVATSTVSHYINAGGALVF

SEQ ID NO: 16631 - protein, 1034 aa, Chlamydia trachomatis
MIKRTSLSFVCLSFFYLSTISNSQANETDTLQFRRFTFSDRDIEFVLDPFSLITAQNITLSNITSWGEGACTISGNTQTQIFSNSINTTSAAGGAFDMVTTSFTASDNANLLFYNNYCTHNKGGGAIRSGGPIRFLNNQDVLFYNNTSAGAKYVGTGDHDEKNRGGALYATTITLTGNRTLTFINNMSGDCGGAISADTQISITDTVKGILFENNHTLNHIPDTQAENMARGGAICSRRDLCSISNNSGPIVFNYNQGGKGGAISATRCVIDNNKERIIFSNNSSLGSRQSSPKSNGGAIQTTQGFTLRNNKGSIYFDNNTATHAGGAIDCGYIDIRDNGPVYFLNNSAAWGAALNLSKSSATANYIHTGTGDIIFNNNVIFTFDANLLGVRKLFHINNNIVTPYTLSLGAKKDTRIYFYDLFQWERVKENGNNNPPSPNSRNTITINPEKEFSGAVVFSYNQMSSDVRTLMGKERNYIKEAPTTLKFGTLAIEDGAELEIWNIPFTQESTSLLALGSDATLTVGKNGKLTITNLGVILPAILKENYIPPCIRVNPQDMTQNTNANQPPPSTKDVSIQMIFFDGDLALVDENYESVYDSMDLSRGKAEQPILSIETTNDGQLGSNWQTSLNTSLLSPPHYGYQGLWTPTWLTTTYTVTLSNNSSNPTSATSIAEQKKTSETFTPSNTTTASIPNIKASAGSGSGSASNSGEVTITKHTLVVNWAPVGYIVDPIRRGDLIANSLVHSGRNMTMSLRSLLPDNSWFALQGAATTLFTKQQKRLSYHGYSSASKGYTVSSQASGAHGHKFLLSFSQSSDKMKEKETNNRISSRYYLSALCFEHPMFDRIALIGAAACNYGTHKMRSFYGTKKSSKGKFHSTTLGASLRCELRDSMPLRSIMLTPFAQALFSRTEPASIRESGDLARLFTLEQAHTAVVSPIGIKGTYSSDTWPTLSWEMELAYQPTLYWKRPLLNTLLIQNNGSWVTTNTPLAKHSFYGRGSHSLKFSHLKLFANYQAEVATSTVSHYINAGGALVF

SEQ ID NO: 16632 - protein, 1034 aa, Chlamydia trachomatis
MIKRTSLSFVCLSFFYLSTISNSQANETDTLQFRRFTFSDRDIEFVLDPFSLITAQNITLSNITSWGEGACTISGNTQTQIFSNSINTTSAAGGAFDMVTTSFTASDNANLLFYNNYCTHNKGGGAIRSGGPIRFLNNQDVLFYNNTSAGAKYVGTGDHDEKNRGGALYATTITLTGNRTLTFINNMSGDCGGAISADTQISITDTVKGILFENNHTLNHIPDTQAENMARGGAICSRRDLCSISNNSGPIVFNYNQGGKGGAISATRCVIDNNKERIIFSNNSSLGSRQSSPKSNGGAIQTTQGFTLRNNKGSIYFDNNTATHAGGAIDCGYIDIRDNGPVYFLNNSAAWGAALNLSKSSATANYIHTGTGDIIFNNNVTFTFDANLLGVRKLFHINNNIVTPYTLSLGAKKDTRIYFYDLFQWERVKENGNNNPPSPNSRNTITINPEKEFSGAVVFSYNQMSSDVRTLIGKERNYIKEAPTTLKFGTLAIEDGAELEIWNIPFTQESTSLLALGSDATLTVGKNGKLTITNLGVILPAILKENYIPPCIRVNPQDMTQNTNANQPPPSTKDVSIQMIFFDGDLALVDENYESVYDSMDLSRGKAEQPILSIETTNDGQLGSNWQTSLNTSLLSPPHYGYQGLWTPTWLTTTYTVTLSNNSSNPTSATSIAEQKKTSETFTPSNTTTASIPNIKASAGSGSGSASNSGEVTITKHTLVVNWAPVGYIVDPIRRGDLIANSLVHSGRNMTMSLRSLLPDNSWFALQGAATTLFTKQQKRLSYHGYSSASKGYTVSSQASGAHGHKFLLSFSQSSDKMKEKETNNRISSRYYLSALCFEHPMFDRIALIGAAACNYGTHKMRSFYGTKKSSKGKFHSTTLGASLRCELRDSMPLRSIMLTPFAQALFSRTEPASIRESGDLARLFTLEQAHTAVVSPIGIKGTYSSDTWPTLSWEMELAYQPTLYWKRPLLNTLLIQNNGSWVTTNTPLAKHSFYGRGSHSLKFSHLKLFANYQAEVATSTVSHYINAGGALVF

SEQ ID NO: 16633 - protein, 1752 aa, Chlamydia trachomatis
MKWLSATAVFAAVLPSVSGFCFPEPKELNFSRVGTSSSTTFTETVGEAGAEYIVSSNASFTKFTNIPTTNTTTPTNSNSSSSNRETASVSKDSDSTTTTPDPKGGGAFYNAHSGVLSFMTRSGTEGSLTLSEIKMTGEGGAIFSQGELLFTDLTGLTIQNNLSQLSGGAIFGGSTISLSGITKATFSSNSAEVPAPVKKPTKPEAQTAGETSGSSSSSGNDSVSSSSSSKAEPAAANLQSHFICATATPAAQTDTETSTPSHKPGSGGAIYAKGDLTIADSQKVLFSINKATKDGGAIFAEKDVSFENITSLKVQTNGAEEKGGAIYAKGDLSIQSSKQSLFNSNYSKQGGGALYVEGNINFQDLEEIRIKYNKAGTFKTKKITLPSKAQASAGNADAWASSSPQSSSGATTVSDSGDSSSGSNSDTSKTVPVTAKGGGLYTDKNLSITNITGIIEIANNKATDVGGGAYVKGTLTCKNSHRLQFLKNSSDKQGGGIYGEDNITLSNLTGKTLFQENTAKKEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAYTCPDSFPTADTAEQPAAASAATSTPESDPVASTALSTPSSSTVSSLTLLAASSQASPATSNEKTQDPNADTDLLIDYVVDTTISKNTAKKGGGIYAKKAKMSRIDQLNISENSATEIGGGICCKESLKLDALVSLSVTGNLVGKEGGGLHAKTVNISNLKSGFSFSNNKANSSSTGVPTTASAPAAAAASLQAAAAVAPSSSATPTYSGVVGGAIYGEQVTFSQCSGTCQFSGNQAIDNNPSQSSLNVQGGAIYAKTSLSIGSSDAGTSYIFSGNSVSTGKSQTTGQIAGGAIYSPTVTLNCPATFSNNTASMATPKTSSQDRSSGNSIKDTIGGAIAGTAITLSGVSRFSGNTADLGAAIGTLANTNTPSATSGSQNSITEKITLENSSFIFERNQANKRGAIYSPNVSIKGNNITFNQNTSTHDGSAIYFTKDAKIESLGSVLFTGNNVTATQASSATSGQNTNTANYGAAIFGDPGTTQSPQTDAILTLLASSGNITFSNNSLQNDQGDTPASKFCSIAGYVKLSLQAAKGKTISFFDCVHTSTKKTGSTQNVYETLDINKKENSKPYTGTIVFSSELHENKSYIPQNAILHNGTLVLKEKTELHVVSFEQKEGSKLIMEPGAVLSNQNIANGALAINGLTIDLSSMGTPQAGEIFSPPELRVVATTSSASGGSGVSRSIPTNPKTISAAAPSGSAATTPTMSENKVFLTGDLTLIDPNGNFYQNPMLGSDLDVPLIKLPTNTSDVQVYDLTLSGDLFPQKGYMGTWTLNSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKMVGKTKAIKKMHNYFHKGSEYSYQASVYGGKFLYFLLNKQHGWALPFLIQGVVSYGHIKHDTTILYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 16634 - protein, 1749 aa, Chlamydia trachomatis
MKWLSATAVFAAVLPSVSGFCFPEPKELNFSRVGTSSSTTFTETVGEAGAEYIVSSNASFTKFTNIPTTNTTTPTNSNSSSSNRETASVSKDSDSTTTTPDPKGGGAFYNAHSGVLSFMTRSGTEGSLTLSEIKMTGEGGAIFSQGELLFTDLTGLTIQNNLSQLSGGAIFGGSTISLSGITKATFSSNSAEVPAPVKKPTKPEAQTAGETSGSSSSSGNDSVSSSSSSKAEPAAANLQSHFICATATPAAQTDTETSTPSHKPGSGGAIYAKGDLTIADSQKVLFSINKATKDGGAIFAEKDVSFENITSLKVQTNGAEEKGGAIYAKGDLSIQSSKQSLFNSNYSKQGGGALYVEGNINFQDLEEIRIKYNKAGTFKTKKITLPSKAQASAGNADAWASSSPQSSSGATTVSDSGDSSSGSNSDTSKTVPVTAKGGGLYTDKNLSITNITGIIEIANNKATDVGGGAYVKGTLTCENSHRLQFLKNSSDKQGGGIYGEDNITLSNLTGKTLFQENTAKKEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAYTCPDSFPTADTAEQPAAASAATSTPESDPVASTALSTPSSSTVSSLTLLAASSQASPATSNEKTQDPNADTDLLIDYVVDTTISKNTAKKGGGIYAKKAKMSRIDQLNISENSATEIGGGICCKKSLKLDALVSLSVTENLVGKEGGGLHAKTVNISNLKSGFSFSNNKANSSSTGVATTASAPAAAAASLQAAAAAAPSSSATPTYSGVVGGAIYGEQVTFSQCSGTCQFSGNQAIDNNPSQSSLNVQGGAIYAKTSLSIRSSDAGTSYIFSGNSVSTGKSQTTGQIAGGAIYSPTVTLNCPATFSNNTASMATPKTSSSSGNSIKDTIGGAIAGTAITLSGVSRFSGNTADLGAAIGTLANANTPRATSGSQNSITEKITLKNSSFIFERNQANKRGAIYSPSVSIKGNNITFNQNTSTHDGSAIYFTKDAKIESLGSVLFTGNKVTATQASSATSGQNTNTANYGAAIFGDPGTTQSPQTDAILTLLASSGNITFSNNSLQNNQGGTPASKFCSIAGYVKLSLQATKGKTISFFDCVHTSTKKTGSTQNVYETLDINKKENSKPYTGTIVFSSELHENKSYIPQNAILHNGTLVLKEKTELHVVSFEQKEGSKLIMEPGAVLSNQNIANGALAINGLTIDLSSMGTPQAGEIFSPPELRIVATTSSASGRSGVSRSIPTNPKGISAAAPSGSAATTPTMSENKVFLTGDLTLIDPNGNFYQNPMLGSDLDVPLIKLPTNTSDVQVYDLTLSGDLFPQKGYMGTWTLNSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKMVGKTKAIKKMHNYFHKGSEYSYQASVYGGKFLYFLLNKQHGWALPFLIQGVVSYGHIKHDTTILYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 16635 - protein, 1751 aa, Chlamydia trachomatis
MKWLSATAVFAAVLPSVSGFCFPEPKELNFSRVGTSSSTTFTETVGEAGAEYIVSGNTSFTKFTNIPTTDTTTPTNSNSSSSNGETASVSEDSDSTTTTPDPKGGGAFYNAHSGVLSFMTRSGTEGSLTLSEIKMTGEGGAIFSQGELLFTDLTGLTIQNNLSQLSGGAIFGGSTISLSGITKATFSSNSAEVPAPVKKPTEPKAQTASETSGSSSSSGNDSVSSPSSSRAEPAAANLQSHFICATATPAAQTDTETSTPSHKPGSGGAIYAKGDLTIADSQEVLFSINKATKDGGAIFAEKDVSFENITSLKVQTNGAEEKGGAIYAKGDLSIQSSKQSLFNSNYSKQGGGALYVEGDINFQDLEEIRIKYNKAGTFETKKITLPKAQASAGNADAWASSSPQSGSGATTVSNSGDSSSGSDSDTSETVPATAKGGGLYTDKNLSITNITGIIEIANNKATDVGGGAYVKGTLTCENSHRLQFLKNSSDKQGGGIYGEDNITLSNLTGKTLFQENTAKEEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAHTCPDSFPTADTAEQPAAASAATSTPKSAPVVSTALSTPSSSTVSSLTLLAASSQASPATSNKETQDPNADTDLLIDYVVDTTISKNTAKKGGGIYAKKAKMSRIDQLNISENSATEIGGGICCKESLELDTLVSLSVTENLVGKEGGGLHAKTVNISNLKSGFSFSNNKANSSSTGVATTASAPAAAAASLQAAAAAAPSSPATPTYSGVVGGAIYGEKVTFSQCSGTCQFSGNQAIDNNPSQSSLNVQGGAIYAKTSLSIGSSDAGTSYIFSGNSVSTGKSQTTGQIAGGAIYSPTVTLNCPATFSNNTASMATPKTSSEDGSSGNSIKDTIGGAIAGTAITLSGVSRFSGNTADLGAAIGTLANANTPSTTSGSQNSITEKITLENGSFIFERNQANKRGAIYSPSVSIKGNNITFNQNTSTHDGSAIYFTKDATIESLGSVLFTGNNVTATQASSATSGQNTNTANYGAAIFGDPGTTQSSQTDAILTLLASSGNITFSNNSLQNNQGDTPASKFCSIAGYVKLSLQAAKGKTISFFDCVHISTKKTGSTQKVYETLDINKEEKSNPYTGTIVFSSELHENKSYIPQNAILHNGTLVLKEKTELHVVSFEQKEGSKLIMEPGAVLSNQNIANGALAINGLTIDLSSMGTPQAGEIFSPPELRIVATTSSASGGSGVSSSIPTNPKRISAAAPSGSAATTPTMSENKVFLTGDLTLIDPNRNFYQNPILGSDLDVPLIKLPTDTSDVQVYDLTLSGDLFPQKGYMGTWTLDSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKMVGKTKAIKKMHNYFHKGSEYSYQASVYGGKFLYFLLNKQHGWALPFLIQGVVSYGHIKHDTTTLYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 16636 - protein, 1749 aa, Chlamydia trachomatis
MKWLSATAVFAAVLPSVSGFCFPEPKELNFSRVGTSSSTTFTETVGEAGAEYIVSSNASFTKFTNIPTTNTTTPTNSNSSSSNRETASVSKDSDSTTTTPDPKGGGAFYNAHSGVLSFMTRSGTEGSLTLSEIKMTGEGGAIFSQGELLFTDLTGLTIQNNLSQLSGGAIFGGSTISLSGITKATFSSNSAEVPAPVKKPTKPEAQTAGETSGSSSSSGNDSASSSSSSKAEPAAANLQSHFICATATPAAQTDTETSTPSHKPGSGGAIYAKGDLTIADSQKVLFSINKATKDGGAIFAEKDVSFENITSLKVQTNGAEEKGGAIYAKGDLSIQSSKQSLFNSNYSKQGGGALYVEGNINFQDLEEIRIKYNKAGTFKTKKITLPSKAQASAGNADAWASSSPQSSSGATTVSDSGDSSSGSNSDTSKTVPVTAKGGGLYTDKNLSITNITGIIEIANNKATDVGGGAYVKGTLTCKNSHRLQFLKNSSDKQGGGIYGEDNITLSNLTGKTLFQENTAKKEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAYTCPDSFPTADTAEQPAAASAATSTPESDPVASTALSTPSSSTVSSLTLLAASSQASPATSNEKTQDPNADTDLLIDYVVDTTISKNTAKKGGGIYAKKAKMSRIDQLNISENSATEIGGGICCKKSLKLDALVSLSVTENLVGKEGGGLHAKTVNISNLKSGFSFSNNKANSSSTGVATTASAPAAAAASLQAAAAAAPSSPATPTYSGVVGGAIYGEQVTFSQCSGTCQFSGNQAIDNNPSQSSLNVQGGAIYAKTSLSIRSSDAGTSYIFSGNSVSTGKSQTTGQIAGGAIYSPTVTLNCPATFSNNTASMATPKTSSSSGNSIKDTIGGAIAGTAITLSGVSRFSGNTADLGAAIGTLANANTPRATSGSQNSITEKITLKNSSFIFERNQANKRGAIYSPSVSIKGNNITFNQNTSTHDGSAIYFTKDAKIESLGSVLFTGNKVTATQASSATSGQNTNTANYGAAIFGDPGTTQSPQTDAILTLLASSGNITFSNNSLQNNQGGTPASKFCSIAGYVKLSLQATKGKTISFFDCVHTSTKKTGSTQNVYETLDINKKENSKPYTGTIVFSSELHENKSYIPQNAILHNGTLVLKEKTELHVVSFEQKEGSKLIMEPGAVLSNQNIANGALAINGLTIDLSSMGTPQAGEIFSPPELRIVATTSSASGRSGVSRSIPTNPKGISAAAPSGSAATTPTMSENKVFLTGDLTLIDPNGNFYQNPMLGSDLDVPLIKLPTNTSDVQVYDLTLSGDLFPQKGYMGTWTLNSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKMVGKTKAIKKMHNYFHKGSEYSYQASVYGGKFLYFLLNKQHGWALPFLIQGVVSYGHIKHDTTILYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 16637 - protein, 1751 aa, Chlamydia trachomatis
MKWLSATAVFAAVLPSVSGFCFPEPKELNFSRVGTSSSTTFTETVGEAGAEYIVSGNASFTKFTNIPTTDTTTPTNSNSSSSNGETASVSEDSDSTTTTPDPKGGGAFYNAHSGVLSFMTRSGTEGSLTLSEIKMTGEGGAIFSQGELLFTDLTGLTIQNNLSQLSGGAIFGGSTISLSGITKATFSSNSAEVPAPVKKPTEPKAQTASETSGSSSSSGNDSVSSPSSSRAEPAAANLQSHFICATATPAAQTDTETSTPSHKPGSGGAIYAKGDLTIADSQEVLFSINKATKDGGAIFAEKDVSFENITSLKVQTNGAEEKGGAIYAKGDLSIQSSKQSLFNSNYSKQGGGALYVEGDINFQDLEEIRIKYNKAGTFETKKITLPKAQASAGNADAWASSSPQSGSGATTVSNSGDSSSGSDSDTSETVPATAKGGGLYTDKNLSITNITGIIEIANNKATDVGGGAYVKGTLTCENSHRLQFLKNSSDKQGGGIYGEDNITLSNLTGKTLFQENTAKEEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAHTCPDSFPTADTAEQPAAASAATSTPKSAPVVSTALSTPSSSTVSSLTLLAASSQASPATSNKETQDPNADTDLLIDYVVDTTISKNTAKKGGGIYAKKAKMSRIDQLNISENSATEIGGGICCKESLELDTLVSLSVTENLVGKEGGGLHAKTVNISNLKSGFSFSNNKANSSSTGVATTASAPAAAAASLQAAAAAAPSSPATPTYSGVVGGAIYGEKVTFSQCSGTCQFSGNQAIDNNPSQSSLNVQGGAIYAKTSLSIGSSDAGTSYIFSGNSVSTGKSQTTGQIAGGAIYSPTVTLNCPATFSNNTASMATPKTSSEDGSSGNSIKDTIGGAIAGTAITLSGVSRFSGNTADLGAAIGTLANANTPSATSGSQNSITEKITLENGSFIFERNQANKRGAIYSPSVSIKGNNITFNQNTSTHDGSAIYFTKDATIESLGSVLFTGNNVTATQASSATSGQNTNTANYGAAIFGDPGTTQSSQTDAILTLLASSGNITFSNNSLQNNQGDTPASKFCSIAGYVKLSLQAAKGKTISFFDCVHTSTKKTGSTQKVYETLDINKEEKSNPYTGTIVFSSELHENKSYIPQNAILHNGTLVLKEKTELHVVSFEQKEGSKLIMEPGAVLSNQNIANGALAINGLTIDLSSMGTPQAGEIFSPPELRIVATTSSASGGSGVSSSIPTNPKRISAAAPSGSAATTPTMSENKVFLTGDLTLIDPNGNFYQNPMLGSDLDVPLIKLPTNTSDVQVYDLTLSGDLFPQKGYMGTWTLDSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKMVGKTKAIKKMHNYFHKGSEYSYQASVYGGKFLYFLLNKQHGWALPFLIQGVVSYGHIKHDTTTLYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEASQVICGVPTRTSARAEYSTQLYLGPFWTLYGNYTIDVGMYTLSQMTSCGARMIF

SEQ ID NO: 16638 - protein, 1751 aa, Chlamydia trachomatis
MKWLSATAVFAAVLPSVSGFCFPEPKELNFSRVGTSSSTTFTETVGEAGAEYIVSGNASFTKFTNIPTTDTTTPTNSNSSSSNGETASVSEDSDSTTTTPDPKGGGAFYNAHSGVLSFMTRSGTEGSLTLSEIKMTGEGGAIFSQGELLFTDLTGLTIQNNLSQLSGGAIFGGSTISLSGITKATFSSNSAEVPAPVKKPTEPKAQTASETSGSSSSSGNDSVSSPSSSRAEPAAANLQSHFICATATPAAQTDTETSTPSHKPGSGGAIYAKGDLTIADSQEVLFSINKATKDGGAIFAEKDVSFENITSLKVQTNGAEEKGGAIYAKGDLSIQSSKQSLFNSNYSKQGGGALYVEGDINFQDLEEIRIKYNKAGTFETKKITLPKAQASAGNADAWASSSPQSGSGATTVSNSGDSSSGSDSDTSETVPATAKGGGLYTDKNLSITNITGIIEIANNKATDVGGGAYVKGTLTCENSHRLQFLKNSSDKQGGGIYGEDNITLSNLTGKTLFQENTAKEEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAHTCPDSFPTADTAEQPAAASAATSTPKSAPVVSTALSTPSSSTVSSLTLLAASSQASPATSNKETQDPNADTDLLIDYVVDTTISKNTAKKGGGIYAKKAKMSRIDQLNISENSATEIGGGICCKESLELDTLVSLSVTENLVGKEGGGLHAKTVNISNLKSGFSFSNNKANSSSTGVATTASAPAAAAASLQAAAAAAPSSPATPTYSGVVGGAIYGEKVTFSQCSGTCQFSGNQAIDNNPSQSSLNVQGGAIYAKTSLSIGSSDAGTSYIFSGNSVSTGKSQTTGQIAGGAIYSPTVTLNCPATFSNNTASMATPKTSSKDGSSGNSIKDTIGGAIAGTAITLSGVSRFSGNTADLGAAIGTLANANTPSTTSGSQNSITEKITLENGSFIFERNQANKRGAIYSPSVSIKGNNITFNQNTSTHDGSAIYFTKDATIESLGSVLFTGNNVTATQASSATSGQNTNTANYGAAIFGDPGTTQSSQTDAILTLLASSGNITFSNNSLQNNQGDTPASKFCSIAGYVKLSLQAAKGKTISFFDCVHTSTKKTGSTQKVYETLDINKEEKSNPYTGTIVFSSELHENKSYIPQNAILHNGTLVLKEKTELHVVSFEQKEGSKLIMEPGAVLSNQNIANGALAINGLTIDLSSMGTPQAGEIFSPPELRIVATTSSASGGSGVSSSIPTNPKRISAAAPSGSAATTPTMSENKVFLTGDLTLIDPNRNFYQNPILGSDLDVPLIKLPTDTSDVQVYDLTLSGDLFPQKGYMGTWTLDSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKMVGKTKAIKKMHNYFHKGSEYSYQASVYGGKFLYFLLNKQHGWALPFLIQGVVSYGHIKHDTTTLYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 16639 - protein, 1752 aa, Chlamydia trachomatis
MKWLSATAVFAAVLPSVSGFCFPEPKELNFSRVGTSSSTTFTETVGEAGAEYIVSGNASFTKFTNIPTTDTTTPTNSNSSSSNGETASVSEDSDSTTTTPDPKGGGAFYNAHSGVLSFMTRSGTEGSLTLSEIKMTGEGGAIFSQGELLFTDLTGLTIQNNLSQLSGGAIFGGSTISLSGITKATFSSNSAEVPAPVKKPTEPKAQTASETSGSSSSSGNDSVSSPSSSRAEPAAANLQSHFICATATPAAQTDTETSTPSHKPGSGGAIYAKGDLTIADSQEVLFSINKATKDGGAIFAEKDVSFENITSLKVQTNGAEEKGGAIYAKGDLSIQSSKQSLFNSNYSKQGGGALYVEGDINFQDLEEIRIKYNKAGTFETKKITLPSLKAQASAGNADAWASSSPQSGSGATTVSDSGDSSSGSDSDTSETVPVTAKGGGLYTDKNLSITNITGIIEIANNKATDVGGGAYVKGTLTCENSHRLQFLKNSSDKQGGGIYGEDNITLSNLTGKTLFQENTAKEEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAHTCPDSFPTADTAEQPAAASAATSTPKSAPVSTALSTPSSSTVSSLTLLAASSQASPATSNKETQDPNADTDLLIDYVVDTTISKNTAKKGGGIYAKKAKMSRIDQLNISENSATEIGGGICCKESLELDALVSLSVTENLVGKEGGGLHAKTVNISNLKSGFSFSNNKANSSSTGVATTASAPAAAAASLQAAAAAAPSSPATPTYSGVVGGAIYGEKVTFSQCSGTCQFSGNQAIDNNPSQSSLNVQGGAIYAKTSLSIGSSDAGTSYIFSGNSVSTGKSQTTGQIAGGAIYSPTVTLNCPATFSNNTASIATPKTSSEDGSSGNSIKDTIGGAIAGTAITLSGVSRFSGNTADLGAAIGTLANANTPSATSGSQNSITEKITLENGSFIFERNQANKRGAIYSPSVSIKGNNITFNQNTSTHDGSAIYFTKDATIESLGSVLFTGNNVTATQASSATSGQNTNTANYGAAIFGDPGTTQSSQTDAILTLLASSGNITFSNNSLQNNQGDTPASKFCSIAGYVKLSLQAAKGKTISFFDCVHTSTKKTGSTQNVYETLDINKEENSNPYTGTIVFSSELHENKSYIPQNAILHNGTLVLKEKTELHVVSFEQKEGSKLIMEPGAVLSNQNIANGALAINGLTIDLSSMGTPQAGEIFSPPELRIVATTSSASGGSGVSSSIPTNPKRISAAVPSGSAATTPTMSENKVFLTGDLTLIDPNGNFYQNPMLGSDLDVPLIKLPTNTSDVQVYDLTLSGDLFPQKGYMGTWTLDSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKIVGKTKAIKKMHNYFHKGSEYSYQASVYGGKFLYFLLNKQHGWALPFLIQGVVSYGHIKHDTTTLYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 16640 - protein, 1751 aa, Chlamydia trachomatis
MKWLSATAVFAAVLPSVSGFCFPEPKELNFSRVGTSSSTTFTETVGEAGAEYIVSGNASFTKFTNIPTTDTTTPTNSNSSSSNGETASVSEDSDSTTTTPDPKGGGAFYNAHSGVLSFMTRSGTEGSLTLSEIKMTGEGGAIFSQGELLFTDLTGLTIQNNLSQLSGGAIFGGSTISLSGITKATFSSNSAEVPAPVKKPTEPKAQTASETSGSSSSSGNDSVSSPSSSRAEPAAANLQSHFICATATPAAQTDTETSTPSHKPGSGGAIYAKGDLTIADSQEVLFSINKATKDGGAIFAEKAVSFENITSLKVQTNGAEEKGGAIYAKGDLSIQSSKQSLFNSNYSKQGGGALYVEGDINFQDLEEIRIKYNKAGTFETKKITLPKAQASAGNADAWASSSPQSGSGATTVSNSGDSSSGSDSDTSETVPATAKGGGLYTDKNLSITNITGIIEIANNKATDVGGGAYVKGTLTCENSHRLQFLKNSSDKQGGGIYGEDNITLSNLTGKTLFQENTAKEEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAHTCPDSFPTADTAEQPAAASAATSTPKSAPVVSTALSTPSSSTVSSLTLLAASSQASPATSNKETQDPNADTDLLIDYVVDTTISKNTAKKGGGIYAKKAKMSRIDQLNISENSATEIGGGICCKESLELDTLVSLSVTENLVGKEGGGLHAKTVNISNLKSGFSFSNNKANSSSTGVATTASAPAAAAASLQAAAAAAPSSPATPTYSGVVGGAIYGEKVTFSQCSGTCQFSGNQAIDNNPSQSSLNVQGGAIYAKTSLSIGSSDAGTSYIFSGNSVSTGKSQTTGQIAGGAIYSPTVTLNCPATFSNNTASMATPKTSSEDGSSGNSIKDTIGGAIAGTAITLSGVSRFSGNTADLGAAIGTLANANTPSATSGSQNSITEKITLENGSFIFERNQANKRGAIYSPSVSIKGNNITFNQNTSTHDGSAIYFTKDATIESLGSVLFTGNNVTATQASSATSRQNTNTANYGAAIFGDPGTTQSSQTDAILTLLASSGNITFSNNSLQNNQGDTPASKFCSIAGYVKLSLQAAKGKTISFFDCVHTSTKKTGSTQKVYETLDINKEEKSNPYTGTIVFSSELHENKSYIPQNAILHNGTLVLKEKTELHVVSFEQKEGSKLIMEPGAVLSNQNIANGALAINGLTIDLSSMGTPQAGEIFSPPELRIVATTSSASGGSGVSSSIPTNPKRISAAAPSGSAATTPTMSENKVFLTGDLTLIDPNGNFYQNPMLGSDLDVPLIKLPTNTSDVQVYDLTLSGDLFPQKGYMGTWTLDSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKMVGKTKAIKKMHNYFHKGSEYSYQASVYGGKFLYFLLNKQHGWALPFLIQGVVSYGHIKHDTTTLYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 16641 - protein, 1752 aa, Chlamydia trachomatis
MKWLSATAVFAAVLPSVSGFCFPEPKELNFSRVETSSSTTFTETIGEAGAEYIVSGNASFTKFTNIPTTDTTTPTNSNSSSSSGETASVSEDSDSTTTTPDPKGGGAFYNAHSGVLSFMTRSGTEGSLTLSEIKMTGEGGAIFSQGELLFTDLTSLTIQNNLSQLSGGAIFGGSTISLSGITKATFSCNSAEVPAPVKKPTEPKAQTASETSGSSSSSGNDSVSSPSSSRAEPAAANLQSHFICATATPAAQTDTETSTPSHKPGSGGAIYAKGDLTIADSQEVLFSINKATKDGGAIFAEKDVSFENITSLKVQTNGAEEKGGAIYAKGDLSIQSSKQSLFNSNYSKQGGGALYVEGGINFQDLEEIRIKYNKAGTFETKKITLPSLKAQASAGNADAWASSSPQSGSGATTVSDSGDSSSGSDSDTSETVPVTAKGGGLYTDKNLSITNITGIIEIANNKATDVGGGAYVKGTLTCENSHRLQFLKNSSDKQGGGIYGEDNITLSNLTGKTLFQENTAKEEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAHTCPDSFPTADTAEQPAAASAATSTPKSAPVSTALSTPSSSTVSSLTLLAASSQASPATSNKETQDPNADTDLLIDYVVDTTISKNTAKKGGGIYAKKAKMSRIDQLNISENSATEIGGGICCKESLELDALVSLSVTENLVGKEGGGLHAKTVNISNLKSGFSFSNNKANSSSTGVATTASAPAAAAASLQAAAAAAPSSPATPTYSGVVGGAIYGEKVTFSQCSGTCQFSGNQAIDNNPSQSSLNVQGGAIYAKTSLSIGSSDAGTSYIFSGNSVSTGKSQTTGQIAGGAIYSPTVTLNCPATFSNNTASIATPKTSSEDGSSGNSIKDTIGGAIAGTAITLSGVSRFSGNTADLGAAIGTLANANTPSATSGSQNSITEKITLENGSFIFERNQANKRGAIYSPSVSIKGNNITFNQNTSTHDGSAIYFTKDATIESLGSVLFTGNNVTATQASSATSGQNTNTANYGAAIFGDPGTTQSSQTDAILTLLASSGNITFSNNSLQNNQGDTPASKFCSIAGYVKLSLQAAKGKTISFFDCVHTSTKKTGSTQNVYETLDINKEENSNPYTGTIVFSSELHENKSYIPQNAILHNGTLVLKEKTELHVVSFEQKEGSKLIMEPGAVLSNQNIANGALAINGLTIDLSSMGTPQAGEIFSPPELRIVATTSSASGGSGVSSSIPTNPKRISAAVPSGSAATTPTMSENKVFLTGDLTLIDPNGNFYQNPMLGSDLDVPLIKLPTNTSDVQVYDLTLSGDLFPQKGYMGTWTLDSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKIVGKTKAIKKMHNYFHKGSEYSYQASVYGGKFLYFLLNKQHGWALPFLIQGVVSYGHIKHDTTTLYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 16642 - protein, 1751 aa, Chlamydia trachomatis
MKWLSATAVFAAVLPSVSGFCFPEPKELNFSRVGTSSSTTFTETVGEAGAEYIVSGNASFTKFTNIPTTDTTTPTNSNSSSSNGETASVSEDSDSTTTTPDPKGGGAFYNAHSGVLSFMTRSGTEGSLTLSEIKITGEGGAIFSQGELLFTDLTGLTIQNNLSQLSGGAIFGESTISLSGITKATFSSNSAEVPAPVKKPTEPKAQTASETSGSSSSSGNDSVSSPSSSRAEPAAANLQSHFICATATPAAQTDTETSTPSHKPGSGGAIYAKGDLTIADSQEVLFSINKATKDGGAIFAEKDVSFENITSLKVQTNGAEEKGGAIYAKGDLSIQSSKQSLFNSNYSKQGGGALYVEGDINFQDLEEIRIKYNKAGTFETKKITLPKAQASAGNADAWASSSPQSGSGATTVSNSGDSSSGSDSDTSETVPATAKGGGLYTDKNLSITNITGIIEIANNKATDVGGGAYVKGTLTCENSHRLQFLKNSSDKQGGGIYGEDNITLSNLTGKTLFQENTAKEEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAHTCPDSFPTADTAEQPAAASAATSTPESAPVVSTALSTPSSSTVSSLTLLAASSQASPATSNKETQDPNADTDLLIDYVVDTTISKNTAKKGGGIYAKKAKMSRIDQLNISENSATEIGGGICCKESLELDALVSLSVTENLVGKEGGGLHAKTVNISNLKSGFSFSNNKANSSSTGVATTASAPAAAAASLQAAAAAVPSSPATPTYSGVVGGAIYGEKVTFSQCSGTCQFSGNQAIDNNPSQSSLNVQGGAIYAKTSLSIGSSDAGTSYIFSGNSVSTGKSQTTGQIAGGAIYSPTVTLNCPATFSNNTASMATPKTSSEDGSSGNSIKDTIGGAIAGTAITLSGVSRFSGNTADLGAAIGTLANANTPSATSGSQNSITEKITLENGSFIFERNQANKRGAIYSPSVSIKGNNITFNQNTSTHDGSAIYFTKDATIESLGSVLFTGNNVTATQASSATSGQNTNTANYGAAIFGDPGTTQSSQTDAILTLLASSGNITFSNNSLQNNQGDTPASKFCSIAGYVKLSLQAAKGKTISFFDCVHTSTKKIGSTQNVYETLDINKEENSNPYTGTIVFSSELHENKSYIPQNAILHNGTLVLKEKTELHVVSFEQKEGSKLIMKPGAVLSNQNIANGALVINGLTIDLSSMGTPQAGEIFSPPELRIVATTSSASGGSGVSSSIPTNPKRISAAAPSGSAATTPTMSENKVFLTGDLTLIDPNGNFYQNPMLGSDLDVPLIKLPTNTSDVQVYDLTLSGDLFPQKGYMGTWTLDSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKMVGKTKAIKKMHNYFHKGSEYSYQASVYGGKFLYFLLNKQHGWALPFLIQGVVSYGHIKHDTTTLYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 16643 - protein, 1795 aa, Chlamydia trachomatis
MKWLSATAVFAAVLPSITVFSEPVSKELNSSYRGSGFSLSDSQSNNFTQTTENYTGTTYIISGNVSFTTFTNIPIPKPMPPLQPSEPESSSGGSDGSDSSASTKQQQATAQISFLQPREKLYLSILQNLSSSSCAHFSRLHQGNIDLSNLTSARPYALSFPIATTTTTADSVTSTPTPKGGGAFYNDQGGPLSFITHAGNPGSISCSLIKMTGKGGAVYSKGPISFDGLENVTFKDNLSQEAGGALFTDSTLTIQHILNSIEFTNNAARVPVPLIPIQPATPDGTSPSSLRSISPGYIAQTNKADAGSQTPTLPTYTTETAGNGGAIFAQGAIVISTYKDMTFRKNSAEFPHIIDTIKEQIETTKKAKAAATPAAPKVSSILASSSAPAAAPDVKDTTIKGCGGAIFGLDTITIHDGSEDTLFILNTATGSGGAIYGNKAISIDKVANLKFQSNSADAQGGAIYAKENLTISDSSTLTQFNGNNGKTGGGGIYCLGDITLTNLSQAYFGANRAGNYDITLTIPSKEKAVVASAATGAASSQSAAQQSAPADTPPLGKGGGLYVEKNLSVSKITSILEFLNNQATDHGGGAYVKGTLTCENSHRIQFTTNTSKKSGGGLYCESDVTFSNLTGKTLFKGNVAEENGGGLCLAAEKSLNLSNLESFCLINNTSSKSGGGAHIPKELTFTVPNPDSSSTTTTGPVFGSAVITGNTATEHGGGVYTKKASFTNLELIDIDQNQAKNGAGLCTQEIPANGAVGSAGQANPDDLDFKVDFIVTTNVTKNAASENGGGVYGKKGKISRLDHLNISGNSAGKFGGGLYFTEELTLDGVEVSNISGNTAKEAGGAIYAKKLTCTNLPEEFTVSNNKAETTSAVKTESGNNTTVPTDIIGGAIYAEELILKELVGDCTFSGNQAIDKNATLSTNNSPTDPNVQGGAIYAKTSFKLQNSKGKLTFSENSATTKRCATTGQVAGGAIYAPAVTIENCSQSIYFVNNSALCTPSESSGSALQITPKGTFGGAIAGTTSVTFTGNQALFFQGNSAENGSAIGCKNSTNGSDGKVEFTDSSYCYFEENIAKNRGTIYAATLSIPKGYMNFSNNSSANDGSAIYFTKQADITASASVSFLNNKVTLAQTPATNTQGSNQTASVKNLGAAIYGEPASGSDDAVLNLTALSGNITFKNNQCLPTAQQDATSFCSIAGKVKLTLNAAENQSINFYDAVNITTSKTSGYNTLDINKAPSSSPGTPSSYTGTILFSGELHEHKSFIPQKAVLHSGTLVLGKNAELNVISFDQKAGSSLVMGPGSILSTRKPTGGSGGTTGGIAINNLTIDFSEVLAQDGNAASPPALKLGVEPTRVAGPKGQKGEKKALVQANKAQPDVNQEKIYLTGILTLIDPSGVFYQNPDLGQDRQIELLKLPDSSKVEISDLTLAGDTKPKKGYIGTWTLDTTNTNGKLQANWKFEEYRRWVYIPRDNYFYVNSILGSQNSLIAVKQGIVNNMLNNARFDDAAYNNLWLCGIGSFLQKDEGEEARSFSYHSRGYSLAIDAKPRPEFILGASFSQVFGHAKSEKTAGQYKHKGSDHSFQGTLYAGRSFYLPHRQTKAPRPILFQGLVTYGYMKHDTTTYYPTIQERNLGNWEDLGWLFDIRIVLDLKEPSHNSTTRFSFYSEAEYTGVRQKQFTEVDYDPRTFNSFAYRNLATPLGFVFEGALLHHDILMYNKLSVAYVPVIYRNHPECTYRINSTGQTGEVSSVIPARNTGRMECSSQIYLGPYWTLYGTYTVDAGMSSLTQIANCGARMIF

SEQ ID NO: 16644 - protein, 1751 aa, Chlamydia trachomatis
MKWLSATAVFAAVLPSVSGFCFPEPKELNFSRVGTSSSTTFTETVGEAGAEYIVSGNASFTKFTNIPTTDTTTPTNSNSSSSNGETASVSEDSDSTTTTPDPKGGGAFYNAHSGVLSFMTRSGTEGSLTLSEIKMTGEGGAIFSQGELLFTDLTGLTIQNNLSQLSGGAIFGGSTISLSGITKATFSSNSAEVPAPVKKPTEPKAQTASETSGSSSSSGNDSVSSPSSSRAEPAAANLQSHFICATATPAAQTDTETSTPSHKPGSGGAIYAKGDLTIADSQEVLFSINKATKDGGAIFAEKDVSFENITSLKVQTNGAEEKGGAIYAKGDLSIQSSKQSLFNSNYSKQGGGALYVEGDINFQDLEEIRIKYNKAGTFETKKITLPKAQASAGNADAWASSSPQSGSGATTVSNSGDSSSGSDSDTSETVPATAKGGGLYTDKNLSITNITGIIEIANNKATDVGGGAYVKGTLTCENSHRLQFLKNSSDKQGGGIYGEDNITLSNLTGKTLFQENTAKEEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAHTCPDSFPTADTAEQPAAASAATSTPKSAPVVSTALSTPSSSTVSSLTLLAASSQASPATSNKETQDPNADTDLLIDYVVDTTISKNTAKKGGGIYAKKAKMSRIDQLNISENSATEIGGGICCKESLELDTLVSLSVTENLVGKEGGGLHAKTVNISNLKSGFSFSNNKANSSSTGVATTASAPAAAAASLQAAAAAAPTSPATPTYSGVVGGAIYGEKVTFSQCSGTCQFSGNQAIDNNPSQSSLNVQGGAIYAKTSLSIGSSDAGTSYIFSGNSVSTGKSQTTGQIAGGAIYSPTVTLNCPATFSNNTASMATPKTSSEDGSSGNSIKDTIGGAIAGTAITLSGVSRFSGNTADLGAAIGTLANANTPSATSGSQNSITEKITLENGSFIFERNQANKRGAIYSPSVSIKGNNITFNQNTSTHDGSAIYFTKDATIESLGSVLFTGNNVTATQASSATSGQNTNTANYGAAIFGDPGTTQSSQTDAILTLLASSGNITFSNNSLQNNQGDTPASKFCSIAGYVKLSLQAAKGKTISFFDCVHTSTKKTGSTQKVYETLDINKEEKSNPYTGTIVFSSELHENKSYIPQNAILHNGTLVLKEKTELHVVSFEQKEGSKLIMEPGAVLSNQNIANGALAINGLTIDLSSMGTPQAGEIFSPPELRIVATTSSASGGSGVSSSIPTNPKRISAAAPSGSAATTPTMSENKVFLTGDLTLIDPNRNFYQNPILGSDLDVPLIKLPTDTSDVQVYDLTLSGDLFPQKGYMGTWTLDSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKMVGKTKAIKKMHNYFHKGSEYSYQASVYGGKFLYFLLNKQHGWALPFLIQGVVSYGHIKHDTTTLYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 16645 - protein, 1751 aa, Chlamydia trachomatis
MKWLSATAVFAAVLPSVSGFCFPEPKELNFSRVGTSSSTTFTETVGEAGAEYIVSGNASFTKFTNIPTTDTTTPTNSNSSSSNGETASVSEDSDSTTTTPDPKGGGAFYNAHSGVLSFMTRSGTEGSLTLSEIKMTGEGGAIFSQGELLFTDLTGLTIQNNLSQLSGGAIFGGSTISLSGITKATFSSNSAEVPAPVKKPTEPKAQTASETSGSSSSSGNDSVSSPSSSRAEPAAANLQSHFICATATPAAQTDTETSTPSHKPGSGGAIYAKGDLTIADSQEVLFSINKATKDGGAIFAEKDVSFENITSLKVQTNGAEEKGGAIYAKGDLSIQSSKQSLFNSNYSKQGGGALYVEGDINFQDLEEIRIKYNKAGTFETKKITLPKAQASAGNADAWASSSPQSGSGATTVSNSGDSSSGSDSDTSETVPATAKGGGLYTDKNLSITNITGIIEIANNKATDVGGGAYVKGTLTCENSHRLQFLKNSSDKQGGGIYGEDNITLSNLTGKTLFQENTAKEEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAHTCPDSFPTADTAEQPAAASAATSTPKSAPVVSTALSTPSSSTVSSLTLLAASSQASPATSNKETQDPNADTDLLIDYVVDTTISKNTAKKGGGIYAKKAKMSRIDQLNISENSATEIGGGICCKESLELDTLVSLSVTENLVGKEGGGLHAKTVNISNLKSGFSFSNNKANSSSTGVATTASAPAAAAASLQAAAAAAPSSPATPTYSGVVGGAIYGEKVTFSQCSGTCQFSGNQAIDNNPSQSSLNVQGGAIYAKTSLSIGSSDAGTSYIFSGNSVSTGKSQTTGQIAGGAIYSPTVTLNCPATFSNNTASMATPKTSSEDGSSGNSIKDTIGGAIAGTAITLSGVSRFSGNTADLGAAIGTLANANTPSATSGSQNSITEKITLENGSFIFERNQANKRGAIYSPSVSIKGNNITFNQNTSTHDGSAIYFTKNATIESLGSVLFTGNNVTATQASSATSGQNTNTANYGAAIFGDPGTTQSSQTDAILTLLASSGNITFSNNSLQNNQGDTPASKFCSIAGYVKLSLQAAKGKTISFFDCVHTSTKKTGSTQKVYETLDINKEEKSNPYTGTIVFSSELHENKSYIPQNAILHNGTLVLKEKTELHVVSFEQKEGSKLIMEPGAVLSNQNIANGALAINGLTIDLSSMGTPQAGEIFSPPELRIVATTSSASGGSGVSSSIPTNPKRISAAAPSGSAATTPTMSENKVFLTGDLTLIDPNRNFYQNPILGSDLDVPLIKLPTDTSDVQVYDLTLSGDLFPQKGYMGTWTLDSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKMVGKTKAIKKMHNYFHKGSEYSYQASVYGGKFLYFLLNKQHGWALPFLIQGVVSYGHIKHDTTTLYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 16646 - protein, 1731 aa, Chlamydia trachomatis
MKWLSATAVFAAVLPSVSGFCFPEPKELNFSRVGTSSSTTFTETVGEAGAEYIVSGNASFTKFTNIPTTDTTTPTNSNSSSSNGETASVSEDSDSTTTTPDPKGGGAFYNAHSGVLSFMTRSGTEGSLTLSEIKMTGEGGAIFSQGELLFTDLTGLTIQNNLSQLSGGAIFGGSTISLSGITKATFSSNSAEVPAPVKKPTEPKAQTASETSGSSSSSGNDSVSSPSSSRAEPAAANLQSHFICATATPAAQTDTETSTPSHKPGSGGAIYAKGDLTIADSQEVLFSINKATKDGGAIFAEKDVSFENITSLKVQTNGTEEKGGAIYAKGDLSIQSSKQSLFNSNYSKQGGGALYVEGDINFQDLEEIRIKYNKAGTFETKKITLPKAQASAGNADAWASSSPQSGSGATTVSNSGDSSSGSDSDTSETVPATAKGGGLYTDKNLSITNITGIIEIANNKATDVGGGAYVKGTLTCENSHRLQFLKNSSDKQGGGIYGEDNITLSNLTGKTLFQENTAKEEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAHTCPDSFPTADTAEQPAAASAATSTPKSAPVVSTALSTPSSSTVSSLTLLAASSQASPATSNKETQDPNADTDLLIDYVVDTTISKNTAKKGGGIYAKKAKMSRIDQLNISENSATEIGGGICCKESLELDTLVSLSVTENLVGKEGGGLHAKTVNISNLKSGFSFSNNKANSSSTGVATTASATPTYSGVVGGAIYGEKVTFSQCSGTCQFSGNQAIDNNPSQSSLNVQGGAIYAKTSLSIGSSDAGTSYIFSGNSVSTGKSQTTGQIAGGAIYSPTVTLNCPATFSNNTASMATPKTSSEDGSSGNSIKDTIGGAIAGTAITLSGVSRFSGNTADLGAAIGTLANANTPSATSGSQNSITEKITLENGSFIFERNQANKRGAIYSPSVSIKGNNITFNQNTSTHDGSAIYFTKDATIESLGSVLFTGNNVTATQASSATSGQNTNTANYGAAIFGDPGTTQSSQTDAILTLLASSGNITFSNNSLQNNQGDTPASKFCSIAGYVKLSLQAAKGKTISFFDCVHTSTKKTGSTQKVYETLDINKEEKSNPYTGTIVFSSELHENKSYIPQNAILHNGTLVLKEKTELHVVSFEQKEGSKLIMEPGAVLSNQNIANGALAINGLTIDLSSMGTPQAGEIFSPPELRIVATTSSASGGSGVSSSIPTNPKRISAAAPSGSAATTPTMSENKVFLTGDLTLIDPNRNFYQNPILGSDLDVPLIKLPTDTSDVQVYDLTLSGDLFPQKGYMGTWTLDSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKMVGKTKAIKKMHNYFHKGSEYSYQASVYGGKFLYFLLNKQHGWALPFLIQGVVSYGHIKHDTTTLYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 16647 - protein, 1751 aa, Chlamydia trachomatis
MKWLSATAVFAAVLPSVSGFCFPEPKELNFSRVGTSSSTTFTETVGEAGAEYIVSGNASFTKFTNIPTTDTTTPTNSNSSSSNGETASVSEDSDSTTTTPDPKGGGAFYNAHSGVLSFMTRSGTEGSLTLSEIKMTGEGGAIFSQGELLFTDLTGLTIQNNLSQLSGGAIFGGSTISLSGITKATFSSNSAEVPAPVKKPTEPKAQTASETSGSSSSSGNDSVSSPSSSRAEPAAANLQSHFICATATPAAQTDTETSTPSHKPGSGGAIYAKGDLTIADSQEVLFSINKATKDGGAIFAEKDVSFENITSLKVQTNGAEEKGGAIYAKGDLSIQSSKQSLFNSNYSKQGGGALYVEGDINFQDLEEIRIKYNKAGTFETKKITLPKAQASAGNADAWASSSPQSGSGATTVSNSGDSSSGSDSDTSETVPATAKGGGLYTDKNLSITNITGIIEIANNKATDVGGGAYVKGTLTCENSHRLQFLKNSSDKQGGGIYGEDNITLSNLTGKTLFQENTAKEEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAHTCPDSFPTADTAEQPAAASAATSTPKSAPVVSTALSTPSSSTVSSLTLLAASSQASPATSNKETQDPNADTDLLIDYVVDTTISKNTAKKGGGIYAKKAKMSRIDQLNISENSATEIGGGICCKESLELDTLVSLSVTENLVGKEGGGLHAKTVNISNLKSGFSFSNNKANSSSTGVATTASAPAAAAASLQAAAAAAPSSPATPTYSGVVGGAIYGEKVTFSQCSGTCQFSGNQAIDNNPSQSSLNVQGGAIYAKTSLSIGSSDAGTSYIFSGNSVSTGKSQTTGQIAGGAIYSPTVTLNCPATFSNNTASMATPKTSSEDGSSGNSIKDTIGGAIAGTAITLSGVSRFSGNTADLGAAIGTLANANTPSTTSGSQNSITEKITLENGSFIFERNQANKRGAIYSPSVSIKGNNITFNQNTSTHDGSAIYFTKDATIESLGSVLFTGNNVTATQASSATSGQNTNTANYGAAIFGDPGTTQSSQTDAILTLLASSGNITFSNNSLQNNQGDTPASKFCSIAGYVKLSLQAAKGKTISFFDCVHISTKKTGSTQKVYETLDINKEEKSNPYTGTIVFSSELHENKSYIPQNAILHNGTLVLKEKTELHVVSFEQKEGSKLIMEPGAVLSNQNIANGALAINGLTIDLSSMGTPQAGEIFSPPELRIVATTSSASGGSGVSSSIPTNPKRISAAAPSGSAATTPTMSENKVFLTGDLTLIDPNRNFYQNPILGSDLDVPLIKLPTDTSDVQVYDLTLSGDLFPQKGYMGTWTLDSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKMVGKTKAIKKMHNYFHKGSEYSYQASVYGGKFLYFLLNKQHGWALPFLIQGVVSYGHIKHDTTTLYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 16648 - protein, 975 aa, Chlamydia trachomatis
MNRVIEIHAHYDQRQLSQSPNTNFLVHHPYLTLIPKFLLGALIFYAPYSFAEMELAISGHKQGKDRDTFTMISSCPEGTNYIINRKLILSDFSLLNKVSSGGAFRNLAGKISFLGKNSSASIHFKHININGFGAGVFSESSIEFTDLRKLVAFGSESTGGIFTAKEDISFKNNHHIAFRNNITKGNGGVIQLQGDMKGSVSFVDQRGAIIFTNNQAVTSSSMKHSGRGGAISGDFAGSRILFLNNQQITFEGNSAVHGGAIYNKNGLVEFLGNAGPLAFKENTTIANGGAIYTSNFKANQQTSPILFSQNHANKKGGAIYAQYVNLEQNQDTIRFEKNTAKEGGGAITSSQCSITAHNTITFSDNAAGDLGGGAILLEGKKPSLTLIAHSGNIAFSGNTMLHITKKASLDRHNSILIKEAPYKIQLAANKNHSIHFFDPVMALSASSSPIQINAPEYETPFFSPKGMIVFSGANLLDDAREDVANRTSIFNQPVHLYNGTLSIENGAHLIVQSFKQTGGRISLSPGSSLALYTMNSFFHGNISSKEPLEINGLSFGVDISPSNLQAEIRAGNAPLRLSGSPSIHDPEGLFYENRDTAASPYQMEILLTSDKTVDISKFTTDSLVTNKQSGFQGAWHFSWQPNTINNTKQKILRASWLPTGEYVLESNRVGRAVPNSLWSTFLLLQTASHNLSDHLCNNRSLIPTSYFGVLIGGTGAEMSTHSSEEESFISRLGATGTSIIRLTPSLTLSGGGSHMFGDSFVADLPEHITSEGIVQNVGLTHVWGPLTVNSTLCAALDHNAMVRICSKKDHTYGKWDTFGMRGTLGASYTFLEYDQTMRVFSFANIEATNILQRAFTETGYNPRSFSKTKLLNIAIPIGIGYEFCLGNSSFALLGKGSIGYSRDIKRENPSTLAHLAMNDFAWTTNGCSVPTSAHTLANQLILRYKACSLYITAYTINREGKNLSNSLSCGGYVGF

SEQ ID NO: 16649 - protein, 975 aa, Chlamydia trachomatis
MNRVIEIHAHYDQRQLSQSPNTNFLVHHPYLTLIPKFLLGALIVYAPYSFAEMELAISGHKQGKDRDTFTMISSCPEGTNYIINRKLILSDFSLLNKVSSGGAFRNLAGKISFLGKNSSASIHFKHININGFGAGVFSESSIEFTDLRKLVAFGSESTGGIFTAKEDISFKNNHHIAFRNNITKGNGGVIQLQGDMKGSVSFVDQRGAIIFTNNQAVTSSSMKHSGRGGAISGDFAGSRILFLNNQQITFEGNSAVHGGAIYNKNGLVEFLGNAGPLAFKENTTIANGGAIYTSNFKANQQTSPILFSQNHANKKGGAIYAQYVNLEQNQDTIRFEKNTAKEGGGAITSSQCSITAHNTIIFSDNAAGDLGGGAILLEGKKPSLTLIAHSGNIAFSGNTMLHITKKASLDRHNSILIKEAPYKIQLAANKNHSIHFFDPVMALSASSSPIQINAPEYETPFFSPKGMIVFSGANLLDDAREDVANRTSIFNQPVHLYNGTLSIENGAHLIVQSFKQTGGRISLSPGSSLALYTMNSFFHGNISSKEPLEINGLSFGVDISPSNLQAEIRAGNAPLRLSGSPSIHDPEGLFYENRDTAASPYQMEILLTSDKIVDISKFTTDSLVTNKQSGFQGAWHFSWQPNTINNTKQKILRASWLPTGEYVLESNRVGRAVPNSLWSTFLLLQTASHNLGDHLCNNRSLIPTSYFGVLIGGTGAEMSTHSSEEESFISRLGATGTSIIRLTPSLTLSGGGSHMFGDSFVADLPEHITSEGIVQNVGLTHVWGPLTVNSTLCAALDHNAMVRICSKKDHTYGKWDTFGMRGTLGASYTFLEYDQTMRVFSFANIEATNILQRAFTETGYNPRSFSKTKLLNIAIPIGIGYEFCLGNSSFALLGKGSIGYSRDIKRENPSTLAHLAMNDFAWTTNGCSVPTSAHTLANQLILRYKACSLYITAYTINREGKNLSNSLSCGGYVGF

SEQ ID NO: 16650 - protein, 910 aa, Chlamydia trachomatis
MNRVHRLQTTSNEKVRIMQKKSLNRHKLFIALSAVSVSLSAAAQAQTETASGSQTIIDAPVLEEMLVTGRQVSGAQSIIDQRLEEAFSADILGGEQIARAGDSNIAIALTRVPGVTLVDGQYVYVRSLGERYSSVQLNGAAVPSPELTRNVLPLDLLPSSIVKTLKVQKAYSPDLPAHFGGGNVDIRTTSIPEDFVFELSLGTGSNSESSGDGLGYASNKRNGLPHDIDQALDLYQGKINVNGIIDIIDTDGGSPTPEQLTEARTINRNLMLSLDRDIEIEKKSNDLDLSGNLTLGNSWALTDDLSIGALLNLSRDESVRNKNQHRKAIGDPEQIYSFIERTIDETRELAGLNAGINYQDMHQIAVNAYNIRIEEDEAQIDTGHDASNRAQDGSQTVDYSTRYEERELEVYQVLGDHKFDQLSGGLFGDLKVDWFYSDATATTNIPGKTSVKGNNRIDTTTGELISTRLLATSAMASVAFLNLEDQVESYGVNAALPLLFENAEITLSGGYSYNDKARQYYGYTANINAIGVSGNVLAGTPGTVLTDATLSNLANPFELTMGGGLGTESYLAAQMIDAAYGMFDAKWDDTWRLTAGARYEDYRQAVLPIDLLDYSGEYLGKLIEDLQNDGQRFAIRDDGWKPSVALTYMNQGFMGAEDFQIRASYAKTLVRPDLRELSEVFYIDPELGIQVQGNPNLQSSELDHYDLRTEWVYDSGDNFTFSLFYKDVANPIEQSRVPGSDDSIVLTFYNAISGKIYGAEFEGLKTLGAGFFITGNITLTDSEIVSPADGGFTNISRKMTGQSDYVINAQLGYDSDNGMHSASLVYNVFGERIYYAARLNGHDDAFEQPFNSLDLIYSFFPTEQLTAKIKLGNLLNEKRTFEQVNSNGQSVTILEQEVGTSYSLDVKYRF

SEQ ID NO: 16651 - protein, 975 aa, Chlamydia trachomatis
MNRVIEIHAHYDQRQLSQSPNTNFLVHHPYLTLIPKFLLGALIVYAPYSFAEMELAISGHKQGKDRDTFTMISSCPEGTNYIINRKLILSDFSLLNKVSSGGAFRNLAGKISFLGKNSSASIHFKHININGFGAGVFSESSIEFTDLRKLVAFGSESTGGIFTAKEDISFKNNHHIAFRNNITKGNGGVIQLQGDMKGSVSFVDQRGAIIFTNNQAVTSSSMKHSGRGGAISGDFAGSRILFLNNQQITFEGNSAVHGGAIYNKNGLVEFLGNAGPLAFKENTTIANGGAIYTSNFKANQQTSPILFSQNHANKKGGAIYAQYVNLEQNQDTIRFEKNTAKEGGGAITSSQCSITAHNTITFSDNAAGDLGGGAILLEGKKPSLTLIAHSGNIAFSGNTMLHITKKASLDRHNSILIKEAPYKIQLAANKNHSIHFFDPVMALSASSSPIQINAPEYETPFFSPKGMIVFSGANLLDDAREDVANRTSIFNQPVHLYNGTLSIENGAHLIVQSFKQTGGRISLSPGSSLALYTMNSFFHGNISSKEPLEINGLSFGVDISPSNLQAEIRAGNAPLRLSGSPSIHDPEGLFYENRDTAASPYQMEILLTSDKTVDISKFTTDSLVTNKQSGFQGAWHFSWQPNTINNTKQKILRASWLPTGEYVLESNRVGRAVPNSLWSTFLLLQTASHNLGDHLCNNRSLIPTSYFGVLIGGTGAEMSTHSSEEESFISRLGATGTSIIRLTPSLTLSGGGSHMFGDSFVADLPEHITSEGIVQNVGLTHVWGPLTVNSTLCAALDHNAMVRICSKKDHTYGKWDTFGMRGTLGASYTFLEYDQTMRVFSFANIEATNILQRAFTETGYNPRSFSKTKLLNIAIPIGIGYEFCLGNSSFALLGKGSIGYSRDIKRENPSTLAHLAMNDFAWTTNGCSVPTSAHTLANQLILRYKACSLYITAYTINREGKNLSNSLSCGGYVGF

SEQ ID NO: 16652 - protein, 975 aa, Chlamydia trachomatis
MNRVIEIHAHYDQRQLSQSPNTNFLVHHPYLTLIPKFLLGALIVYAPYSFAEMELAISGHKQGKDRDTFTMISSCPEGTNYIINRKLILSDFSLLNKVSSGGAFRNLAGKISFLGKNSSASIHFKHININGFGAGVFSESSIEFTDLRKLVAFGSESTGGIFTAKEDISFKNNHHIAFRNNITKGNGGVIQLQGDMKGSVSFVDQRGAIIFTNNQAVTSSSMKHSGRGGAISGDFAGSRILFLNNQQITFEGNSAVHGGAIYNKNGLVEFLGNAGPLAFKENTTIANGGAIYTSNFKANQQTSPILFSQNHANKKGGAIYAQYVNLEQNQDTIRFEKNTAKEGGGAITSSQCSITAHNTIIFSDNAAGDLGGGAILLEGKKPSLTLIAHSGNIAFSGNTMLHITKKASLDRHNSILIKEAPYKIQLAANKNHSIHFFDPVMALSASSSPIQINAPEYETPFFSPKGMIVFSGANLLDDAREDVANRTSIFNQPVHLYNGTLSIENGAHLIVQSFKQTGGRISLSPGSSLALYTMNSFFHGNISSKEPLEINGLSFGVDISPSNLQAEIRAGNAPLRLSGSPSIHDPEGLFYENRDTAASPYQMEILLTSDKTVDISKFTTDSLVTNKQSGFQGAWHFSWQPNTINNTKQKILRASWLPTGEYVLESNRVGRAVPNSLWSTFLLLQTASHNLSDHLCNNRSLIPTSYFGVLIGGTGAEMSTHSSEEESFISRLGATGTSIIRLTPSLTLSGGGSHMFGDSFVADLPEHITSEGIVQNVGLTHVWGPLTVNSTLCAALDHNAMVRICSKKDHTYGKWDTFGMRGTLGASYTFLEYDQTMRVFSFANIEATNILQRAFTETGYNPRSFSKTKLLNIAIPIGIGYEFCLGNSSFALLGKGSIGYSRDIKRENPSTLAHLAMNDFAWTTNGCSVPTSAHTLANQLILRYKACSLYITAYTINREGKNLSNSLSCGGYVGF

SEQ ID NO: 16653 - protein, 975 aa, Chlamydia trachomatis
MNRVIEIHAHYDQRQLSQSPNTNFLVHHPYLTLIPKFLLGALIVYAPYSFAEMELAISGHKQGKDRDTFTMISSCPEGTNYIINRKLILSDFSLLNKVSSGGAFRNLAGKISFLGKNSSASIHFKHININGFGAGVFSESSIEFTDLRKLVAFGSESTGGIFTAKEDISFKNNHHIAFRNNITKGNGGVIQLQGDMKGSVSFVDQRGAIIFTNNQAVTSSSMKHSGRGGAISGDFAGSRILFLNNQQITFEGNSAVHGGAIYNKNGLVEFLGNAGPLAFKENTTIANGGAIYTSNFKANQQTSPILFSQNHANKKGGASYAQYVNLEQNQDTIRFEKNTAKEGGGAITSSQCSITAHNTIIFSDNAAGDLGGGAILLEGKKPSLTLIAHSGNIAFSGNTMLHITKKASLDRHNSILIKEAPYKIQLAANKNHSIHFFDPVMALSASSSPIQINAPEYETPFFSPKGMIVFSGANLLDDAREDVANRTSIFNQPVHLYNGTLSIENGAHLIVQSFKQTGGRISLSPGSSLALYTMNSFFHGNISSKEPLEINGLSFGVDISPSNLQAEICAGNAPLRLSGSPSIHDPEGLFYENRDTAASPYQMEILLTSDKTVDISKFTTDSLVTNKQSGFQGAWHFSWQPNTINNTKQKILRASWLPTGEYVLESNRVGRAVPNSLWSTFLLLQTASHNLSDHLCNNRSLIPTSYFGVLIGGTGAEMSTHSSEEESFISRLGATGTSIIRLTPSLTLSGGGSHMFGDSFVADLPEHITSEGIVQNVGLTHVWGPLTVNSTLCAALDHNAMVRICSKKDHTYGKWDTFGMRGTLGASYTFLEYDQTMRVFSFANIEATNILQRAFTETGYNPRSFSKTKLLNIAIPIGIGYEFCLGNSSFALLGKGSIGYSRDIKRENPSTLAHLAMNDFAWTTNGCSVPTSAHTLANQLILRYKACSLYITAYTINREGKNLSNSLSCGGYVGF

SEQ ID NO: 16654 - protein, 682 aa, Shigella flexneri
MDIRLNLSPLALAIGGALTVVVGVPNAVAEEQAKVDETLQIIGHQYEGYAEHMPQSGTKTDVEWLDVPQAVSVVTKTEMEDRGAVRLVDALDGVAGVNNTLGEGSRDQFVIRGFDSLNDMYRDGMRDDGTLQSYRSLANIERVEIVKGPAGALYGRGSAGGIINLVTKRANGENFTNINGGVGSNSQFVGQVDSSMAFSDKVNGRINVEHRQADSYVDHVDSNDFFIAPTIRVMPSDGHTIDLDVEYAHQELVPYRGVPSKNGKPVDVSESTFYGGTNDYQESDSIRVGVNYEWLLNSEWAWTNRAAYNHIELEQKGTRQSNDVVTGTEVDQTVNNFGYDPRTTTTLQSELVWETDSNQMMIGADYNQINIALTSALVSDEELPQKDIYDPVTGPTPDPGFKPSRDNTTTTAGVYIQDVYTFGDLSVIGNVRYDSMELEQQKAGSAKEHIDDNKVSYRGGLVYRINNDMSVYASLARSWQLPYAGIYIKPELAEFFHTDLKEVGAKAYLLDNALMLNAAVFQIDQEQPETNTDGDVINKIEARHQGIELEARGQISEQWDISIGYSFLDAEDKETGKKPNDVSDHLFSLWSTYQLDDNWRLGGGVKYVGDRYAGNDEAVALGDYTTVDLMAAYTTGRHKVQANAYNVLNEKYILGTTNGKSGTNQVGYGAPAEFMLSYGYQF

SEQ ID NO: 16655 - protein, 160 aa, Shigella flexneri
MADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 16656 - protein, 83 aa, Erwinia stewartii
PEPKHQSMAQGSRTTLDSRYQQLRQGENPVGSLGMFGGYSGGYQRHDNNEAEGHGNHNTLTVGIDYQLNEQVLLGGLIAGTLR

SEQ ID NO: 16657 - protein, 1038 aa, Anaplasma marginale
GGGNVIHYQFKGAIVNGNNAILNVNTGSLTAYHPTIGTVARINIGANNLFTIDASAGDVTILDGQAIAFGNAGSVLALSNLTGVGVKNVLLAADLAAPGANEGGLIFNGGANGLNIGSNAAGTARKMGDRGGDKFNSLLIKDVVTITDDVNLGGIHNVIVNNNADFTSNTAVNADAIQINDGIYRVDASGGDVIVPAANIEFAHANAQLVLQNSSNADDRTITLIADINPNNDDEGIVTLNSVNAGKKLTIAGGVTLGRVHRLQAIKFQGVGDFGTAGITFNTANIELDTTGATELGATLGNVILINNNVQLTQTGNIGGFLDFNATNGTVTLNNGVNIAGAVQNTGGTNTGTLIALGASNLGSVNGLTMLKVGAGAVSITQGGNTSITEIQGNGTALLTLPANFNLTGSINKTGGQALKLNFTNGGSVSGVVGTAANSVGDITTAGTTNFASSVNAKGAATLGGTTSFADTFTNTGAVTLAKASITNFAKNVTATSFAANNATINFGNSLAFNSNITGSGTTLTLGASQVTYTGTGSFTDTLTLNTTFDGAAKSGGNILIKSCSTLDLSGVSTLALVVTATNFDINNISPDTKYTVISAEAAGGLKPTPAGNVKVTVNNDNRFVNFTFDESTLTLFAKDVSQEVIDNDFKPGGPLANIPNAANIKKSLELMEQAPIGSDARLVFGNWGKLTPIQEADAVTHLMQDVVKPSDTIAAINNQVILSNISSSLINLNARMDVIQPAVVAAGDKDRDAKFGAWISPFVGNATQKMRNNISGYKSDTTGGTIGFDGLVNDDLALGLAYTRTDTDIKLKNNKTGYKNKVESNIYSVYGLYNVPYENLFVEAIASYSDNRIKSKSRRVIATALETVGYQTASGKYKSESYTGQLMAGYTYMMPENINLTPLAGLRYSVIKDKGYKETGTTNQNLTVKGKNYNTFDGLLGAKVSSNINVGEVVLTPELYAMVDYAFKNKVPAIDARLQGMTAPFPTNSFKQSKTSFDVGVGVTAKHKMMEYGINYDTNIGSKYFAQQGSVKVRVNF

SEQ ID NO: 16658 - protein, 1531 aa, Chlamydia trachomatis
MSSEKDIKSTCSKFSLSVVAAILASVSGLASCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACGSFSSAGGASVLGTIDISKNLGAISFSRTLCTTSDLGQMEYQGGGALFGENISLSENAGVLTFKDNIVKTFASNGKILGGGAILATGKVEITNNSEGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGRAEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKIPQCIHVQQGSLELLNGATLCSYGFKQDAGAKLVLAAGAKLKILDSGTPVQQGHAISKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASGDEASAEISNLSVSDLQIHVVTPEIEEDTYGHMGDWSEAKIQDGTLVISWNPTGYRLDPQKAGALVFNALWEEGAVLSALKNARFAHNLTAQRMEFDYSTNVWGFAFGGFRTLSAENLVAIDGYKGAYGGASAGVDIQLMEDFVLGVSGAAFLGKMDSQKFDAEVSRKGVVGSVYTGFLAGSWFFKGQYSLGETQNDMKTRYGVLGESSASWTSRGVLADALVEYRSLVGPVRPTFYALHFNPYVEVSYASMKFPGFTEQGREARSFEDASLTNITIPLGMKFELAFIKGQFSEVNSLGISYAWEAYRKVEGGAVQLLEAGFDWEGAPMDLPRQELRVALENNTEWSSYFSTVLGLTAFCGGFTSTDSKLGYEANTGLRLIF

SEQ ID NO: 16659 - protein, 1530 aa, Chlamydia trachomatis
MSSEKDIKSTCSKFSLSVVAAILASVSGLASCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACESFSSAGGASVLGAIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLASGSKLKILDSGTPVQGHAVSKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIRVVTPEIEEDTYGHMGDWSEAKIQDGTLVINWNPTGYRLDPQKAGALVFNALWEEGAVLSALKNARFAHNLTAQRMEFDYSTNVWGFAFGGFRTLSAENLVAIDGYKGAYGSASAGVDIQLMEDFVLGVSGAAFLGKMDSQKFDAEVSRKGVVGSVYTGFLAGSWFFKGQYSLGETQNDMKTRYGVLGESSASWTSRGVLADALVEYRSLVGPVRPTFYALHFNPYVEVSYASMKFPGFTEQGREARSFEDASLTNITIPLGMKFELAFIKGQFSEVNSLGISYAWEAYRKVEGGAVQLLEAGFDWEGAPMDLPRQELRVALENNTEWSSYFSTVLGLTAFCGGFTSTASKLGYEANAGLRLIF

SEQ ID NO: 16660 - protein, 1531 aa, Chlamydia trachomatis
MSSEKDIKSTCSKFSLSVVAAILASVSGLASCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACGSFSSAGGASVLGTIDISKNLGAISFSRTLCTTSDLGQMEYQGGGALFGENISLSENAGVLTFKDNIVKTFASNGKILGGGAILATGKVEITNNSEGISFTGNARAPQALPTQEEFPLFSKKEGRPLSSGYSGGGAILGREVAIFHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLAAGAKLKILDSGTPVQQGHAISKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASGDEASAEISNLSVSDLQIHVVTPEIEEDTYGHMGDWSEAKIQDGTLVISWNPTGYRLDPQKAGALVFNALWEEGAVLSALKNARFAHNLTAQRMEFDYSTNVWGFAFGGFRTLSAENLVAIDGYKGAYGGASAGVDIQLMEDFVLGVSGAAFLGKMDSQKFDAEVSRKGVVGSVYTGFLAGSWFFKGQYSLGETQNDMKTRYGVLGESSASWTSRGVLADALVEYRSLVGPVRPTFYALHFNPYVEVSYASMKFPGFTEQGREARSFEDASLTNITIPLGMKFELAFIKGQFSEVNSLGISYAWEAYRKVEGGAVQLLEAGFDWEGAPMDLPRQELRVALENNTEWSSYFSTVLGLTAFCGGFTSTDSKLGYEANTGLRLIF

SEQ ID NO: 16661 - protein, 432 aa, Chlamydia trachomatis
MSSDESRPSLRFENFILFPLISAPILHSTKGTQFHIWNTKSQNSAVGTRVADRFARGHRPRHLEQRSGDQMVKHAAATLLGALAVAGAWAQSSVTLYGSLDAGVAYVNNVGGGAKWSMIQGNTQPDRWGLKGVEDLGGGLKAIFQLENGFYTNNGQMAAAGTMWNRQAFVGLNSDRLGALTLGHQTPFNFDWLDPLSSAFLAQSWYAFHPGNLDQLADTSTVPFNNSVKYRSPVFAGFTVGAMLGFGNTTNFSTGRTMSFGVNYANGPFKAAAVYSNEHDQAFPMATVGGIAGPGGTFQGMPVASYVAKKAQNMGAGLSYRFGPLLVHGLYTRVKLQANGHSDTFQSYDAGANYQSSPFNVIAGGAATSTLAGRRWSQFELGDTYSLSKRTQLYVNVLYEHASGNAKAAFFTAGASSTANQVIVLTGIHHSF

SEQ ID NO: 16662 - protein, 1530 aa, Chlamydia trachomatis
MSSEKDIKSTCSKFSLSVVAAILASVSGLASCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACGSFSSAGGASVLGTIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSVEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLKERKSAEVLLINSRENPGYTGSIRFLEAESKVPQCIHVQQGSLELLNGATLCSYGFKQDAGAKLVLAAGSKLKILDSGTPVQGHAISKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASSDEASAEISNLSVSDLQIHVATPEIEEDTYGHMGDWSEAKIQDGTLVINWNPTGYRLDPQKAGALVFNALWEEGAVLSALKNARFAHNLTAQRMEFDYSTNVWGFAFGGFRTLSAENLVAIDGYKGAYGGASAGVDIQLMEDFVLGVSGAAFLGKMDSQKFDAEVSRKGVVGSVYTGFLAGSWFFKGQYSLGETQNDMKTRYGVLGESSASWTSRGVLADALVEYRSLVGPVRPTFYALHFNPYVEVSYASMKFPGFTEQGREARSFEDASLTNITIPLGMKFELAFIKGQFSEVNSLGISYAWEAYRKVEGGAVQLLEAGFDWEGAPMDLPRQELRVALENNTEWSSYFSTVLGLTAFCGGFTSTDSKLGYEANAGLRLIF

SEQ ID NO: 16663 - protein, 1531 aa, Chlamydia trachomatis
MSSEKDIKSTCSKFSLSVVAAILASVSGLASCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNYGITCDKNESASQGGAIFGKNCQISDNEGPVVFRDSTACLGGGAIAAQEIVSIQNNQAGISFEGGKASFGGGIACGSFSSAGGASVLGTIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRFYVEETVEKVEEVEPAPEQKDNNELSFLWSAEQSFITAANQALFASEDGDLSPESSISSEELVKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLAAGAKLKILDSGTPVQQGHAISKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASGDEASAEISNLSVSDLQIHVVTPEIEEDTYGHMGDWSEAKIQDGTLVISWNPTGYRLDPQKAGALVFNALWEEGAVLSALKNARFAHNLTAQRMEFDYSTNVWGFAFGGFRTLSAENLVAIDGYKGAYGSASAGVDIQLMEDFVLGVSGAAFLGKMDSQKFDAEVSRKGVVGSVYTGFLAGSWFFKGQYSLGETQNDMKTRYGVLGESSASWTSRGVLADALVEYRSLVGPVRPTFYALHFNPYVEVSYASMKFPGFTEQGREARSFEDASLTNITIPLGMKFELAFIKGQFSEVNSLGISYAWEAYRKVEGGAVQLLEAGFDWEGAPMDLPRQELRVALENNTEWSSYFSTVLGLTAFCGGFTSTASKLGYEANAGLRLIF

SEQ ID NO: 16664 - protein, 1531 aa, Chlamydia trachomatis
MSSEKDIKSTCSKFSLSVVAAILASVSGLASCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACGSFSSAGGASVLGTIDISKNLGAISFSRTLCTTSDLGQMEYQGGGALFGENISLSENAGVLTFKDNIVKTFASNGKILGGGAILATGKVEITNNSEGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAEQSFITAANQALFASEDGDLSPESSISSEELVKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLAAGAKLKILDSGTPVQQGHAISKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASGDEASAEISNLSVSDLQIHVVTPEIEEDTYGHMGDWSEAKIQDGTLVISWNPTGYRLDPQKAGALVFNALWEEGAVLSALKNARFAHNLTAQRMEFDYSTNVWGFAFGGFRTLSAENLVAIDGYKGAYGGASAGVDIQLMEDFVLGVSGAAFLGKMDSQKFDAEVSRKGVVGSVYTGFLAGSWFFKGQYSLGETQNDMKTRYGVLGESSASWTSRGVLADALVEYRSLVGPVRPTFYALHFNPYVEVSYASMKFPGFTEQGREARSFEDASLTNITIPLGMKFELAFIKGQFSEVNSLGISYAWEAYRKVEGGAVQLLEAGFDWEGAPMDLPRQELRVALENNTEWSSYFSTVLGLTAFCGGFTSTDSKLGYKANTGLRLIF

SEQ ID NO: 16665 - protein, 1531 aa, Chlamydia trachomatis
MSSEKDIKSTCSKFSLSVVAAILASVSGLASCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNYGITCDKNESASQGGAIFGKNCQISDNEGPVVFRDSTACLGGGAIAAQEIVSIQNNQAGISFEGGKASFGGGIACGSFSSAGGASVLGTIDISKNLGAISFSRTLCTTSDLGQMEYQGGGALFGENISLSENAGVLTFKDNIVKTFASNGKILGGGAILATGKVEITNNSGGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLESAEQSFITAANQALFASEDGDLSPESSISSEELVKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLAAGAKLKILDSGTPVQQGHAISKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASGDEASAEISNLSVSDLQIHVVTPEIEEDTYGHMGDWSEAKIQDGTLVISWNPTGYRLDPQKAGALVFNALWEEGAVLSALKNARFAHNLTAQRMEFDYSTNVWGFAFGGFRTLSAENLVAIDGYKGAYGGASAGVDIQLMEDFVLGVSGAAFLGKMDSQKFDAEVSRKGVVGSVYTGFLAGSWFFKGQYSLGETQNDMKTRYGVLGESSASWTSRGVLADALVEYRSLVGPVRPTFYALHFNPYVEVSYASMKFPGFTEQGREARSFEDASLTNITIPLGMKFELAFIKGQFSEVNSLGISYAWEAYRKVEGGAVQLLEAGFDWEGAPMDLPRQELRVALENNTEWSSYFSTVLGLTAFCGGFTSTDSKLGYEANTGLRLIF

SEQ ID NO: 16666 - protein, 1531 aa, Chlamydia trachomatis
MSSEKDIKSTCSKFSLSVVAAILASVSGLASCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACGSFSSAGGASVLGTIDISKNLGAISFSRTLCTTSDLGQMEYQGGGALFGENISLSENAGVLTFKDNIVKTFASNGKILGGGAILATGKVEITNNSEGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSAEQSFITAANQALFASEDGDLSPESSISSEELVKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLAAGAKLKILDSGTPVQQGHAISKPEAEIESSSEPEGAHSLWIAKNAQTTVPVVDIHTISVDLASFSSSQQEGTVEAPQVIVPGGSYVRSGELNLELVNTTGTGYENHALLKNEAKVPLMSFVASGDEASAEISNLSVSDLQIHVVTPEIEEDTYGHMGDWSEAKIQDGTLVISWNPTGYRLDPQKAGALVFNALWEEGAVLSALKNARFAHNLTAQRMEFDYSTNVWGFAFGGFRTLSAENLVAIDGYKGAYGGASAGVDIQLMEDFVLGVSGAAFLGKMDSQKFDAEVSRKGVVGSVYTGFLAGSWFFKGQYSLGETQNDMKTRYGVLGESSASWTSRGVLADALVEYRSLVGPVRPTFYALHFNPYVEVSYASMKFPGFTEQGREARSFEDASLTNITIPLGMKFELAFIKGQFSEVNSLGISYAWEAYRKVEGGAVQLLEAGFDWEGAPMDLPRQELRVALENNTEWSSYFSTVLGLTAFCGGFTSTDSKLGYEANTGLRLIF

SEQ ID NO: 16667 - protein, 422 aa, Pseudomonas putida
MRVMKWSMIALAVSAGTSQLAFASAQDESKGFIEDSQLNVKTRMLYFSRDFRNNAPGSQSRVEETGLGFLGTFESGFTQGAVGFGVDAIGMLGLKLDSGRGRAGTGLFPEGSDGRSQDDYSEGGGAVKMRFSNTVLKYGNQFTALPVFATDDSRLLPEVAEGTLITSDEIEGLTLHAGHFTGMNAQAQTFRDSLHLTEANIVGGTYALTDSLSTSLYYSKVEDYWRKYYGNINWAVPISDKQGLVFDFNIYDTKGDGAELVTAYDGESLDNTAFSLSAAWNIGAHTFTIVHQRVHGDGDYAYGVDGGGTVFLGNSVARSDFNAEDEKSWQARYDLNFAEFGVPGLTFMTRYVRGTDANVAGTTNGKEWERDIDIKYVMQEGPAKDLSFRVRQATYRSSDGVYYGSPSLDELRLIVEYPLSIL

SEQ ID NO: 16668 - protein, 329 aa, Neisseria meningitidis
AYLNGLSGMTPEGAAETLRQVSGENTLNSGYANINQLNLFREGIRNGVKGLAPTDEPRSQMWITALGGISNQGSNDSISGFDSYTGGLAAGYALTMSKALVGVGLAYIDTDVYSRDDLNHTDMRSWVGSLYAALDLDPVRLEADVMYGQGYNESETSFSGLPDAEGDYNSYFWGFGARASYNFLFNEGATRLTPYVGIEYASVTQDAYTESGPLGRHFDVDRLERWTLPVGIELQHDFVIDDEKSISTCIGVGYARDLNDSQAEASVYLGPNSAPLRVHGVEMGKDALRYNAGVSFNVNDTVSIFGQYNGETRSNYTDNSFRLGVEIRF

SEQ ID NO: 16669 - protein, 291 aa, Neisseria meningitidis
SVAAMADVTLYGTIKAGVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQENVNIEKYQIHRLVSGYDNDALYASVAVQQQDAKLVEENYSHNSQTEVAATLAYRFGNVTPRVSYAHGFKGSFDATNYNNDYDQVVVGAEYDFSKRTSALV

SEQ ID NO: 16670 - protein, 376 aa, Neisseria meningitidis
STTTKLSGEVVFWAGDSFGDRSRHNVAGGPFGRASDDPTETYLGYRARLNFDSSFSGRDRLRIRLEAVDIPNLRAFGLNNTLMARTSIDGRSNGFRLDDLNYRFPAFDGKARFWVGANALGIDNILDVLSPLESASTGSISRFGRRNPAVFRGPGGAGAGANFTFGSRSPLKLNLAYLAGNASDATEGNGLFNGSNSAGAQLVYQPNRNLAFAVEYARKYFSTEDVNIAGGTGSWISERPFGNNATTSDNLGLQFNWRVLDKFQLGGWFGATWAHQQRNGSDSATILNWAVTMGFPDAFSEGDLGGIIIGMPPKVTSHDRGALEDRDTSFHIEAFYRYAFNDYISITPGFFVVTNPDHNSRNANIFVGTLRTTFRF

SEQ ID NO: 16671 - protein, 304 aa, Neisseria meningitidis
TVTWKQGSSAQEKTATLTWEQTGYSPNPERQGSLVPNTLWGSFSDIRAIQNLMDISVNGADYHRGFWVSGLGNFLHKSGSDTKRKFRHNSAGYALGVYAQTPSEDVFSAAFCQLFGKDKDYLVSKNSSTVYAGSIYYQHISYWNTWNTLLQNTLGAEAPLVLNAQLAYCHASNNMKTNMTDTYAPPKTTYSEIKGDWGNDCFGVEFGAKAPIETASLLFDMYSPFVKLQLVHAHQDDFKENNSDQGRYFESNNLTNLSMPIGVKLEKFSHKDTASYNLTLAYAPDIVRSNPDCTASLLVSPTSA

SEQ ID NO: 16672 - protein, 184 aa, Wolbachia endosymbiont
EILPLFTEIDGIDYKKGTDIYSPLKASFIAGGGAFGYKMDDIRVDVEGVYLYLNKNDVKDVVFTPADTIANSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEAGVAFNF

SEQ ID NO: 16673 - protein, 183 aa, Wolbachia endosymbiont
EILPLFTKVDGITYKKDNSDYSPLKASFLAGGGAFGYEMDDIRVDVEGVYSYLNKNNVTDAKFTPDTIADSVTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEAGVAFNF

SEQ ID NO: 16674 - protein, 177 aa, Wolbachia endosymbiont
EILPLFTKVDGITYKKDNSDYSPLKASFLAGGGAFGYKMDDIRVDVEGVYSYLNKNNVTDAKFTPDTIADSVTAISGLVNVYYDIAIEDMPITPYVGVGVGAAYISTPLKDAANDQKSKFGFAGQVKAGVSYDVTPEVKLYAGARYFGSYGANFDKSGGEKDKGGHTVLYSTVGAEA

SEQ ID NO: 16675 - protein, 267 aa, Vibrio harveyi
  misc_feature (168)..(168): Xaa can be any naturally occurring amino acid
MRKSLLALSLLAATSAPVMAADYSDGDIHKNDYKWMQFNLMGAFDELPGESSHDYLEMEFGGRSGIFDLYGYVDVFNLASDKGSDKVGDPKIFMKFAPRMSIDGLTGKDLSFGPVQELYVATLFEWDGTDYKTNPFSVNNQKVGIGSDVMVPWFGKVGVNLYGTYPRXPKKIGTVSKSRLTGSKPFYFFENGSFISYQGYIDYQFGMKEKYSSASNGGAMFNGIYWHSDRFAVGYGLKGYKDVYGIKDSDALKSTGFGHYIAVTYKF

SEQ ID NO: 16676 - protein, 266 aa, Vibrio harveyi
MRKSLLALSLLAATSAPVMAADYSDGDIHKNDYKWMQFNLMGAFDELPGESSHDYLEMEFGGRSGIFDLYGYVDVFNLASDKGSDKVGDPKIFMKFAPRMSIDGLTGKDLSFGPVQELYVATLFEWDGTDYKTNKFSVNNQKVGIGSDVMVPWFGKVGVNLYGTYQGNQKDWNGFQISTNWFKPFYFFENGSFISYQGYIDYQFGMKEKYSSASNGGAMFNGIYWHSDRFAVGYGLKGYKDVYGIKDSDALKSTGFGHYIAVTYKF

SEQ ID NO: 16677 - protein, 146 aa, Wolbachia endosymbiont
DGHDVQKAEVAMLWDSGFAWGNPQGWQVDLQWEVNIARWRSSSDNQPNDLWEFGASPVVRIAWWRHTWVPFLELSVGPRLLTSTHTSANHDISTAFQFSEYAGIGLTVGKDRRFAAGYRFQHLSNGGIKDPNPGTTFHVIYLRYRF

SEQ ID NO: 16678 - protein, 147 aa, Wolbachia endosymbiont
VDVYTRLGGFVWRADSHDDSGLNDHDTGVSPLAAVGVEYAITKNWATRLDYQWVNNIGDASTVGGRPDNGLLSVGVSYRFGQETVAPAPVVAAAPAPAPVVQTKRFTLKSDVLFNFNKATLKPEGQRSLDQLYSQLSSLDPKDGPVV

SEQ ID NO: 16679 - protein, 140 aa, Wolbachia endosymbiont
EYGVLNNSKYIPTNGNTVGYTFKGIDGLVLGTNYLLAQDRYKYAATGSFAGEVTPQSISNGVQVGAKYDANNIIIGIAYGRTNYREDIVTAPGDDLAGTKQQVNGALSTLGYRFSDLGLLVSLDSGYAKTKNYKDKHEKR

SEQ ID NO: 16680 - protein, 186 aa, Wolbachia endosymbiont
LYVRLQYNGEILPLFTKVDGIEYKKGSEILTPLKASFIAGGGAFGYKMDDIRVDVEGLYSQLSKNDVTGAAFTPIDTIADSLTAFSGLVNVYYDIAIEDMPITPYIGVGVGAAYISNPSKVDAVKDQRGFGFAYQAKAGVSYDVTPEIKLYAGARYFGSYGANFDKTSTSDAGIKGVLYSTVGCRT

SEQ ID NO: 16681 - protein, 183 aa, Wolbachia endosymbiont
LYVRLQYNGEILPFYTKVDGIKNATGKEKDSPLTRSFVAGGGAFGYKMDDIRVDVEGLYSQLATDAAVVNGSETNVADSLTAFSGLVNVYYDITIEDMPITPYVGVGVGAAYISNPSKADTVKDQKGFGFAYQAKAGVSYEVTPEIKLFAGARYFGSYGASFDKAAKGDTGIKNVVYSTEGKS

SEQ ID NO: 16682 - protein, 712 aa, Vibrio alginolyticus
MSYQNLDGKVRVRAGLSTTYSVLAIAIASATSMSAVAAPAKKEQTTAMETVVVTGSVIGKSEIEDVKEYPGARTVITRDQIEKTAAGSIDNALQRVPGIKVQDESGTGVLPNISVRGLKASRSGHAQFLMDGVPLTLAPYGHTGQSIFPATLSMLDRIDIVRGGAAVQYGPNNVGGVINLVTKPIPHTWQTEISNRLTVFDGGDAPLNDFYLRTGGWLSDTFALQLEGNFLKGESFREHSDTDVKNFQAKAQWLLSDTQEIQAFLQRYDAETQMPGALSPQDYEQDRHQSKRPYDDYEGKSTRWSVKYIHDLPFADSAELEVLTFGHKSERLFKWGFNSAGGHWADPALPATDVRTSPREFTVYGIEPKMAMYFGEGKSVTQNWIVGTRYVNEDIDYKLTQTPIAGGATSVPRDWHLDTDAFAGYVSNEIGLFNDTLKVTPGLRVESVRMTFTDRGKKQTADNTVTEWLPGLTVAYNLTDQWVTYANAQKSLRAPQIAYIRGLGEEGSELAWNYEVGARYTQDATSFNAALYRIDFEDQLQWQSSTQTFDNIGKTLHQGIELSARYVPEALPALSLGASYNYLDATLEEEGENKGNQLPYTSKHQLGWDATYAFYGMDTTLSGFYFSDSYTDNANTSDEDATGATGKVPSYMVWNFNLGTDLYKDDKGKLRMNVAVNNLFDEEYYFRGIDTSPVGRYPAPGRSYTLDLNYQF

SEQ ID NO: 16683 - protein, 978 aa, Vibrio alginolyticus
MNKLLSNTRHTPLAAALAAALTLLAGGAQAQDASAGAGVTELDKVMVKGVRGAQAEAIENKRTAAQIIDSISAEDIGKLPDVTITDSLQRVPGVQIRRSAGEGSQLNIRGMPQVQTTMNGELYLSAGGGDQFGQPNIGRAQPDFVDIPPTLFSGVDVIKSPTAADLDGGISGTVSLKTRRPFDLPEGWTFSGQAEGSYGDRVEELNELYSGLASFRTERWGALLAVSYSDATLENKHPSVYSNGAQKSTEQNVGFDFNGDGRIGSNTDPSNLPRDYFYNWVATELDNRSTDRQRTGVNGSFQFNINDSWTVLADAAYTKLEDQDTSVAAQLHTGWATNQLQPGSVVDSNGVLEYGQFRYNRFQAHSMAGVADSDSLNTNLELRFDDGGPFRASFRWVHGDAQRTYDEARADAVVTRGDQITRAGGVTQWANANGLPTVDASVDFRGTYPAVNLGTDVSNPDNWQLMSTWAQGNKIEATMDAFRADGTFEFDEGVVRGFQFGIRYGEREVKLDTYRYLSPVSTTCADPNRSLYYFKDPLISDTCSGVSEARLLPFNSIPGYWAYFNDFDPLKVTGLGSQGLPAINPQVMKDPVGYLNSLYPGNVAYQQAADSYKVTEKSTAAYFLANLEGGTGSAVPWTANIGARIVQTKLAIDQYLSSGNVFIGNVEWNGVSPAIGTNRLNRQYTDVLPTANLSLDITDAQKLRFAYNKAVARQDLPDLGRGLVSFYAVNGTPPRNPALPPDAVLFLNGRSGNPDLDPYRATNYNASWEWYFSDASLVSVGAFLIDVKSFPTTVTNIEPQPDADGVVRLGGPVESIVNGGGGKIKGFEIGYQQAFDFLPGWLSGFGTNINYTFSDADTDNTDIEGNTLPIGDNSKHQANAVLWYQKDKLQARVAYNWRSKRFSQVNSGAWGDELAIWNDDVGYLDASFSYDVNDHLTLYAQATNLTGESERRYAQWTNHYYDQNIFERRYYAGLRLRF

SEQ ID NO: 16684 - protein, 398 aa, Wolbachia endosymbiont
ADLAQYNGLWALGTNAEQYFHAYHNDRSGLSLTNETLLTQWPVRLNYGLAQQNERLSPEEDGQTRFTKTVTSRHGKRTAQNLFANADIDYSPLRVQLGLNLHNAKSTDYQTKQQLDYKEKLDLLSEFTYALTPSTQLFLKSSRTYRMPSLYETTLSNEVFSYNPYNPIKPEQAWNNEVGVQFMASNSVLQDDRLNLSVSYFRNSIKDFISGGRLAKTPGMSEWQANFTFTNYDKLQLSGWELGAHYQYAWLYTHFAATLYSETKICSVQQAQYAESDTCNSLGFAWGLTPTRIPPKQNLYLNVGTKFFNDTLDSGVKVSYHSGKSNPSDWLAGTAANPILEIPSDYTIDLYSQYELNANTQLFFAINNVTDRYQVRPGSVVSMPDPGRTITLGFEISY

SEQ ID NO: 16685 - protein, 159 aa, Wolbachia endosymbiont
ADSITTAEDKEYGLLSSKKYIPTSGNTIGYTFNGIDGLVLGANYLLAQERDIDSQNYGASPTQAGEVAIGSISNGIQVGAKYDANNIIVGIAYGRTNYKESTNARQTASKKQELNGALASLGYHFSDLGLLVSLDSGYAKTKNYQTKHEKRYFVSPGFQ

SEQ ID NO: 16686 - protein, 108 aa, Wolbachia endosymbiont
  misc_feature (37)..(37): Xaa can be any naturally occurring amino acid
  misc_feature (96)..(96): Xaa can be any naturally occurring amino acid
ANSLTAISGLVNVYYDIAIEDMPITPYMGVGVGAAYXSTPLATAVSIQNGKFAFAGQARAGVSYDITPEIKLYAGARYFGSYGANFDKTNNDGKGXLKVLYSTVGAEA

SEQ ID NO: 16687 - protein, 108 aa, Wolbachia endosymbiont
  misc_feature (16)..(16): Xaa can be any naturally occurring amino acid
  misc_feature (37)..(37): Xaa can be any naturally occurring amino acid
  misc_feature (88)..(88): Xaa can be any naturally occurring amino acid
ANSLTAISGLVNVYYXIAIEDMPITPYMGVGVGAAYXSTPLATAVSIQNGKFAFAGQARAGVSYDITPEIKLYAGARYFGSYGANFDXTNNDGNGELKVLYSTVGAEA

SEQ ID NO: 16688 - protein, 96 aa, Wolbachia endosymbiont
  misc_feature (42)..(42): Xaa can be any naturally occurring amino acid
  misc_feature (90)..(90): Xaa can be any naturally occurring amino acid
  misc_feature (95)..(95): Xaa can be any naturally occurring amino acid
ANSLTAISGLVNVYYDIAIEDMPITPYVGVGVGAAYVSTPLXTAVSIQNGKFAFAGQARAGVSYDVTPEIKLYAGARYFGSYGAHFDSTXTDGNXE

SEQ ID NO: 16689 - protein, 108 aa, Wolbachia endosymbiont
  misc_feature (101)..(101): Xaa can be any naturally occurring amino acid
  misc_feature (107)..(107): Xaa can be any naturally occurring amino acid
ANSLTAISGLVNVYYDIAIEDMPITPYMGVGVGAAYISTPLATAVSIQNGKFAFAGQARAGVSYDITPEIKLYAGARYFGSYGANFDNTNNDGNGELVVLXSTVGAXA

SEQ ID NO: 16690 - protein, 108 aa, Wolbachia endosymbiont
  misc_feature (28)..(28): Xaa can be any naturally occurring amino acid
  misc_feature (37)..(37): Xaa can be any naturally occurring amino acid
  misc_feature (42)..(42): Xaa can be any naturally occurring amino acid
  misc_feature (59)..(59): Xaa can be any naturally occurring amino acid
  misc_feature (66)..(66): Xaa can be any naturally occurring amino acid
  misc_feature (82)..(82): Xaa can be any naturally occurring amino acid
  misc_feature (85)..(85): Xaa can be any naturally occurring amino acid
  misc_feature (90)..(90): Xaa can be any naturally occurring amino acid
  misc_feature (98)..(98): Xaa can be any naturally occurring amino acid
  misc_feature (102)..(103): Xaa can be any naturally occurring amino acid
ANSLTAISGLVNVYYDIAIEDMPITPYXGVGVGAAYXSTPLXTAVSSQNGKFAFAGQAXAGVSYDXTPEIKLYAGARYFGSXGAXFDKTXTDGKGELXVPYXXVGAEA

SEQ ID NO: 16691 - protein, 162 aa, Wolbachia endosymbiont
AMYGTNNHGRVNNMTGYRGINKGATVGFDAKINNNIIGIAYSNVHSVFKFKNSKNNDKELIGSKVISIYGQKELQQNFTLQVLVSASKNFIKDKINYSYGDTKIRSNVKHHNHSYNAEALLNYNYLVKNSIIVTPNIGLRYGKSRDGIYNETGINVQKIALT

SEQ ID NO: 16692 - protein, 108 aa, Wolbachia endosymbiont
  misc_feature (91)..(91): Xaa can be any naturally occurring amino acid
ANSLTAISGLVNVYYDIAIEDMPITPYIGVGVGAAYISTPLATAVSSQNGKFAFAGQARAGVSYDITPEIKLYAGARYFGSYGANFDKTNXDGKGELKVLYSTVGAEA

SEQ ID NO: 16693 - protein, 108 aa, Wolbachia endosymbiont
  misc_feature (107)..(107): Xaa can be any naturally occurring amino acid
ANSLTAISGLVNVYYDIAIEDMPITPYIGVGVGAAYISTPLATAVSSQNGKFAFAGQARAGVSYDITPEIKLYAGARYFGSYGANFDKTNNDGKGELKVLCSTVGAXA

SEQ ID NO: 16694 - protein, 108 aa, Wolbachia endosymbiont
  misc_feature (14)..(14): Xaa can be any naturally occurring amino acid
  misc_feature (85)..(85): Xaa can be any naturally occurring amino acid
  misc_feature (94)..(94): Xaa can be any naturally occurring amino acid
  misc_feature (100)..(100): Xaa can be any naturally occurring amino acid
  misc_feature (106)..(106): Xaa can be any naturally occurring amino acid
ANSLTAISGLVNVXYDIAIEDMPITPYVGVGVGAAYISTPLTTAVSIQNGKLAFAGQARAGVSYDITPEIKLYAGARYFGSYGAXFDNNTNDGXWELVVXYSTVGXHA

SEQ ID NO: 16695 - protein, 641 aa, Burkholderia cepacia
MKRETVFGILGVLLYTQPSVAQKSVTDTVRLNFNIDSVALEEVVVKGARTPAANSRWSDMHPVELVTVGGANGDLYKALQTLPGTQVQGETGELLVRGGGSYETQTFIDGMHVLNPYTSNGINTPARSRYSTFMFSGVNLASGGASQEYGEALSAVLPLETKDYSKVDKVGVNASVVGVGGGGTKTFDRGSLSVDLNYQNLGLYDKVYSGRRDFEKPYRMFSGAVQFRYTLDERVVWKVYAQYDRTDFSTYEGDNRRLFGLGEDNIYVNATFRRHTSREWSWFAGAAYSYYNRRMGGAVVSGDNWLEHQQETHLKAKVSKRLSSVFRLDMGIESYIRNYRNHYLLCGTDDSNRMSPTIGAGFFSMAYYPMEQLKMEFSFRTEYTSPNRKMNFSPRLAANYYWGNMMLSGIVGRYTQLPENNCLVRRPQLMSEVCMQYNLGVQYDYEGRFCKAELYYKDYDRLALEETDADTKAVFLTSNGYGHSKGIDLFFRDRASFKNLEYQLSYTYNIAKRKYREYLELTTPQYATRHNAAWVVKYSLPRLRSIVSVTDRFSSGRPYHNPMLPGLMNDEVKPYNSLDLGVTFLASKKVIIHASASNILCRKNEFGKVDNKAVLASSDHFFYVGVYVTLGKKAAYDVSNF

SEQ ID NO: 16696 - protein, 1092 aa, Uncultured bacterium JEC54
MRKIHLKNCQKVILMAVVMFCTLSSLYAQVGQTVTGVVKDTEGEPLIGVSVLEIGTSNGAITNLDGQYTLTLTKNKSVLAFSYIGYTKQEISVSGRKSIIVVMKEDAVGLQEVIVTGYGKTVTKDKLTAAISKVSSEVLERGVRANPLTALAGTVTGVRVTQTSGQPGSGPSIQVRAGASLNGKGSPLYIIDGVQKDDMNDINSNDIESIEILKDAAATALYGARANNGVVLVTTKSGHVGKTTITLNVNVGKGFARDNYNFLNARDYLYWERMAANRSGDDLNLVNGWGTGNDITADGNQTASGIYSTTILTDKNKYLLDYGWQSMKDPVTDNYLLFKETNMRDLNMQDAWTQDYNISFSGGNEKGKYYSSIGYYDETGFPLESGYERLSFNLNGEYKIKNWLKASGFVNFSRSETNPNYMSDANFWSVVPAVPPTFKGANMDGTVIKLINNTQNANWNEMKNYYYRRNTAYKTTLGTSFQIDLMKGLSLKLSGMWYLHMVEKESFNKELPNGPGKVDSNRKASADYARRLDQTYNAIFNYNTSFGDHSISAVGGFEMIDKYNFGLKASGQGATSDDFIGLQFTEPLDANGKSTRNMSTTHTQERIMSGFINASYDYKSKYLFSFSGRYDGYSKLVDNRWGFFPGVSAAWNVYREEFMEKYLDIFSNMKLRMGYGQNGNVNGIGLYELQGSYANAGNYNGVYGLLIDDIAYPGLRWEKTTSFDAAIELGLFNKVDFSVGYFNKKTTDLIADVPLSASSGVGSMKTNNGAVRSQGMELEVNYRIFDRKDFKWNVGANVTFVKSKVLKLPDNGNENNRQGGTEVYKGKGSNETVWRGGIQEGQSYGDIYGFKMTHVVRDEADLANYAYYVDKVPSQPVYGPAAYAQLTVEQQKNAQKLAPGDAVWYDVNGDGIIDTHDQVKFGNSIPKWMGGFNTSASWKGLTLFARFDYALGYKKWNSGYQYFMGITSGSFNVPELAKKTWTEDNPTAGLPVLMTNDTNFKKNYTRNTSLFWENAAYLCAREISLSYDLPSQWTKKAMMEKVTVTLTGQNLFYVTSNNLYTPEYDSKNNTKDDGKGGYALPKTVLMGIKVVF

SEQ ID NO: 16697 - protein, 1007 aa, Methylocapsa acidiphila
MRTFKPSKLSIALLSCGFMVSSGGLYAQEAVKATPEPENVAAKKSDEQEVDAIEVIEVTGFRRSLIKSINQKRFADTVSEQITADDLGALPDVSMADALTRLPGISAVRTGGQAAEINIRGMSGGFVSTTLNGREQVSTSGQRSVEFDQYPSELISQASVFKSPKVSLIEGGVAGTVELKTASPLKNEDKHSFNVNARGMYNDLASDVPDATSTGHRFSVSYQGKFADDTFGVALGYARLFQPSATTQFVGLNYSKLRDVDGLADDTNGPTKEEGIHLAKEYVGEGFELQHKGGEETRDGFVATLEWQPADNFSLKFDSFYSKFDSEEFARGYRVKFDGSQAAIGNATIIDNSVIGGTFNRTSNSSTRVEIVNDDNSDSDEVQSFGINADWQITDNFNMAVDLSYSSATSDFRNGLIWSLVADDANAAQPEFDNNVSINYLLNGLDLPDVSLNQADALTDLSRVMVTKYGIYPYVNSDEVIAARVDFQYSLDSDYISSVEFGARYSEREYSSDRSVYEFGSDSGFNSKEKPLNITEDMATVVDWKGDFSSFPSYLALDQNKVLNAWFPQGIPQPVQTWGGSASGVINGDPLGKDTAWTVKESGQVFEDIFAAYIMANIDVEIGDIPVTGNFGVRVVRTKQASTSLQDVGETRVKDAYGQDAIDENGDVIVQANADLGAQFITDDAGLINQKYAPGIIENTYTDYLPQMNLNFHITPNDQIRFAAAKVMSRPNIDRLASNSSVSINKVTTDSGTYAEISGNAKNSPHLKPFYANQYDISYERYFSESDGSFVFAIFYKDIESAGIVTQTISEYDFAGNGLIVPDEFIDPLSGVPLEIRNGNFETAFNDDKGGYIKGLEVSYTQIFSFLPDFWSGLGLSTSYSHTKSEIQQISQLGQQDLPITLPGLSENVLQTTLFWGYEGFETRISARYRDEFVSEQVAVEAQTVNYDDELVIDYQASYQFNDNLGVVFQVNNVTDEPTKSYFGVQSQTGTIQYFGRQFFLGMTYAL

SEQ ID NO: 16698 - protein, 98 aa, Methylocapsa acidiphila
MASGGRCYQESAMSVARNLWRVADAPHIVPADSVERQTAERLINACPAGLFSLTPEGNLRIDYRSCLECGTCRLLCDESTLQQWRYPPSGFGITYRFG

SEQ ID NO: 16699 - protein, 778 aa, Uncultured bacterium
MLRRRSEPITTTTRYSVKKHRIALAASAVLMGPAVAAAQGVEAAVGAPAPLQEVVVSARPDRAETPAIPPNTPAPAYGISSTRMADFNVVNTEDALKYAPNLAVRKRFIGDMNSIISVRSTSSRQSARGLVYADGLLLSNLLGSDFSFPPRWSLVNAAEIERMDVLYGPYSALYPGNSLGATVLITTRTPEKFEGDASVQLFTQRFGLYGTHDNFNGVHANAYVGDRVGPFSWLVSVDRQDSKSQPLSFYTASRSTRPAGAADTPVSGAYFDQDQSGRDRVVMGVNSEGVTHTVQDQLKLKLGYDITSTLQAQFTAAYWQQDRSNTTGSYLRDANGNVVSGGPVNIGGYQYVIPANAFAPGNGEDARWLYGLSLRTRNQTGWNFSGVASLFDVSKDVSRSANTVANGPGTVTYGDGTGWRTLDLKADYRPQQLQGGHWVTFGYHYDNYRLTNTTYNTSDWRAATITAFNNAFTGKTETQALYAQDAWYFAEDWKLIPGVRYEHWRAYDGSRSEPGVDIGYPVRSESNWSPKLALEKAFGQDWLGRLSLGQAYRYPTVSELFQGRITGTSLINNDPNLRPERSFSKDLTFERTVEASNFRVSLYEDDIRDALVSQTNTTVFPTVTSFQNVDRVRTRGIELAYDGRDVLVSGFDLSASGAYNHSKTLENANNPASVDKYFYRIPKWRANLVGTYRFTPAWAGTLAMTYSGRQYNTLDNSDTNPDTFGGTSSFLTFDVKVTYKPARNVRLGLGIDNLTDQRYYVYHPYPGRTFYAEAKLSF

SEQ ID NO: 16700 - protein, 721 aa, Uncultured bacterium
MFGSPGLFAQEFEPGLVSESAESGDKTRIIVLGQKIERPLDEVTDSVVVVTDEEIAREPVLDLYDLIERIPNVSASVDERGFAIRGIDQRGVSGRGSTLVVYVDDSPLGNRTTFFGPNDTWDLAQVEVYRGPQSTNFGRSSLAGTIYLRTKDPTFDWTLDVRGEVGEFGRRQIAAAGGGAIVDDVLAFRASINHQASDGFVFNTFLGEEADENELTTARFKLLFEPAPNISIVSTSGYTDNMGGEGSLSPTNRVPAGPALRPGEVNREVAYNVPGIEGTESFIQSLNASWEVAPGLTLQSIGTFQQTDYFRQFDGDNMPQSLSISTRSGDDEIFTQELRAQFANEWFSGVVGGYFFDSNADETDDFVIPGFFLSPVAPFDAFIERESDLSNRTRNYALFADGEFAVSNTVDLIFGLRYDYEKFESFSRAVTSPVEPFPQGAESLNRFFGTETEAIDASYDAWLPKVGLRWTVSDDANISFVAQRAYQAGGGIFDVVDGLVSEFDPEYLWNYELGARTAWMDGRLVVNANLYYADWTDQQVAQRRPDFPFVFIVTNAGKSTLYGFEADATFDVSDVVTIYGSVGYAHTEFDRFPNPRFNPTRPASEFNQADFAGNRFPNAPRFSANFGLSFDEGLGWFGGIEGNHQTSTFNSSENIAANRCCERITVNARIGYAWENFRLSAQARNLFNEDYFTFLSVANFSAPVGFLGDPRIISVRLDTSF

SEQ ID NO: 16701 - protein, 690 aa, Uncultured bacterium
MAADNRAAKSTNDAEETITVVADGAQQSATSGYQPLSSATATLTSMPLLDIPQVVNTVSDRVLEDQHATSLDEALYNVANVVQTNTLGGTQDAFTRRGFGANRDGSIMTNGLRTVLPRSFNAATERVEVLKGPASTLYGILDPGGLINVITKRPERQFSGSVSGTSTSFGGGTGSVDITGPIEGTNLAYRLIGEYQNEDYWRNFGKNKSSFIAPSLTWFGERATVTASYSHRDYSAPFDRGTIFDLNTGHAVNVDRKTRFDEAFNITDGYSDLAQLNAEYRLNDAWTARFDYSYSQDHYNDNQARVMAYDSATGNLTRRVDGTHGSTQKMHSTRADLQGNVVVGGFYNELLTGVAYENYDLLRTDMLRCKNVKGFNIYHPVYGTLDTCNTVSASDSDQRIQQESYAAYVQDALYLTDNWIAVAGVRYQYYTQYAGKGRPFNVNTDSRDEKWTPKAGLVYKITPNVSLFANVAQSFMPQSSIASYIGELPPEESTSYEVGAKFDLLNGITANIALFDIHKRNVLYTESIGDETVAKTAGKVRSQGVEVDLAGSITDNLSVIASYGYTDAKVLEDPDYAGKPLPNVPKHTGSLFLTYDIHNVYNSNTLTVGGGGHAVSKRSGTNGADYYLQGYAVADVFAAYKMKLQYPVTLQVNVKNLFDKTYYTSSIGTNNLGNQIGDPREVQFTVKMDF

SEQ ID NO: 16702 - protein, 571 aa, Uncultured bacterium
MYRISSSGLLLCLLSQTAMAADLPRRALPPAATAVPIFSWTGAHAGLFAGYGTLDRATQFVCTGPDGQPGARNCPVIPSKRASDGSFVGGAEVGYDWQVNSGFVAGAAADYQFTRLWGYDRREGAFPAAGGGFYRRSVAHSGQRLDELATLRGRIGFAVDRTLVYATGGLAAGTVRTDNNLSLAGFPLFDRRQGAVRLGYVAGAGIEHAFSEHLSAKVEGLYYDLGSRAVLPAPSYPVLTGYHAGTRVATDGFLARVGLNYRFGAGLPDLPPVALAGPATWDFEGGLRYFFSAGTPREKLGDPDAPGQLNSRLTYANAQAHAGESFARLEHNPTGLFAKGFLGSGGVTGGRLADEDFPPALRRYSKTLSPIKDGDSGYGVIDLGYDVLRRDGYKLGGFLGYQFASELYNGYGCRQVAGGTPCARPYPTSMKTLGESMQWNALRVGVIGEARFDRVRLSLEGAYLPVVSLSGVDRHWLRPDINPGPEGGRGDGYFLEGIISYDLTPSVSVGVGGRYWQLQADKAHTTAFPFSPPSPMKFETGRYGGFAQLSYRLADFGFGETGAPAAPIRKD

SEQ ID NO: 16703 - protein, 452 aa, Uncultured bacterium
MIRRCLALAVTTALFPVVSQATNLLQVYEMARAADPQLSAAESTRLYSVEGQVQARAALLPQMSGTATLARSRTEYDGISGSAISKTRQYSINGTQTLFNWSQFSNLRSQRAIAKAADFTLESAKQNLIVRSSAAYFSVLIGIESLIAAEANEASAKRQFDYAQKRLEVGLSPITDLHEARASYDQARADTITARNTLQDYYQALTEITGQPVTDLRGLPEDFRPEVPAKFSHIDQLVTEAISNNPSLKAQQLQVNAAESSISAARGEHYPTLSLSGSLGKSKAWGTSSGAMSALIPDRDQPISDTNNLQLTLSIPLFAGGATQSRVRQAIAQRDIQQDTYEQNKRTLNRNTRNAYQNMIAGISEVEARRLAVVSAQAALDASQVGLEVGTRTLLDVVQNQRILFSVRQAYVQARYNFLQNRLLLSQNSGTLSIEDVQEINQLLTADSERKL

SEQ ID NO: 16704 - protein, 1364 aa, Escherichia coli
MNKVFSLKYSFLAKGFIAVSELARRVSVKGKLKSASSIIISPITIAIVSYAPPSLAATVNADISYQTFRDFAENKGAFIVGASNINIYDKNGVLVGVLDKAPMPDFSSATMNTGTLPPGDHTLYSPQYVVTAKHVNGSDIMSFGHIQNNYTVVGENNHNSLDIKIRRLNKIVTEVAPAEISSVGAVNGAYQEGGRFKAFYRLGGGLQYIKDKNGNLTPVYTNGGFLTGGTISALSSYNNGQMITAPTGDIFNPANGPLANYLNKGDSGSPLFAYDSLDKKWVLVGVLSSGSEHGNNWVVTTQDFLHQQPKHDFDKTISYDSEKGSLQWRYNKNSGVGTLSQESVVWDMHGKKGGDLNAGKNLQFTGNNGEIILHDSIDQGAGYLQFFDNYTVTSLTDQTWTGGGIITEKGVNVLWQVNGVNDDNLHKVGEGTLTVNGKGVNNGGLKVGDGTVILNQRPDDNGHKQAFSSINISSGRATVILSDANQVNPDKISWGYRGGTLDLNGNNVNFTRLQAADYGAIVSNNNKNKSELTLKLQTLNENDISVDVKTYEVFGGHGSPGDLYYVPASNTYFILKSKAYGPFFSDLDNTNVWQNVGHDRDKAIQIVKQQKIGESSQPYMFHGQLNGYMDVNIHPLSGKDVLTLDGSVNLPEGVITKKSGTLIFQGHPVIHAGMTTSAGQSDWENRQFTMDKLRLDAATFHLSRNAHMQGDISAANGSTVILGSSRVFTDKNDGTGNAVSSVEGSSIATTAGDQSYYSGNVLLENHSSLEVRENFTGGIEAYDSSVSVTSQNAIFDHVGSFVNSSLLLEKGAKLTAQSGIFTNNTMKIKENASLTLTGIPSVGKPGYYSPVTSTTEGIHLGERASLSVKNMGYLSSNITAENSAAIINLGDSNATIGKTDSPLFSTLMRGYNAVLQGNIMGPQSSVNMNNALWHSDRNSELKELKANDSQIELGVRGHFAKLRVKELIASNSVFLVHANNSQADQLNVTDKLQGSNNTILVDFFNKAANGTNVTLITAPKGSDENTFKAGTQQIGFSNITPEIRTENTDTATQWVLTGYQSVADARASKIATDFMDSGYKSFLTEVNNLNKRMGDLRDSQGDAGGWARIMNGTGSGESGYRDNYTHVQIGADRKHELNGIDLFTGALLTYTDNNASSQAFSGKTKSLGGGVYASGLFESGAYFDLIGKYLHHDNRYTLNFASLGERSYTSHSLYAGAEIGYRYHMSENTWVEPQMELVYGSVSGKSFNWKDQGMQLSMKDKDYHPLIGRTGVDVGRAFSGDTWKVTVRAGLGYQFDLLANGETVLQDASGKKHFKGEKDSRMLMNVGTNVEVKDNMRFGLELEKSAFGRYNIDNSINANFRYYF

SEQ ID NO: 16705 - protein, 919 aa, Pasteurella trehalosi
MRMKKNFAYHPLSAAIFAALISPTVSANTQTNTNTERLELDEVIVTESRYAHERQNEVTGLGKVVKNYHEMSKNQILGIRDLTRYDPGISVVEQGRGASSGYAIRGVDKNRVSLLVDGLPQAQHYHTLGSDANGGAINEIEYENIRSIELSKGASSAEYGSGALGGAIGFRTKDAQDIIKEGQHWGLDSKTSYASKNSHFLQSIAAAGEAGGFEALVIATHRHGKETKIHSEANKLKHNIRRITGFENRYDLYPGSAQNAPGGSFFIVEDTCPTLDCTPRARPKLNRDNFPVRTFPEYTPEERKQLEQIPYRTEQLSAQEYTGKDRIAPNPLDYKSNSVFMKFGYHFNSSHYLGAILEDTKQRYDIRDMQTPAYYTKDDINIRVDNLSRKNSSVYEGDNILDGLVFDRRIPYGLRYSHVKFFDERHHKRRLGFNYQYTPENNRWLDNIKLSADKQDIELYSRLHRLHCSDYPVVDKNCRPTLDKSWSMYRTERNNYQEKHRVIHLEFDKALNAGQGVFKQTHKLNLGLGFDRFNSLMDHGDMTAQYTKGGYTSYRGRGRLDNPYIYRRNPRSIETVSLCNNTHGDIINCEPRKIKGDSHFVSFRDLVISEYVDLGLGVRFDQHRFKSDDPWTLSRTYRNWSWNGGITLKPTEFVSLSYRISNGFRVPAFYELYGKRDHIGLKDNEYVQREQRSHQLEPEKSTNHEIGVSFKGQFGYLDVSYFRNNYKNMIATACKRIIQKSHCFSNYHNIQDVALNGINLVAKFDLHGILSMLPDGFYSSVAYNRVKVKERKLTDSRLDSVNDPILDAIQPARYVLGFGYDHPEEKWGIGITTTYSKAKNADEVAGTRHHGIYRVDLGGKLTGSWYTHDITGYINYKHYTLRGGIYNVTNRKYSTWESVRQSGVNAVNQDRGSNYTRFA

SEQ ID NO: 16706 - protein, 883 aa, Pasteurella trehalosi
MRMKISKLSCAVVAALATTPVYAQQEAAKTGKASIETIEVTATKRSESIQDIPVSVTALNGEALENLGVDNFQEYVEFLPNVTFQGTGPGQNEIYIRGAATTQSNISVSSVQALQPSVAFYLDEQPVSMQGRNLDIYATDMQRIEVLPGPQGTLFGASSQSGTVRLITKKPDHTGFAAGVDTSTSFTKGGEMSNSVEGFINFAVSDDLAFRVAAYTDNQGGWIDNIRNDPANGGYIGSAVVIDRISGGVLSDPENTPVISPENDALVEDDFNDAVYSGARFGLSYIINEDWDLLVQHTQQTLSTEGVFAYDPNLERETSTNRFVPEDNDDEFGLTTWTLEGRLDKLDIVYTGGYLDRSIDSTIDYTGYTNGGLFSAYYVCNYGGDVAPEDEICLDPTKYYKEKTDSTRMTHELRFNTPTDNVWRLTAGVFYDEQDLNSVGKFNIANTDKFDDLARTLVGSEGVNSTSQPFEPSISFVNDIQHAIDQIAVFGQIEYDLTDDITATFGARWYEIQDTYKGSTTTVDVSRRLRAFGTQDPAELAASGLDDGVIAAIESGQLEVDLLDGDGTLTVDDVILKASVDWKVNEDILVFATYSEGFRPPVTNRVGGGLATNQTGAFEDFRIPVYSTTDELDNYEFGIKGDFLDGILRVNATAYYSEISDLQTSRYDPTNISFLVFTDNVGDAEIRGLDADLTWLATDNLVINAAFSVLDTELTSINAALDGIAPPVGSKLPYSADFSGNIRAQYFYELDNGFTGYINGSISYTGDRLASMSMDAYALEDAAQLVYGAGTGLSIEREAAVYEGVTFADSNGETIQGGRYIQDSYILANLAFGITNDEWKAEIFIDNLTDESAILYIDAQQYTPKIVSNRPRTVGLRLSYDFF

SEQ ID NO: 16707 - protein, 919 aa, Pasteurella trehalosi
MRMKKNFAYHPLSAAIFAALISPTVSANTQTNTNTERLELDEVIVTESRYAHERQNEVTGLGKVVKNYHEMSKNQILGIRDLTRYDPGISVVEQGRGASSGYAIRGVDKNRVSLLVDGLPQAQHYHTLGSDANGGAINEIEYENIRSIELSKGASSAEYGSGALGGAIGFRTKDAQDIIKEGQHWGLDSKTSYASKNSHFLQSIAAAGEAGGFEALVIATHRHGKETKIHSEANKLKHNIRRITGFENRYDLYPGSAQNAPGGSFFIVEDTCPTLDCTPRARPKLNRDNFPVRTFPEYTPEERKQLEQIPYRTEQLSAQEYTGKDRIAPNPLDYKSNSVFMKFGYHFNSSHYLGAILEDTKQRYDIRDMQTPAYYTKDDINIRVDNLSRKNSSVYEGDNILDGLVFDRRIPYGLRYSHVKFFDERHHKRRLGFNYQYTPENNRWLDNIKLSADKQDIELYSRLHRLHCSDYPVVDKNCRPTLDKSWSMYRTERNNYQEKHRVIHLEFDKALNAGQGVFKQTHKLNLGLGFDRFNSLMDHGDMTAQYTKGGYTSYRGRGRLDNPYIYRRNPRSIETVSLCNNTHGDIINCEPRKIKGDSHFVSFRDLVISEYVDLGLGVRFDQHRFKSDDPWTLSRTYRNWSWNGGITLKPTEFVSLSYRISNGFRVPAFYELYGKRDHIGLKDNEYVQREQRSHQLEPEKSTNHEIGVSFKGQFGYLDVSYFRNNYKNMIATACKRIIQKSHCFSNYHNIQDVALNGINLVAKFDLHGILSMLPDGFYSSVAYNRVKVKERKLTDSRLDSVNDPILDAIQPARYVLGFGYDHPEEKWGIGITTTYSKAKKADEVAGTRHHGIYRVDLGGKLTGSWYTHDITGYINYKNYTLRGGIYNVTNRKYSTWESVRQSGVNAVNQDRGSNYTRFA

SEQ ID NO: 16708 - protein, 922 aa, Mannheimia glucosida
MIMKYHHFRYSPVALTVLFALSHSYGAATENKKIEENNDLAVLDEVIVTESHYAHERQNEVTGLGKVVKNYHEMSKNQILGIRDLTRYDPGISVVEQGRGASSGYAIRGVDKNRVSLLVDGLPQAQHYHTLGSDANGGAINEIEYENIRSIELSKGASSAEYGSGALGGAIGFRTKDAQDIIKEGQHWGLDSKTSYASKNSHFLQSIAAASEAGGFEALVIATHRHGKETKIHSEANKLKHNIRRITGFENRYDLYPGSAQNAPGGSFFIVEDTCPTLDCTPRARPKLNRDNFPVRTFPEYTPEERKQLEQIPYRTEQLSAQEYTGKDRIAPNPLDYKSNSVFMKFGYHFNSSHYLGAILEDTKQRYDIRDMQTPAYYTKDDINIRVDNLSRKNSSVYEGDNILDGLVFDRRIPYGLRYSHVKFFDERHHKRRLGFNYQYTPENNRWLDNIKLSADKQDIELYSRLHRLHCSDYPVVDKNCRPTLDKSWSMYRTERNNYQEKHRVIHLEFDKALNAGQGVFKQTHKLNLGLGFDRFNSLMDHGDMTAQYTKGGYISYRGRGRLDNPYIYRRNPRSIETVSLCNNTHGDIINCEPRKIKGDSHFVSFRDLVISEYVDLGLGVRFDQHRFKSDDPWTLSRTYRNWSWNGGITLKPTEFVSLSYRISNGFRVPAFYELYGKRDHIGLKDNEYVQREQRSHQLEPEKSTNHEIGVSFKGQFGYLDVSYFRNNYKNMIATACKRIIQKSHCFSNYHNIQDVALNGINLVAKFDLHGILSMLPDGFYSSVAYNRVKVKERKLTDSRLDSVNDPILDAIQPARYVLGFGYDHPEEKWGIGITTTYSKAKNADEVAGTRHHGIHRVDLGGKLTGSWYTHDITGYINYKNYTLRGGIYNVTNRKYSTWESVRQSGVNAVNQDRGSNYTRFA

SEQ ID NO: 16709 - protein, 922 aa, Mannheimia glucosida
MIMKYHHFRYSPVALTVLFALSHSYGAATENKKIEENNDLAVLDEVIVTESHYAHERQNEVTGLGKVVKNYHEMSKNQILGIRDLTRYDPGISVVEQGRGASSGYAIRGVDKNRVSLLVDGLPQAQHYHTLGSDANGGAINEIEYENIRSIELSKGASSAEYGSGALGGAIGFRTKDAQDIIKEGQHWGLDSKTSYASKNSHFLQSIAAAGEAGGFEALVIATHRHGKETKIHSEANKLKHNIRRITGFENRYDLYPGSAQNAPGGSFFIVEDTCPTLDCTPRARPKLNRDNFPVRTFPEYTPEERKQLEQIPYRTEQLSAQEYTGKDRIAPNPLDYKSNSVFMKFGYHFNSSHYLGAILEDTKQRYDIRDMQTPAYYTKDDINIRVDNLSRKNSSVYEGDNILDGLVFDRRIPYGLRYSHVKFFDERHHKRRLGFNYQYTPENNRWLDNIKLSADKQDIELYSRLHRLHCSDYPVVDKNCRPTLDKSWSMYRTERNNYQEKHRVIHLEFDKALNAGQGVFKQTHKLNLGLGFDRFNSLMDHGDMTAQYTKGGYISYRGRGRLDNPYIYRRNPRSIETVSLCNNTHGDIINCEPRKIKGDSHFVSFRDLVISEYVDLGLGVRFDQHRFKSDDPWTLSRTYRNWSWNGGITLKPTEFVSLSYRISNGFRVPAFYELYGKRDHIGLKDNEYVQREQRSHQLEPEKSTNHEIGVSFKGQFGYLDVSYFRNNYKNMIATACKRIIQKSHCFSNYHNIQDVALNGINLVAKFDLHGILSMLPDGFYSSVAYNRVKVKERKLTDSRLDSVNDPILDAIQPARYVLGFGYDHPEEKWGIGITTTYSKAKNADEVAGTRHHGIHRVDLGGKLTGSWYTHDITGYINYKNYTLRGGIYNVTNRKYSTWESVRQSGVNAVNQDRGSNYTRFA

SEQ ID NO: 16710 - protein, 916 aa, Mannheimia glucosida
MIMKYHHFRYSPVALTVLFALSHSYGAATENKKIEENNDLAVLDEVIVTESHYAHERQNEVTGLGKVVKNYHEMSKNQILGIRDLTRYDPGISVVEQGRGASSGYAIRGVDKNRVSLLVDGLPQAQHYHTLGSDANGGAINEIEYENIRSIELSKGASSAEYGSGALGGAIGFRTKDAQDIIKEGQHWGLDSKTSYASKNSHFLQSIAAAGEAGGFEALVIATHRHGKETKIHSEANKLKHNIRRITGFENRYDLYPNSAQNAPGGSFFIVEDTCPTLDCTPRASVKLNRDNFPVRTFPEYTPEERKQLEQIPYRTEQLSAQEYTGKDRIAPNPLDYKSNSVFMKFGYHFNSSHYLGAILEDTKQRYDIRDMQTPAYYTKDDINLSLRNYVYEGDNILDGLVFKPRIPYGLRYSHVKFFDERHHKRRLGFNYQYTPENNRWLDNIKLSADKQDIELYSRLHRLHCSDYPVVDKNCRPTLDKSWSMYRTERNNYQEKHRVIHLEFDKALNAGQGVFKQTHKLNLGLGFDRFNSLMDHGDMTAQYTKGGYTSYRGRGRLDNPYIYRRDPRSIETVSLCNNTHGDILNCEPRKIKGDSHFVSFRDLVISEYVDLGLGVRFDQHRFKSDDPWTLSRTYRNWSWNGGITLKPTEFVSLSYRISNGFRVPAFYELYGKRDHIGLKDNEYVQRAQRSHQLEPEKSTNHEIGVSFKGQFGYLDVSYFRNNYKNMIATACKRIIQKSHCFYNYHNIQDVALNGINLVAKFDLHGILSMLPDGFYSSVAYNRVKVKERKLTDSRLDSVNDPILDAIQPARYVLGFGYDHPEEKWGIGITTTYSKAKNADEVAGTRHHGIHRVDLGGKLTGSWYTHDITGYINYKNYTLRGGIYNVTNRKYSTWESVRQSGVNAVNQDRGSNYTRFA

SEQ ID NO: 16711 - protein, 930 aa, Mannheimia glucosida
MIMKYHHFRYSPVALTVLFALSHSYGAATENKKIEENNDLAVLDEVIVTESHYAHERQNEVTGLGKVVKNYHEMSKNQILGIRDLTRYDPGISVVEQGRGASSGYAIRGVDKNRVSLLVDGLPQAHSYHTLGSDANGGAINEIEYENIRSIELSKGASSAEYGSGAHGGAIGFRTKDAQDIIKEGQHWGLDSKTSYASKNSHFLQSIAAAGEAGGFEALVIATHRHGKETKIHSEANKLKHNIRRITGFENRYDFTQIPHRMLLEDLLLIVEDTCPTLDCTPRARVKLNRDNFPVRTFPEYTPEERKQLEQIPYRTEQLSAQEYTGKDRIAPNPLDYKSNSVFMKFGYHFNSSHYLGAILEDTKTRYDIRDMQTPAYYTKDDINLSLRNYVYEGDNILDGLVFKPRIPYGLRYSHVKFFDERHHKRRLGFTYKYKPENNRWLDSIKLSADKQDIELYSRLHRLHCSDYPVVDKNCRPTLDKSWSMYRTERNNYQEKHRVIHLEFDKALNAGQGVFNQTHKLNLGLGFDRFNSLMDHGDMTAQYTKGGYTSYRGRGRLDNPYIYRRDPRSIETVSLCNNTRGDILNCEPRKIKGDSHFVSFRDLVISEYVDLGLGVRFDQHRFKSDDPWTLSRTYRNWSWNGGITLKPTEFVSLSYRISNGFRVPAFYELYGKRDHIGLKDNEYVQRAQRSHQLEPEKSTNHEIGVSFKGQFGYLDVSYFRNNYKNMIATACKRIIQKSHCFYNYHNIQDVALNGINLVAKFDLHGILSMLPDGFYSSVAYNRVKVKERKLTDSRLDSVNDPILDAIQPARYVLGFGYDHPEEKWGIGITTTYSKAKNADEVAGTRHHGIHRVDLGGKLTGSWYTHDITGYINYKNYTLRGGIYNVTNRKYSTWESVRQSGVNAVNQDRGSNYTRFGAPGRNFSLAFEMKF

SEQ ID NO: 16712 - protein, 922 aa, Mannheimia glucosida
MIMKYHHFRYSPVALTVLFALSHSYGAATENKKIEENNDLAVLDEVIVTESHYAHERQNEVTGLGKVVKNYHEMSKNQILGIRDLTRYDPGISVVEQGRGASSGYAIRGVDKNRVSLLVDGLPQAQHYHTLGSDANGGAINEIEYENIRSIELSKGASSAEYGSGALGGAIGFRTKDAQDIIKEGQHWGLDSKTSYASKNSHFLQSIAAAGEAGGFEALVIATHRHGKETKIHSEANKLKHNIRRITGFENRYDLYPGSAQNAPGGSFFIVEDACPTLDCTPRARAKLNRDNFPVRTFPEYTPEERKQLEKIPYRTEQLSAQEYTGKDRVAPNPLDYKSNSVFMKFGYHFNSSHYLGAILEDTKQRYDIRDMQTPAYYTKDDINIRVDNLSRKNSSVYEGDNILDGLVFDRRIPYGLRYSHVKFFDERHHKRRLGFNYQYTPENNRWLDNIKLSADKQDIELYSRLHRLHCSDYPVVDKNCRPTLDKSWSMYRTERNNYQEKHRVIHLEFDKALNAGQGVFKQTHKLNLGLGFDRFNSLMDHGDMTAQYTKGGYTSYRGRGRLDNPYIYRRNPRSIETVSLCNNTHGDIINCEPRKIKGDSYFVSFRDLVISEYVDLGLGVRFDQHRFKSDDPWTLSRTYRNWSWNGGITLKPTEFVSLSYRISNGFRVPAFYELYGKRDHIGLKDNEYVQREQRSHQLEPEKSTNHEIGVSFKGQFGYLDVSYFRNNYKNMIATACKRIIQKSHCFSNYHNIQDVALNGINLVAKFDLHGILSMLPDGFYSSVAYNRVKVKERKLTDSRLDSVNDPILDAIQPARYVLGFGYDHPEEKWGIGITTTYSKAKNADEVAGTRHHGIHRVDLGGKLTGSWYTHDITGYINYKNYTLRGGIYNVTNRKYSTWESVRQSGVNAVNQDQGSNYTRFA

SEQ ID NO: 16713 - protein, 922 aa, Pasteurella haemolytica
MIMKYHHFRYSPVALTVLFALSHSYGAATENKKIEENNDLAVLDEVIVTESHYAHERQNEVTGLGKVVKNYHEMSKNQILGIRDLTRYDPGISVVEQGRGASSGYAIRGVDKNRVSLLVDGLPQAQHYHTLGSDANGGAINEIEYENIRSIELSKGASSAEYGSGALGGAIGFRTKDAQDIIKEGQHWGLDSKTSYASKNSHFLQSIAAAGEAGGFEALVIATHRHGKETKIHSEANKLKHNIRRITGFENRYDLYPGSAQNAPGGSFFIVEDTCPTLDCTPRARPKLNRDNFPVRTFPEYTPEERKQLEQIPYRTEQLSAQEYTGKDRIAPNPLDYKSNSVFMKFGYHFNSSHYLGAILEDTKQRYDIRDMQTPAYYTKDDINIRVDNLSRKNSSVYEGDNILDGLVFDRRIPYGLRYSHVKFFDERHHKRRLGFNYQYTPENNRWLDNIKLSADKQDIELYSRLHRLHCSDYPVVDKNCRPTLDKSWSMYRTERNNYQEKHRVIHLEFDKALNAGQGVFKQTHKLNLGLGFDRFNSLMDHGDMTAQYTKGGYTSYRGRGRLDNPYIYRRNPRSIETVSLCNNTHGDIINCEPRKIKGDSHFVSFRDLVISEYVDLGLGVRFDQHRFKSDDPWTLSRTYRNWSWNGGITLKPTEFVSLSYRISNGFRVPAFYELYGKRDHIGLKDNEYVQREQRSHQLEPEKSTNHEIGVSFKGQFGYLDVSYFRNNYKNMIATACKRIIQKSHCFSNYHNIQDVALNGINLVAKFDLHGILSMLPDGFYSSVAYNRVKVKERKLTDSRLDSVNDPILDAIQPARYVLGFGYDHPEEKWGIGITTTYSKAKNADEVAGTRHHGIHRVDLGGKLTGSWYTHDITGYINYKNYTLRGGIYNVTNRKYSTWESVRQSGVNAVNQDRASNYTRFA

SEQ ID NO: 16714 - protein, 922 aa, Pasteurella haemolytica
MIMKYHHFRYSPVALTVLFALSHSYGAATENKKIEENNDLAVLDEVIVTESRYAHERQNEVTGLGKVVKNYNEMSKNQILGIRDLTRYDPGISVVEQGRGASSGYAIRGVDKNRVSLLVDGLPQAQHYHTRGSDANGGAINEIEYENIRSIELSKGASSAEYGSGALGGAIGFRTKDAEDIIKEGQHWGLDSKTAYASKNSHFLQSIAAAGEAGGFEALVIATHRHGKETKIHSEANKLKHNIRRITGFENRYDLYPRSAQNAPGGSFFIVEDACPTLDCTPRARVNLNRDNFPLRKSPEYTPEERKQLEQIPYRTEQVSAKEYTGKDRIAPNPLDYKSNSVFVKLGYHFNPSHFLGAILEDTKQRYDMRDMQTQAYYTKDDVNLRVDNLWIKNPVYEGDNILDGLVFSRRIPYGLRYSRVKFFDEHHHKRRLGFNYQYKPENNRWLDSVKLSADKQDIELYSRMHRLHCSDYPVVDKNCRPTLDKSWSMYQTERNSYQEKHRVVRLEFDKAFSAGQGIFKQTHKLNLGLGFDRFNSLMDHGDMTAQYTKGGYTSYRGRGRLDDPYIYRRDPRSIETVSLCNNTHGGITNCEPRKIKGDSRFVSFRDLITSEYVDLGLGVRFDQHRFKSDDPWTLSRTYRNWSWNGGVTLKPTEFMSLSYRISNGFRVPAFYELYGKRDHIGLIDNEYVQREQRSHQLEPEKSTNHEVGVSFKGQFGYLDVSYFRNNYKNMIATACKKNINQKSDCFYNYHNIQDVVLNGVNLVAKFDLHGILSLLPDGFYSSVAYNRVKVKERKLANLRLTSVNDPILDAIQPARYVLGFGYDDPEEKWGIGITTTYSKAKKADEVAGTRHHGVHRVDLGGKLTGSWYTHDITGYINYKNYTLRGGIYNVTNRKYSTWESVRQSGVNAVNQDRGSNYTRFA

SEQ ID NO: 16715 - protein, 780 aa, Pasteurella haemolytica
MKEFLRGATRVLGTATIAFLTSTSATALAQTATPPTAPDQAGDRQGQAAGLEDIVVTARRVKESLQETPVAVTAFSAAAIDRKFATDIRALAGDVPNVVITNVPGFNAASIGIRGQSTGDIILTFEPAVGVVVDDFVLAHVQTQLFDLFDIDRIEVLRGPQGTLFGKNTVGGVVNVITKRPEKDFGGELRLGYSSFRTKDVKAAINIPLSDNLFFRAAGSFQESDGYYRLTKTNNVDFIPVDVPARGQRWGGTRYFSGRAKLLWEPGPDTNVLLTYEMLRDRGDSPPSVNETPKGFLFDVVGFPGIQTTGGSPFDTGTTLCRGDINAATCPGTLLGHRIDVDGGYLRVEHSFPDVGALTVVGGYRRVKSILPSDYTGESAYLFVSTRDDVREQYSVEARFSSDFSDRIKFTAGTMYWGQTLDAKATSFLGFLRFLGDPTALTDPNQSTANYKVDSYAAFGEAEYKVSDPFALFLGGRYTKEKKSFSVRPQVRRSTIATGFWPEYSDSASFSKPTFRAGYRWQIADGINNYFTYSQGYKSGGYNEQAMSATSALPFKEETADSFELGLKTETADRRLRFNAAAFYVRYDDLQRDAVVPFVDPITGLPGQETRTTNAGKAEVYGLELEASAVPVDGLTLSASLGWQKAKYLEFLTDVDGDGVNDDASNLKLRNVPKWTANASANYAFPPTDWGQVSLNADVNYQSQYESVTLNAPYTQGQARTLVGASIQWNDPSERYRVSIFGRNLLDETYRVSANSVAGLFNFTNYAPPRSYGIELGVKF

SEQ ID NO: 16716 - protein, 922 aa, Pasteurella haemolytica
MIMKYHHFRYSPVALTVLFALSHSYGAATENKKIEENNDLAVLDEVIVTESHYAHERQNEVTGLGKVVKNYHEMSKNQILGIRDLTRYDPGISVVEQGRGASSGYAIRGVDKNRVSLLVDGLPQAQHYHTLGSDANGGAINEIEYENIRSIELSKGASSAEYGSGALGGAIGFRTKDAQDIIKEGQHWGLDSKTSYASKNSHFLQSIAAASEAGGFEALVIATHRHGKETKIHSEANKLKHNIRRITGFENRYDLYPGSAQNAPGGSFFIVEDTCPTLDCTPRARPKLNRDNFPVRTFPEYTPEERKQLEQIPYRTEQLSAQEYTGKDRIAPNPLDYKSNSVFMKFGYHFNSSHYLGAILEDTKQRYDIRDMQTPAYYTKDDINIRVDNLSRKNSSVYEGDNILDGLVFDRRIPYGLRYSHVKFFDERHHKRRLGFNYQYTPENNRWLDNIKLSADKQDIELYSRLHRLHCSDYPVVDKNCRPTLDKSWSMYRTERNNYQEKHRVIHLEFDKALNAGQGVFKQTHKLNLGLGFDRFNSLMDHGDMTAQYTKGGYTSYRGRGRLDNPYIYRRNPRSIETVSLCNNTHGDIINCEPRKIKGDSHFVSFRDLVISEYVDLGLGVRFDQHRFKSDDPWTLSRTYRNWSWNGGITLKPTEFVSLSYRISNGFRVPAFYELYGKRDHIGLKDNEYVQREQRSHQLEPEKSTNHEIGVSFKGQFGYLDVSYFRNNYKNMIATACKRIIQKSHCFSNYHNIQDVALNGINLVAKFDLHGILSMLPDGFYSSVAYNRVKVKERKLTDPRLDSVNDPILDAIQPARYVLGFGYDHPEEKWGIGITTTYSKAKNADEVAGTRHHGIHRVDLGGKLTGSWYTHDITGYINYKNYTLRGGIYNVTNRKYSTWESVRQSGVNAVNQDRGSNYTRFA

SEQ ID NO: 16717 - protein, 918 aa, Pasteurella haemolytica
MKEHTFHYSPIAIAVIFSVSHSQLFANEHQMTNDHSTVLDEVIVTESHYAHERQNEVTGLGKVVKNYHEMSKNQILGIRDLTRYDPGISVVEQGRGASSGYAIRGVDKNRVSLLVDGLPQAQHYHTLGSDANGGAINEIEYENIRSIELSKGASSAEYGSGALGGAIGFRTKDAQDIIKEGQHWGLDSKTSYASKNSHFLQSIAAAGEAGGFEALVIATHRHGKETKIHSEANKLKHNIRRITGFENRYDLYPDSAQNAPGGSFFIVEDTCPTLDCTPRARPKLNRDNFPVRTFPEYTPEERKQLEQIPYRTEQLSAQEYTGKDRIAPNPLDYKSNSVFMKFGYHFNSSHYLGAILEDTKQRYDIRDMQTPAYYTKDDINIRVDNLSLKNSSVYEGDNILDGLVFNKRIPYGLRYSHVKFFDEHHHKRRLGFTYKYKPENNRWLDSIKLSADKQDIELYSRLHRLHCSDYPVVDKNCRPTLDKSWSMYRTERNNYQEKHRVIHLEFDKALNAGQGVFKQTHKLNLGLGFDRFNSLMDHGDITAQYTKGGYTSYRGRGRLDDPYIYRRNPRSIETVSLCNNTHGDIINCEPRKIKGGSHFVSFRDLITSEYVDLGLGVRFDQHRFKSDDPWTLSRTYRNWSWNGGITLKPTEFMSLSYRISNGFRVPAFYELYGKRDHIGLKDNEYVQREQRSHQLEPEKSTNHEIGVSFKGQFGYLDVSYFRNNYKNMIATACKRIIQKSHCFSNYHNIQDVALNGINLVAKFDLHGILSMLPDGFYSSVAYNRVKVKERKLNDSRLDSVNDPILDAIQPARYVLGFGYDHPEEKWGIGITTTYSKAKNADEVVGTRHHGIYRVDLGGKLTGSWYTHDITGYINYKNYTLRGGIYNVTNRKYSTWESVRQSGVNAVNQDRGSNYSRFA

SEQ ID NO: 16718 - protein, 916 aa, Pasteurella haemolytica
MIMKYHHFRYSPVALTVLFALSHSYGAATENKKIEENNDLAVLDEVIVTESHYAHERQNEVTGLGKVVKNYHEMSKNQILGIRDLTRYDPGISVVEQGRGASSGYAIRGVDKNRVSLLVDGLPQAQHYHTLGSDANGGAINEIEYENIRSIELSKGASSAEYGSGALGGAIGFRTKDAQDIIKEGQHWGLDSKTSYASKNSHFLQSIAAAGEAGGFEALVIATHRHGKETKIHSEANKLKHNIRRITGFENRYDLYPNSAQNAPGGSFFIVEDTCPTLDCTPRARVKLNRDNFPVRTFPEYTPEERKQLEQIPYRTEQLSAQEYTGKDRIAPNPLDYKSNSVFMKFGYHFNSSHYLGAILEDTKQRYDIRDMQTPAYYTKDDINLSLRNYVYEGDNILDGLVFKPRIPYGLRYSHVKFFDERHHKRRLGFTYKYKPENNRWLDSIKLSADKQDIELYSRLHRLHCSDYPVVDKNCRPTLDKSWSMYRTERNNYQEKHRVIHLEFDKALNAGQGVFKQTHKLNLGLGFDRFNSLMDHGDMTAQYTKGGYTSYRGSGRLDNPYIYRRDPRSIETVSLCNNTHGDILNCEPRKIKGDSHFVSFRDLVISEYVDLGLGVRFDQHRFKSDDPWTLSRTYRNWSWNGGITLKPTEFVSLSYRISNGFRVPAFYELYGKRDHIGLKDNEYVQRAQRSHQLEPEKSTNHEIGVSFKGQFGYLDVSYFRNNYKNMIATACKRIIQKSHCFYNYHNIQDVALNGINLVAKFDLHGILSMLPDGFYSSVAYNRVKVKERKLTDSRLDSVNDPILDAIQPARYVLGFGYDHPEEKWGIGITTTYSKAKNADEVAGTRHHGIHRVDLGGKLTGSWYTHDITGYINYKNYTLRGGIYNVTNRKYSTWESVRQSGVNAVNQDRGSNYTRFA

SEQ ID NO: 16719 - protein, 916 aa, Pasteurella haemolytica
MIMKYHHFRYSPVALTVLFALSHSYGAATENKKIEENNDLAVLDEVIVTESHYAHERQNEVTGLGKVVKNYHEMSKNQILGIRDLTRYDPGISVVEQGRGASSGYAIRGVDKNRVSLLVDGLPQAQHYHTLGSDANGGAINEIEYENIRSIELSKGASSAEYGSGALGGAIGFRTKDAQDIIKEGQHWGLDSKTSYASKNSHFLQSIAAAGEAGGFEALVIATHRHGKETKIHSEANKLKHNIRRITGFENRYDLYPNSAQNAPGGSFFIVEDTCPTLDCTPRARVKLNRDNFPVRTFPEYTPEERKQLEQIPYRTEQLSAQEYTGKDRIAPNPLDYKSNSVFMKFGYHFNSSHYLGAILEDTKQRYDIRDMQTPAYYTKDDINLSLRNHVYEGDNILDGLVFNTRIPYGLRYSHVKFFDERHHKRRLGFNYQYTPENNRWLDNIKLSADKQDIELYSRLHRLHCSDYPVVDKNCRPTLDKSWSMYRTERNNYQEKHRVIHLEFDKALNAGQGVFKQTHKLNLGLGFDRFNSLMDHGDMTAQYTKGGYTSYRGRGRLDNPYIYRRDPRSIETVSLCNNTHGDILNCEPRKIKGDSHFVSFRDLVISEYVDLGLGVRFDQHRFKSDDPWTLSRTYRNWSWNGGITLKPTEFVSLSYRISNGFRVPAFYELYGKRDHIGLKDNEYVQREQRSHQLEPEKSTNHEIGVSFKGQFGYLDVSYFRNNYKNMIATACKRIIQKSHCFSNYHNIQDVALNGINLVAKFDLHGILSMLPDGFYSSVAYNRVKVKERKLTDSRLDSVNDPILDAIQPARYVLGFGYDHPEEKWGIGITTTYSKAKNADEVAGTRHHGIHRVDLGGKLTGSWYTHDITGYINYKNYTLRGGIYNVTNRKYSTWESVRQSGVNAVNQDRGSNYTRFA

SEQ ID NO: 16720 - protein, 916 aa, Pasteurella haemolytica
MIMKYHHFRYSPVALTVLFALSHSYGAATENKKIEENNDLAVLDEVIVTESHYAHERQNEVTGLGKVVKNYHEMSKNQILGIRDLTRYDPGISVVEQGRGASSGYAIRGVDKNRVSLLVDGLPQAQHYHTLGSDANGGAINEIEYENIRSIELSKGASSAEYGSGALGGAIGFRTKDAQDIIKEGQHWGLDSKTSYASKNSHFLQSIAAAGEAGGFEALVIATHRHGKETKIHSEANKLKHNIRRITGFENRYDLYPNSAQNAPGGSFFIVEDTCPTLDCTPRARVKLNRDNFPVRTFPEYTPEERKQLEQIPYRTEQLSAQEYTGKDRIAPNPLDYKSNSVFMKFGYHFNSSHYLGAILEDTKQRYDIRDMQTPAYYTKDDINLSLRNHVYEGDNILDGLVFNTRIPYGLRYSHVKFFDERHHKRRLGFNYQYTPENNRWLDNIKLSADKQDIELYSRLHRLHCSDYPVVDKNCRPTLDKSWSMYRTERNNYQEKHRVIHLEFDKALNAGQGVFKQTHKLNLGLGFDRFNSLMDHGDMTAQYTKGGYTSYRGRGRLDDPYIYRRNPRSIETVSLCNNTHGDIINCEPRKIKGGSHFVSFRDLITSEYVDLGLGVRFDQHRFKSDDPWTLSRTYRNWSWNGGITLKPTEFVSLSYRISNGFRVPAFYELYGKRDHIGLKDNEYVQRAQRSHQLEPEKSTNHEIGVSFKGQFGYLDVSYFRNNYKNMIATACKRIIQKSHCFYNYHNIQDVALNGINLVAKFDLHGILSMLPDGFYSSVAYNRVKVKERKLNDSRLDSVNDPILDAIQPARYVLGFGYDHPEEKWGIGITTTYSKAKNADEVAGTRHHGIHRVDLGGKLTGSWYTHDITGYINYKNYTLRGGIYNVTNRKYSTWESVRQSGVNAVNQDRGSNYTRFA

SEQ ID NO: 16721 - protein, 930 aa, Pasteurella haemolytica
MIMKYHHFRYSPVALTVLFALSHSYGAATENKKIEENNDLAVLDEVIVTESHYAHERQNEVTGLGKVVKNYHEMSKNQILGIRDLTRYDPGISVVEQGRGASSGYAIRGVDKNRVSLLVDGLPQAQHYHTLGSDANGGAINEIEYENIRSIELSKGASSAEYGSGALGGAIGFRTKDAQDIIKEGQHWGLDSKTSYASKNSHFLQSIAAAGEAGGFEALVIATHRHGKETKIHSEANKLKHNIRRITGFENRYDLYPNSAQNAPGGSFFIVEDTCPTLDCTPRARVKLNRDNFPVRTFPEYTPEERKQLEQIPYRTEQLSAQEYTGKDRIAPNPLDYKSNSVFMKFGYHFNSSHYLGAILEDTKQRYDIRDMQTPAYYTKDDINLSLRNYVYEGDNILDGLVFKPRIPYGLRYSHVKFFDERHHKRRLGFTYKYKPENNRWLDSIKLSADKQDIELYSRLHRLHCSDYPVVDKNCRPTLDKSWSMYRTERNNYQEKHRVIHLEFDKALNAGQGVFKQTHKLNLGLGFDRFNSLMDHGDMTAQYTKGGYTSYRGRGRLDNPYIYRRDPRSIETVSLCNNTRGDILNCEPRKIKGDSHFVSFRDLVISEYVDLGLGVRFDQHRFKSDDPWTLSRTYRNWSWNGGITLKPTEFVSLSYRISNGFRVPAFYELYGKRDHIGLKDNEYVQRAQRSHQLEPEKSTNHEIGVSFKGQFGYLDVSYFRNNYKNMIATACKRIIQKSHCFYNYHNIQDVALNGINLVAKFDLHGILSMLPDGFYSSVAYNRVKVKERKLTDSRLDSVNDPILDAIQPARYVLGFGYDHPEEKWGIGITTTYSKAKNADEVAGTRHHGIHRVDLGGKLTGSWYTHDITGYINYKNYTLRGGIYNVTNRKYSTWESVRQSGVNAVNQDRGSNYTRFAAPGRNFSLAFEMKF

SEQ ID NO: 16722 - protein, 916 aa, Pasteurella haemolytica
MIMKYHHFRYSPVALTVLFALSHSYGAATENKKIEENNDLAVLDEVIVTESHYAHERQNEVTGLGKVVKNYHEMSKNQILGIRDLTRYDPGISVVEQGRGASSGYAIRGVDKNRVSLLVDGLPQAQHYHTLGSDANGGAINEIEYENIRSIELSKGASSAEYGSGALGGAIGFRTKDAQDIIKEGQHWGLDSKTSYASKNSHFLQSIAAAGEAGGFEALVIATHRHGKETKIHSEANKLKHNIRRITGFENRYDLYPNSAQNAPGGSFFIVEDTCPTLDCTPRARVKLNRDNFPVRTFPEYTPEERKQLEQIPYRTEQLSAQEYTGKDRIAPNPLDYKSNSVFMKFGYHFNSSHYLGAILEDTKQRYDIRDMQTPAYYTKDDINLSLRNYVYEGDNILDGLVFKPRIPYGLRYSHVKFFDERHHKRRLGFNYQYTPENNRWLDNIKLSADKQDIELYSRLHRLHCSDYPVVDKNCRPTLDKSWSMYRTERNNYQEKHRVIHLEFDKALNAGQGVFKQTHKLNLGLGFDRFNSLMDHGDMTAQYTKGGYTSYRGRGRLDNPYIYRRDPRSIETVSLCNNTHGDILNCEPRKIKGDSHFVSFRDLVISEYVDLGLGVRFDQHRFKSDDPWTLSRTYRNWSWNGGITLKPTEFVSLSYRISNGFRVPAFYELYGKRDHIGLKDNEYVQRAQRSHQLEPEKSTNHEIGVSFKGQFGYLDVSYFRNNYKNMIATACKRIIQKSHCFYNYHNIQDVALNGINLVAKFDLHGILSMLPDGFYSSVAYNRVKVKERKLTDSRLDSVNDPILDAIQPARYVLGFGYDHPEEKWGIGITTTYSKAKNADEVAGTRHHGIHRVDLGGKLTGSWYTHDITGYINYKNYTLRGGIYNVTNRKYSTWESVRQSGVNAVNQDRGSNYTRFA

SEQ ID NO: 16723 - protein, 916 aa, Pasteurella haemolytica
MIMKYHHFRYSPVALTVLFALSHSYGAATENKKIEENNDLAVLDEVIVTESHYAHERQNEVTGLGKVVKNYHEMSKNQILGIRDLTRYDPGISVVEQGRGASSGYAIRGVDKNRVSLLVDGLPQAQHYHTLGSDANGGAINEIEYENIRSIELSKGASSAEYGSGALGGAIGFRTKDAQDIIKEGQHWGLDSKTSYASKNSHFLQSIAAAGEAGGFEALVIATHRHGKETKIHSEANKLKHNIRRITGFENRYDLYPNSAQNAPGGSFFIVEDTCPTLDCTPRARVKLNRDNFPVRTFPEYTPEERKQLEQIPYRTEQLSAQEYTGKDRIAPNPLDYKSNSVFMKFGYHFNSSHYLGAILEDTKQRYDIRDMQTPAYYTKDDINLSLRNYVYEGDNILDGLVFKPRIPYGLRYSHVKFFDERHHKRRLGFNYQYTPENNRWLDNIKLSADKQDIELYSRLHRLHCSDYPVVDKNCRPTLDKSWSMYRTERNNYQEKHRVIHLEFDKALNAGQGVFKQTHKLNLGLGFDRFNSLMDHGDMTAQYTKGGYTSYRGRGRLDNPYIYRRDPRSIETVSLCNNTHGDILNCEPRKIKGDSHFVSFRDLVISEYVDLGLGVRFDQHRFKSDDPWTLSRTYRNWSWNGGITLKPTEFVSLSYRISNGFRVPAFYELYGKRDHIGLKDNEYVQRAQRSHQLEPEKSTNHEIGVSFKGQFGYLDVSYFRNNYKNMIATACKRIIQKSHCFYNYHNIQDVALNGINLVAKFDLHGILSMLPDGFYSSVAYNRVKVKERKLTDSRLDSVNDPILDAIQPARYVLGFGYDHPEEKWGIGITTTYSKAKNADEVAGTRHHGIHRVDLGGKLTGSWYTHDITGYINYKNYTLRGGIYNVTNRKYSTWESVRQSGVNAVNQDRGSNHTRFA

SEQ ID NO: 16724 - protein, 916 aa, Pasteurella haemolytica
MIMKYHHFRYSPVALTVLFALSHSYGAATENKKIEENNDLAVLDEVIVTESHYAHERQNEVTGLGKVVKNYHEMSKNQILGIRDLTRYDPGISVVEQGRGASSGYAIRGVDKNRVSLLVDGLPQAQHYHTLGSDANGGAINEIEYENIRSIELSKGASSAEYGSGALGGAIGFRTKDAQDIIKEGQHWGLDSKTSYASKNSHFLQSIAAAGEAGGFEALVIATHRHGKETKIHSEANKLKHNIRRITGFENRYDLYPNSAQNAPGGSFFIVEDTCPTLDCTPRARVKLNRDNFPVRTFPEYTPEERKQLEQIPYRTEQLSAQEYTGKDRIAPNPLDYKSNSVFMKFGYHFNSSHYLGAILEDTKQRYDIRDMQTPAYYTKDDINLSLRNYVYEGDNILDGLVFKPRIPYGLRYSHVKFFDERHHKRRLGFTYKYKPENNRWLDSIKLSADKQDIELYSRLHRLHCSDYPVVDKNCRPTLDKSWSMYRTERNNYQEKHRVIHLEFDKALNAGQGVFKQTHKLNLGLGFDRFNSLMDHGDMTAQYTKGGYTSYRGRGRLDNPYIYRRDPRSIETVSLCNNTHGDILNCEPRKIKGDSHFVSFRDLVISEYVDLGLGVRFDQHRFKSDDPWTLSRTYRNWSWNGGITLKPTEFVSLSYRISNGFRVPAFYELYGKRDHIGLKDNEYVQRAQRSHQLEPEKSTNHEIGVSFKGQFGYLDVSYFRNNYKNMIATACKRIIQKSHCFYNYHNIQDVALNGINLVAKFDLHGILSMLPDGFYSSVAYNRVKVKERKLTDSRLDSVNDPILDAIQPARYVLGFGYDHPEEKWGIGITTTYSKAKNADEVAGTRHHGIHRVDLGGKLTGSWYTHDITGYINYKNYTLRGGIYNVTNRKYSTWESVRQSGVNAVNQDRGSNYTRFA

SEQ ID NO: 16725 - protein, 282 aa, Anaplasma marginale
MNYRELFTGGLSAASVCARTLLVSGAVVASPMSHEVASEGGVMGGSFYVGAAYSPAFPSVTSFDMRESSKETSYVRGYDKSIATIDVSVPANFSKSGYTFAFSKNLITSFDGAVGYSLGGARVELEASYRRFAPLADGQDAKSGAESLAAITRDANITETNYFVVKIDEITNTSVMLNGCYDVLHTDLPVSPYVCAGIGASFVDISKQVTTKLAYRGKVGISYQFTPEISLVAGGFYHGLFDESYKDIPAHNSVKFSGEAKASVKAHIADYGFNLGARFLFS

SEQ ID NO: 16726 - protein, 282 aa, Anaplasma phagocytophilum
MNYRELLVGSLSAAAVCACSLLISGSSFAYSGNNDASDVSGVMNGSFYVSGSYSPSFPSISSFDISESDRGGSYVKGYNKNLSTLNVSDPASFTQHDPSFKFAKSLLTSFDGATGYAIGGARVEVEVGYKKFETLAESDYKHVESHNFVAVGRDAILTPDNFFVMKIDSVKDISVMLNACYDVMHTDLPVSPYMCAGLGASFINIADHVTSKLAYRGKVGVSYKLTPEISLIAGGFYHGIFDEQYAGIPASNRVNIAGGAAAKVKANIASYGFNIGARFAFN

SEQ ID NO: 16727 - protein, 699 aa, Magnetospirillum magneticum
MRARPSSVLWMALGCGMAGPMSALAGGLQQPEVQLETTTVVGSAAAAAATSEAASQGYVPRAQLENRPLLRPGELLETVPGLIVTQHSGDGKANQYFLRGFNLDHGTDLATTVAGMPVNMRTHAHGQGYTDLNFVIPELVSGIAYKKGTYFAEEGDFSAAGAVRIDYADKLPHGLAQFELGEYGYRRGLLANSNTVGPGTLLYGFEWLGENGPWVVPEGVHKLNGVLRYTLPLGGGERITITGMAYKNAWQSTDQVPQRAIDEGLISRFGAIDPTDGGMASRYSLSADWLRPLADGQFKANAYVIKSRLTLFSNFTYALANPELGDQFEQFENRVTTGFNASRTWFGEIAGHDSETEVGSQTRHDRLDPILLADTVARQPYAVVRSDTVNETSTALYLRNSIQWRPWLRTLAGLRADQFWYSVGSSNPLNSGSGAEHIVSPKLGMVLSPTAGTDVFVNWGRGYHSNDVRGATTTVDPVSGNPVQKVSVLVPATGYEIGVRTKELARGLQLSASLWRLDIGSELVFAGDTGTTQPSRPSRRTGVELAAYYKPSPELILDADAAFSRARFRDADPVGDYIPEAIQTTASAGVSWTHGRWTLGARLRYFGPRPLIEDNSVRSASSFLVNLKVGYRVQKNVRVFIEVLNALNRKANDIDYYYASLLKGETSPVDANGVATGINDRHIHPAEPRTVRAGIAWAF

SEQ ID NO: 16728 - protein, 1094 aa, Magnetospirillum magneticum
MYFKPSYLNLKSFIFLVLALLTIESGFSKTISLKKSKIENKIEKATLVSIFSKLSQQTDYKFSYGQAVIADNTTYTVNFTGESVTSILSDLSKKANFNYNINGKLVLIQKTAAQKTVNTKAADKIRVKGKIVDENKVPIPGATVIETGTSNSTVTDFDGVFELSVGDGKTIEVSYVGYKTKSLPAQASFMTIQLEPSTAELNEVLVVGYGKQSKKDVTGAVTQLEAANFKQGVNVSVDNLIQGKVAGVRVVNTSGEPGAGVNVTIRGVGSIRSGSTPLFVVDGMPLTNDDVSPSGTNVGFGSSTAKNPLNFLNTSDIESITVLKDASATAIYGARGSNGVVLVTTKKGSKGEGTLTVDSYMGVSTVAHKLDVLNAGEYRNAIKDPAFDHGGNTDWQDVIFRSAITTNNSLSFAKQTESGNYYASMAQMDQEGIIRNSNFKRISGRINAAESFLDNKRLKLKMNLTASQTTDDGVPTSDDGGSNGQLIVHTLMANPTRSVFDANGNYTNFNMNAHYNPAYLLSIYEDQTRTLRVLGNLETSFRIVDGLEYKLNLGIDRSTSERNTTIYPNLTDLNPKGKYVQNNLDSKNSLIEHYLTYSKALDKHKFEVLGGFSYQKFERSGTSFSIDGISTQGVGVKPSINPGFAGTQSGTTGYAQENELQSYFGRLNYSFDNKYLLTASMRADGSTRFGDNNKYGYFPSFALGWNISNENFLKDSQTINNLKLRASWGQTGNQEVPNKQTKASYSLAGPDGYYLYNDLNLVNGVSVSRTANPDLKWEVVTQYNLGLDFNLWNDKFYGTVDYFNKTTTDAILYIPSTPLSQTKFIWTNIDGKIVNKGIEIMLGSKIIDKKDFSWNVDVNGSTLNNKIENLPLSEILTGAISGPGQSGVNANIYKSGYAAGSFYLLEHTGFDQNGANVFKDQNGDGKIDNSDRIIIEGALPTFYYGFNSDMRYKNFTFSFSIIGQTGGYLLNNTGLNALNINNLASDRNVATGYYESGANPANSPILSTLFLEKSDFIRLNAARIGYNFDLKGLNWINGLTLYVTGNNLITITNYTGFDPLVNTPKATDGNQSIGIDYAAYPTSRTFSFGATLKL

SEQ ID NO: 16729 - protein, 733 aa, Magnetospirillum magneticum
MGGNGFVPAVMAAAVFAALGNANAAHAQNAPALEEVVVTAQQREASLQDVPISVSAFSDTDIQKNMFRDVTDFVARTPNASFITSGARSRREISMRGVTNFVGANNARRTSSFGFYVDGFNLSSSSINPPIMDIERIEVLRGPQSTYFGANALGGGISVTTNAPNTDEVSGYVMADYGRFDSMDIEGVLNVPIVKDKLAARVNYKNYSTDGNIENINPQGGGNDADYEYVRATVLWTPTENLSVTLNYSDASEDVGMREGVPSGVLSSFGNVLYGDTADPDGVGFFPQNDSKVNFNAPQTVGTEFEYAIARVDYDFADMRFTSISGYMESDFFLRGDIDGGSIDYFQEFRTIPRESITQEFRLQSMDDSRLQWNVGLYYSDDEGFIDNKTFVGGAEIFGIPEGFLIDSEETFGSSEVYAVFGQVNYALSDSLTLTVGGRYSEEEIFADISGFGGGAVQEQTSEETFTDFSPMASIRYDLGDDASVYATVAKGFKSGGAQVTGDPEVNSYDPEELWNYEIGYKAEYLNRTLRVNAAAFYMDWTDQQTSQQFSGVDENGDFFIFGAVGNADSAESYGVELSITSAPTAGLVMNLNVGWLQAEYEDFTTVIDGAPRVLDGLTVPNSPEWTVSADAEYSFQLTGDLDAFVRGEYIYRDEIRSSIDSLIREGFPWEVPAYDIFNLRAGVEHENYTVAFYVENLFDDTYFTNSYQKAFMGGLHIEPGVQRYGLRARYNF

SEQ ID NO: 16730 - protein, 686 aa, Magnetospirillum magneticum
MSVSLSFSRSPLALSITLALASAAHAQGLVAPQPLSQDDSALTLGTISITSKASGPLSTRSVFSSVDIVGADILENEHVDYSWELLSKAPGVQVTQFKQGTDAGRFSFRGFNGEGRINAVKLLIDGIPSNDNAGGMPFLDAVFPLDIEAIEIVRGTNDARYGLNNIAGNVNVITRTGGNEGRASVTVGSFGTKEFQVSKGIESGNWSQNYFLAWRDSDGYRDHADARKLSLSGKWFYTSDDGRWRTGVIARYYRNKALESGYLSYEEAIKAPRSSPAYAAADRGERETGQLSAHLDGELTPELSLSAKVYANQYENQRWVRFSAAGSQQERYNDEQQQGAITTLTWRPKVAWAHEFTLEGGLDAQRQSNLGQRYRTTERVRTSQFRDWDFDLNTQGAYVQAVIRPIEALRIIPALRIDDVDGHFIDRLAGTRAPVHDYGLIKQPKISIAYTLSQQASVYANWGRTFQIGSGIDAYRTQDRNLRPSINDGWEAGVKFSPLPWLNGRVAYWEQRASGEVARVLGVDGLPDPGGLGNVGKTLRKGYDIQLNMKPHARTTAWIAYSHQVARITAPDPSAPATLGKEIENVPHYLVSAGVDWQATDRLKLSAWGNAQGDYYLERTNTQGRAGKFAVLNLGASYRLSETMDLGLQVKNVTNRKYVYAWYDSGSSGYSPADGRGVYASMNLRF

SEQ ID NO: 16731 - protein, 463 aa, Magnetospirillum magneticum
MKKIALSLVALVATSAFASTITLYQDKDTGAIYTKPGPNRVALGEFISKDELKKEALGEIKKELPYKNTLQTHFHVIKKNSPEFLLGKETGPNMLVRPFDNPDMYMKFGVRVMGTFENYKEENKATGVTEEDFWDAYLRRVRFEVTAGFGKHTSFTMDIRNDKANYRDSGEKEFNVGDAYLKIKKPFGTSLANFKLYRGKIDVSRTETVKSAYVIHYDRPHVADEAAQYISHNRRATNIQMYGNWKHKIAYQIAMGDGVYSGKLKDARGKKFSSSTASGFHQDEFFYGGKIVLSPFDGWEEKKRTETYFAQGKHFSIGAAYWKSPDINFVDGSGKAVKLDHTLINYELSAHYKGAFVQAEYFKFDGVVSDWNNAQVGTSNGWYVTGEYVIPSLYYIAPFARYEKWDKLEDANGYDMRSKIAGINWYLRGNSTKVGIAYQEDDYDVNVGDKKVKRLKFTTQWFF

SEQ ID NO: 16732 - protein, 813 aa, Magnetospirillum magneticum
MPANPRPAPPGQAPRDTVACRRRTSRGAATAIAMAVALMTQRPAVAQHDTAVPNQDSAMLPEVLVVAAAPLPGIGVDSDLVPYTVQTVRGDDLDRSRAGNLAEYLSRNLAGVNVNDIQGSPFQTDITYRGFRASSIPGVPQGLSVYLDGIRVNEPFGDVVSWDMIPEAALASVSLVSSANPAYGLNTLGGALAMTTRSGLDSPGFEADLSYGSGARKRADLSGGVRSDSGWHAFAAGTLFQEHGWRDQSGGRLGNVFAKAGYAGDTDSLDVSVLHGRSTLTGNGLVPSFHASANGTLPDLYQANRHAVYTYPDQTRNQVTQVVVNGRHWFDDKTSAAALAYVRTSRRDTTNGDVNPAYEAYAEDCEDGFAPDGSPLGADCGMTRAEGAALHPAVINTTHMWQQTVGMALSMARETDRHLLNAGLTLDRSRLTYSQYAQPGTFTDDRGAVADPDAPNALFSGVGGSSRMLGLYLSDTWSLTPSTFLTASARWNHVEVSNTLRNSDGSGQPRESFTYRRLNPALGLSQKLGGGVTVFGGYAQNNRVPTVLELGCADPTRPCRLPAGLQADPYLKQVVSHSYEAGVRWHRGKDTEVTASLYRVDNHDDILFLRAPNTQLGYFANFDRTRNQGLDLTARQRVGDVTLRLAYSYLQATYQAAGQLAAGERTIDIRPGMRMAGLPRHTLKLGLDWQALAGLTLGADLVAVSGTVSSGNEDGLRSDPQPGAPPKTADWHVPGYATLNLRAAYKVNKRFEIYARLANVFDRRYETYGQIANDVFPGGSLVRPHVAPGDAASALFVAPGAPRSFWLGAVFRM

SEQ ID NO: 16733 - protein, 75 aa, Magnetospirillum magneticum
MLVAAGQFAVTSVWEKNAEICASLMAQAAENDASLFALPEALLARDDHDADLSVKSAQLLEGEFLGLYGEKVNVT

SEQ ID NO: 16734 - protein, 448 aa, Magnetospirillum magneticum
MLRRFVNTARVCSVGIAFSSLLGGAVHAADFSTKAAPVPYAADDFWTRPYLFGDLGRTKLKEQGIELGLTLGNESVGNVTGGSRNTAANAGQLWFGAKLDMGKLAGIPGGTVGLTLVDRFGKNLNTEADIPALQLTNEVFGRGNILRLTQLYYSQKLFDDRLELKGGRLPVGSDFFFGLCEFINLTFCGGQPGNIQGGYIYNWPVSQWAGVVHYKLAPEFTISVGVYDANPNYLTTSDPAIYFLPGIPASSRASGVMVPVELVWAPSGPLNGTWRLGGWYDSASTIDGGLPGVISTIPGIGGVPDQNLGDQRGRYGVYESILQRLTVDGPGAQGWYTFLNTTVADHRTSYQDYQIALGFRHTGTFSWRPQDEVGFAVGTTHVNSAALSPNAGGNEVPIEVWYGWQATGWLNLKFDAQYVINPGGRGYNAVGVKTDNAVVLGMRTEVHF

SEQ ID NO: 16735 - protein, 1078 aa, Magnetospirillum magneticum
MTCFARTNFAVPNSKPRRWLALSFLLAGTFLSTQALAIDVANQADWNTAVAAVAAAGANSTVTINITSGFTLSSSLAQLQAANSNVTVNITGNGQTINGASSFQGIVVNGANAPTVNISSLSITNTAAIGGNGQNGQNGYYSGGLAYGSGGGGGGGLGAGGGLLVGSGANVTIAAVTFTSNSATGGHGGNGGSAQNAAADPVNGGNGGAGGAANNGGASGGGGAGGTGGHAGGQGTAGTAGASLGDGGGGGGGSGTTNSTTYTNNNPGGSGNANGGNGGSGGDGATNASGAGGPGPGSDGGAGGNGGAANGGAIYVATGGTLTILDSPISGNTVAGGAAGTPGIGIGPSAINGFSAAAGAAQGAGIFLSGVTANIGVSGGSVTYGDSIGGTGLTTGGVNTAINKTGAGTLVLSATNTFTGNVNISAGTVSIGATANLGNVANDVIISNGGTLAVTGTTTLANGRDFKIAGLSTIDVTSATTTTLQGIVSNGASAGTLVKAGGGILLLSGTNTYTGETNVIGGTLRAGTANAFGASTVFSVLSGGTLDLNGFNKTFGTLSGDGAVTGANVTIAGTFTPGNGNPASSMAITGNLAFQSGAVYLVQLNPTTASLAQITGTANLTGAAVTANYANGTYISKKYTILTATGGVSGTFSGVTNTNLPAGFSSTLSYDSNNAFIDLTMNTASGSINQQNVSNALTNYFNRNGSIPVVFTGLTPTGLTQISGETSTGSQQTTFTAMTQFMGIMTDPFLGGRGDQGSAPAGAIGYAEEALAYATKRNPNDALAAIYTKAPAAPVARPNWSVWAAGFGGSQSTDGNTALGSNNTTSNIYGTAVGADYRFSPFTIAGFSLAGGGTTFNVANGGSGRSDLFQAGAFVRHMIGAGYVSGALAYGWQNVTTNRTVTVAGVDQLRANFDANTFAGRLEGGYRFISPWMGFGITPYAAAQFTTFNLPGYAESAVAGANTFALRFGSQSLTDTRSELGVRTDKAYALTDGVFTLRSRFAWAYDFNPSRSVGATFQTLPGASFVVNGARLAQNSALTTVAAEMKWRNGWSAAASFEGEFSDVTRSYAGKGVVRYAW

SEQ ID NO: 16736 - protein, 247 aa, Vibrio anguillarum
MNKVIAVSALAMAGMFSTQALADESKTGFYVTGKAGASVMSLADQRFLSGNGEETSKYKGGDGHDTVFSGGIAAGYDFYPQFSIPVRTELEFYARGKADSKYNVDKDSWSGGYWRDDLKNEVSVNTLMLNAYYDFRNDSAFTPWVSAGIGYAKEIHQKTTGISTWDYGYGSSGRESLSRSGSADNFAWSLGAGVRYDVTPDIALDLSYRYLDAGDSSVSYKDEWGDKYKSEVDVKSHDIMLGVTYNF

SEQ ID NO: 16737 - protein, 214 aa, Photobacterium damselae
MKKTICSLAVVAALVSPSVFAHKQGDFVLRVGAASVVPNDSSDKILGSQEELKVDSNTQLGLTFGYMFTDNISLELLAATPFSHDISTDLLGLGDIADTKHLPPTLMVQYYFGEPQSKFRPYVGAGLNYTMFFDEGFNSTGKGAGLSDLKLDDSFGLAANIGVDYMINDQWFLNAAAWYANIETEATYKAGGAKQKTDVKINPWVFMISGGYKF

SEQ ID NO: 16738 - protein, 288 aa, Pseudomonas chlororaphis
MVVTWNYRGALARLGPRRGHTADREPEEHRQPGEIAMKKFLLGTVGLIALGAAPAMAADLAARPYTKAPPIIAAAYDWSGFYVGANGGWGTSRNCWDYLGTTATPAVALGEGCHDASGGTAGGQVGYNWQISTWVFGVEAQGNWADFKGSNANLLVIPAPTTNQTKIDAFGLFTARVGYAWNNALIYVKGGAAVTSDKYTRFRTATGVFNDDASETRWGATVGTGLEYGFTPSWSFAVEYDHLFLGGRDLTFSPVLPNVSNVSHIKQDVDVVTARINYRWGGPIVARY

SEQ ID NO: 16739 - protein, 467 aa, Pseudomonas chlororaphis
MDVNVDQFDTEAFRTDKLELTSGNIADHNGNVVSGVFDIHSSDYVLNADLVNDRTWDTSKSNYGYGIVAMNSDGHLTINGNGDVDNGTELDNSSVDNVVAATGNYKVRIDNATGAGAIADYKDKEIIYVNDVNSNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYGSVSGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 16740 - protein, 180 aa, Moraxella catarrhalis
MKTLKTLLAVSAFSLLAMSANAAISYGNSADAQPYVGAKIGQVDAKQINGKNTAYGIYAGYNFDQNFGVEAEFVGSDAKEFNAGMSPVKGDVKSFGAYGTYRYNFINTPFYAKGKLGIAKTKVDVTSRNATTYSNKSDKTSLAGGVGVGFKPLANVGVEASYNYLSEDANAISLGAHLAF

SEQ ID NO: 16741 - protein, 191 aa, Moraxella catarrhalis
MKTLKTLLAVSASSLLAMSANAAISYGNSADAQPYVGAKIGQVDAKQINGKNTAYGIYAGYNFDQNFGAEAEFVGSDAKEFDVTVPAVGTTPAVVLPVKGDVKSFGAYGTYRYNFINTPFYAKGKLGIAKTKVDVTGRNATASYSNKSDETNLAGGVGVGFKPLANVGVEASYNYLSEDANAISLGAHLAF

SEQ ID NO: 16742 - protein, 180 aa, Moraxella catarrhalis
MKTLKTLLAVSASSLLAMSANAAISYGNSADAQPYVGAKIGQVDAKQINGKNTAYGIYAGYNFDQNFGVEAEFVGSDAKEFNAGVSPVKGDVKSFGAYGTYRYNFINTPFYAKGKLGIAKTKVDVTSRNATTYSNKSDKTSLAGGVGVGFKPLANVGVEASYNYLSEDANAISLGAHLAF

SEQ ID NO: 16743 - protein, 191 aa, Moraxella catarrhalis
MKTLKTLLAVSASSLLAMSANAAISYGNSADAQPYVGAKIGQVDAKQINGKNTAYGIYAGYNFDQNFGAEVEFVGSDAKEFDVTVPAVGTTPAVVLPVKGDVKSFGAYGTYRYNFINTPFYAKGKLGIAKTKVDVTGRNATASYSNKSDETNLAGGVGVGFKPLANVGVEASYNYLSEDANAISLGAHLAF

SEQ ID NO: 16744 - protein, 180 aa, Moraxella catarrhalis
MKTLKTLLAVSASSLLAMSANAAISYGNSADAQPYVGAKIGQVDAKQINGKNTAYGIYAGYNFDQNFGVEAEFVGSDAKEFNTGVSPVKGDVKSFGAYGTYRYNFINTPFYAKGKLGIAKTKVDVTSRNATTYSNKSDKTSLAGGVGVGFKPLANVGVEASYNYLSEDANAISLGAHLAF

SEQ ID NO: 16745 - protein, 192 aa, Moraxella catarrhalis
MKTLKTLLAVSASSLLAMSANAAISYGNSADAQPYVGVKIGQVDAKQINGKNTAYGIYAGYNFDQNFGAEAEFVGSDAKEFDVTVPAVVGVSPAVVLPVKGDVKSFGAYGTYRYNFINTPFYAKGKLGIAKTKVDVTGRKATASYSNKSDETSLAGGVGVGFKPLANVGVEASYNYLSEDANAISLGAHLAF

SEQ ID NO: 16746 - protein, 354 aa, Moraxella catarrhalis
MKTLKSLLAVAVSLCCINAYADDSATTAELEARIAKLENNAAPSQFKNSQVSLYGSLRPSLSYLDDNQDKTWDVRDALSRIGIKASTEFADGWSAIAQGEWSVDIANSGNFGKARQAYAAIASPYGQVGIGKQRPAQYTLVAEYVDIFNNANSPFGYDHESPFFVDNFVTYQLVTGDFTWMAGAQFNGDSGEDATDMVNVGVGYDLNQLHIGLGYVSQNTVDNQHIEGDDNTLGGVVAYTFSNDLYLAVSYQDKQYNYDAGSMNKDRSGSTLDTALAYPIFDDYKVKLGYFQFKDGIDDNTSADYDGFNTTLEWNPVDNVRVHLEYLDKNFDNRDDDRSITIGFRYDFNLTWQG

SEQ ID NO: 16747 - protein, 740 aa, Nitrosospira multiformis
MKLRKLSQLSLAIVAALTTSVNAEETKTTAKQDAFEKIEVTARKRTESLFESPTAITSIGANLIDKANMSNLEDIGKYVPNLNITRYGVGNAAHASVFIRGIGLQDHIITTDPGVGVYLDGVYLGRQMGSNLSLPNVERVEVLRGPQGTLYGRNTLGGAVNVITKQPGDEGILTTSAKLGSRGRIAGDVYFNNSLNDELSMSASASYKTRDGVGEAVNLTNPEKEIGEEEEFSGRVALKWQANSDLAFTFSLDGVDNESGQSPYTIELTEPLDANDVFNGDFPLLTQDMIPSDPDDLGTTVAGIESTSYSGWGTSFTADWAIDDTYTAKFISSYRTSEYEGGLDDDASPLNLSEFPEEGGADQYSFEIQLNATYDNMDFVSGLYFFNEDGFTRSGPFVFSPFNTPNGLLNDGVTPSFGGYGDFEINQETNSYAVYFNTSYDLTDDLSIGGGLRYSKDEKDADAIFPTFAERKYVSAEFDAVTWDINASYQISNNMNVYGQIQKGYQTGGFPPRPFGGPDQFVSFDETKAVNYEMGLKGQVHENVSMMLAVFVTDYTDLALPFSDPTAGGGFVTIVENAGQSKAQGIELETTVAITDDFTIRSAVGYLDSEITEVDAGVQGIGKGDSPALTPRWTVMVAPSYFMDLDSGATVALNANYSYRSEMQGQSVYSQSETIDSRELVGFNISYTNAYGDMEVTLYGENVLNEVYDVGRLQQSGFVGVMRSNDRSEFGLKFKKDFEL

SEQ ID NO: 16748 - protein, 357 aa, Nitrosospira multiformis
MKKKLFALCGLGVASATASAQGSLTLYGVADIYLETLTHQNAATPGGSGSLVRMGSGGKSGSRWGIKGSEALGGGWQAVFRLESGINLNSGTNSGGFDRSAWVGLQNDRWGTLRLGRQYTTLFDVMEHYSPTIAYSTIYEPAGAIVGLNFRENNMAKYRVTFGPVAIQAHYSFGGTPGSFRSGAASGIGFEYTGAALSVAAAYDNVNGTQPADITHFRRYAASAIYTVGAAQLIAGFAHANGSVTTPGVVTRFNFYWLGTRYQVSPVLQVIGAFYYEDIGKQNPAAGQSAPDPDNPKQITVQFNYALSKATTLYLTSGYAWRAALDFDNYNYRILNYSLASNRSSSLGIAIGMRKLF

SEQ ID NO: 16749 - protein, 699 aa, Nitrosospira multiformis
MSCSQLRPRLLGQTGLCALLVLTLPPANARADDPVTAPLVITSEFLKDLASPQVTRIDADDPARSPVQETGEMLRSVPGVAVGRAGGHGFEPVIRGQQQGAIAVIADDTMTLGGCPGRMDPPTSFARPGSYDTLTVTRGYRTVTNGPGASGGTIRLDKELPAWDQPVSGRAFTTVDSNGLGVTSGAEASAALNGAFVRAEGGISRADGYEDGSGNEVRSGFTQVGGSLTGGYQSKDGSFLESAISLDKVLDAEFNGMMDSPEATTVGGRMRAGVEVDGEILRKISLSAYGNRVDHVMDTYSLRSNVTSFSETITDSTTVGGKAMADLALWGSATQIGFDVLSNNRTAIGYMGGSSTTVNRLRSYMWPDVTISDIGLFAESTLPVDATTRVVAGGRLDVVYASAGLADRVPAVSSMGMARSANDLYRAYYGEDFDDSVEVNLGGVLRLEHDIGGGITLNSGLSRAVRTADTTERSIASGSGSMGWVGNPGLDPEKHHQIDVGAAWKGQDGTAFISAYGDMVEDYILDTRARGKDGVLRADGARVYTNTTAVIGGIEAGGDIRVLKDWIIDTSLAVTVGQDLDHDRPLAQIPPVAMGLGLTYDGGGWTVGGRLRGALAQGRADTSTLTGSGRDVDDTPGWATVDLHATLTSFQPFEIGVGVTNLLDATYAEHLNKANTFDPMAVQVNEPGRSFYLTVSAAF

SEQ ID NO: 16750 - protein, 833 aa, Nitrosospira multiformis
MKQLNIISFIIAFLFLGTSASAQQSGGSVTGTVVDKSSKEPIAYVQVFVKGTTLGTSTDANGNYSIKGIPSGNQTIVARLMGYSTCEEKVHIEKGGSRHVDLYLTEEILSLDGVVVSANRNETFRRQAPSLVTVLSPELFLKTNSTNLSQGLKFQPGLRVEDNCQNCGFNQVRINGLEGAYSQILIDSHPIFSSLAGVYGLEQMPANMIERVEVIRGGGSALFGSNAVGGVINVITKEPLRNSAEISHSTMTFDHAKGWGSFQNTTQFNGSMLTEDRKAGVMVFGQHNYRPGQDIDGDSFTELPNLRNRSLGFRSYYKTGLYSKATLEYHSMQEYRRGGDRLDNPPFEAQIAEYLQHYINGGSFKFDQGFSGGKDFFSLYASAQDVQRRSYYGGGDYTENLLNGAVQSGSTESDEYNDAFTALTSYGTTKGFDLQGGGMYRHTFGENWDFTGGLEYIYGQLDDRSGYRPSKIDQNTSTFSQYDQLEYKTEKLSALIGARIDYVLLNQDGKRYIDPLFIFSPRANVRYNPNKNLSFRLSYSEGFRAPQYFDEDLHVELAGGTPISRVLSPNLKEERSRSISASFDYYHRADEWQFNIMGEAFSTFISNQFKPSDKVETTSDGKEWIIRTIYNDKDGVSKVYGVNLEGRIAYNKSFDLQLGGTWQRSRYGSIYTAVEADKTTGQAEISVKDYVRTPNLYGYFVATVRPTEHFAINLSGTFTGKMDVVHEAYEGDIPAEHIAPDGSFDFEMNGQQFKGLAEGHAKLVKTPAFADIDLKLSHDFHLASTMTLELNAGIQNIFNSYQKDTDKGPGRASTYVYGPMQPRRIFVGTKINF

SEQ ID NO: 16751 - protein, 319 aa, Nitrosospira multiformis
MINNTHVKRSALTLLCSITALPNMVLAAEYSVYGKAEVQIAKTDTGVMRYADEGTQIEAPFSRIGIKGQHTLNEYVSAVFKYEVQVKGFEHDDTNEPFAARNTYLGLKGAFGEIVVGRNDTRFKYSEGKLDNFNETQADIAQVIAGQDRLGDTITYTSNYWHNAQFSFTYAPKDENKDNQAGFAATLIYGDRNLNNTPYYISLSHVDSLNNIKASRIAGVYKFEQLQLGALYQHSESIDGTKSGNGYVLSASYTLDKWVPKLQFAKDDSALRQESKATQWSTGLDYVFDKQTTAYLLYTDLDLEENADSSLALGLRYKF

SEQ ID NO: 16752 - protein, 1007 aa, Nitrosospira multiformis
MKAYTIKRAALCVALGACLGAMLPSIALAQNVSGAVAGRATAGDQVTVVSSSTGLTRTVTVGADGSYRLGQLPVGDYQLQLSREGQALGDQVAVSVAVGGTTTVNLASGGGVTNLDALQVRGTRVINRVDVYSTETSFNINRQEISRLPVAQDLSAVALMAPGVVGGNSSFGGLSFAGSSVAENAVFINGLNVTDMYTRRGFSTAPFAFFNEFQVKTGGYSVEFGRSTGGVINAVTRSGSNVFEGGVEVTAEPSAWRSSGGDHFHRDGTPHSYGSRDNNSFLKTNVWGSGPIIKDKLFLFAMYEDRSDKGHNTSSDGSTWFKNDSGNGFWGTKLDWNINDNHSLALLAFSDEGDVTNASYGYNWNNDRLGAWGGDSITETGGRNWSATYTGHFGQNFTARAMVGQNKQRAFTNSSLDQACSPVFTDSTYGPRLGKLQGLRAGCHPTGTAVAERDDTRDVARLDFEWQLGDHLLRFGVDRELMTTDQSTRYPGPTALSYTAYVARPGDEVWDGANAYVPAGVTEMLRARNRQSGGKFETEANAFYLEDIWNITPNLMLNLGVRWDRFENRTAAGKAFIKMDDLIAPRVGFSWDMRGDGSTKLFGNAGRYYLPVTNNINVNFAGGLTDEYSYYVLNGWEQKTSPTGSPYMAPIVGQQIGPTDTRMNTGGADLRQSVDRDLKAVYQDEYILGFQNMINQAWSWGVNATYRRMTRALDDIRINYTPCGPTPSTLWPIANPGESLTIWGDKSIGCANEGWITIDTANSGYRKGGSGEVIGYSKPKRTYKALEFQIDRAWDEKWMLNASYLWSKSEGNFEGPVNSDTNYGDTGMVQFWDHPATNERYGVLFNDFRHQFKLRAAYALNKQWSFGTTLQVQSGGPITAYGVMWPNDSIAGGSTSSEGSGGGTGWLCVANCSGPYDKRQFEYSPRGAFGRLPWTWTMGANVTWRLPVEGIDLSARLSVYNLFNNQKTINVHQRYEAQPGQYREATFATGTRWQAPRYTQLVVTWNF

SEQ ID NO: 16753 - protein, 943 aa, Nitrosospira multiformis
MQSATSSLKAAASAPHKERLIAKASKSISARLSAISLAMMLAGFSTNALAVGKLEGQIRDNSSQQPLAGATVTLKELNLSQQAGRDGRFFFVGVKDGDYTLVVNYLGAMTTEHKISIRDKQTTLQDISLNSQDDVEHIRVVGQQGALSKSMNRQRGADNVLSVVSADVLGNFPDSNISESLQRVPGLSIERDQGEGRFVRVRGMAPDYNSVSMNGTRLPSPESDRRAVALDVVPSDLLQSVEVSKTLTPDMDADALGGAIEVKSLSAFDRDDTYLNLNTEASQDTLTDNINPKLAASYSDIIAENLGIAIATSWYNRDFGSDNVETGGDWAFAEDSGFDDAALASVDARDYEINRERLGVGVNFDYRPSDDTDLYLRTLYSEFDDTETRNSAKTKWKSAQQADALSQGKTTRSLKSRTENQNITSFVLGGQTRFDRWTFDYQASHSSASAEKPRDIAGADFVAKIDNTGFSNTQTPQIIAPEDYYQNANFELDEIEIAASKAEDTINAVNVDLTRQLTLGDYSAEVKTGVKVSRRDKSNREDIWIYSDLGDQGVSDDALLLSQYAGNELDYSLGRFGTGIDSTPVWELVNSLDADDNRDEVESTINDFDITEDINAAYLMGHMDIGKLRILTGLRVEQNQWDSTGSGYDGAKDEFIDINHSSDEDHWLPALHLTYRYTDNTVLRAAWTNTLVRPTFGQLAPGYLLEEDDGDIDLTFGNPQLKSLESMNVDLSLEHYFGNIGLISAGLFYKDIENFIYQADLAGLGDYVDAHSAVTFVNGDSADIYGLELSYVQEFHFLPEPFNALVLNSNLTYTDSSANISWIEDGQLLSRDIPMPSQSDLTANLSLGYENSYASVWLSAAYKSEYLQEVTELSDERLDLYQDNHLQWDFVAKAHLTSNVTLYFKGVNLTDEPYYSYTGNSAYNAQYEAYGRTFQLGLQYTNY

SEQ ID NO: 16754 - protein, 806 aa, Nitrosospira multiformis
MAKRHRVRSSLSRTLLTSAVLAAMTAPAFAYGDASGAPQTLDKVVVTASGFEQKVVDAPASISVVSREELSKRPYTNLVDALRDVEGIDVGLEASDKNGRATISMRGLPSEYTLVLIDGRRQSNVGQLYPNNFGGGQFAYLPPLDAIERIEVVRGPMSTLYGSDAMGGVINIITRRNQDSWHGALTQGFTVQQDDQFGDARTTDVYLSGPLVKDRIGLAIRGSYYDAKASNPEWDALTLPDGSLWERSIGFGGGGKSVANTNWNTGVRLNFHVNDDHELWLDYDVSRQKYDNSEGQTGTLDSLASLWRVGNAVIPNPNGSGTVTRRVVQPRVGYTAYQRYERDQLSLTHQGRYSFGTWQTSLTHSKSSNLGRSLPLTLDERANLQTLWNDVCRRTGAANNCAAGRNNALGALNASEQARLQAFLPRPLRTMELEGYVLDTMLDLDFGAHKLTVGGQYNNTDMIDGVFGMDGAGYRSNTKQKHRMWALFAEDNWSLTDTLTATFGLRYDDHNVFGSHLSPRGYLVWNASDAWTFKGGISTGYKTPRPDQLFPGITGFGGQGVLPLVGSPNLKPETSTNYELAAYYEGQRWGFNVTGFFNKFEDKIASGGTFPNCEVAPAGSGYCVDIGPGWAALGYSTFTQSVNIDKAETRGAELAGHVDLLDNLQLRGNYTWTKSEQTSGPDKGRPISGTTPAKHMANASLNWQINEAISLSLIGEGRYDRYRDTLIDSAGARHVRYYEDYTIFHLGGSWKATPWLTVNARVNNLFDKDFVSQSCLLLNPSEFSCVDDYATKDQRRSYWISLNAKF

SEQ ID NO: 16755 - protein, 3420 aa, Nitrosospira multiformis
MPNLANQDFTQFKREQQTAPAWFRILRGGRMTKWKGKVASYAPHVAPAIGWAFSRTLQLSLISLVMAGTAAASDRYWDSNGTAVGRGGSGAWNTSNAFWSPSGDGVSGPYSAWNNAAFDTAIFGGTAGTVTLGSPITVGAMTFETTGYILSGNTLTLGTATPTITTSSGTTTINSVLAGTNGLTKAGDGILSLTGANTFSGNIIVTGGTLSVNSSAALGAAANEISLANGAGLNSSGSLAGRSVTLTGGQAAIGGAGVGDAHFTGAGGLRASSSVTLSDDSNDYTGQTSLSSGGTLFFSSIGNLGEVSALGAPVDEAAGTISLVVGSSASASATYTGSGASSNRNWQLSSRFYANSTISNRGSGTLTLTGNIFNNHTNSSLSARNINFDAGTADIELLGTISSNNNGVGVVFGGTAGRTIKVSGDNTFGGAAIIQNITVQVGSLKNTGDPSALGTGTGAAGAISINSGILSYLGAGDSSDRNFTAQNNAILANDGTGALTLSGDVALTGTLTLGGSFAGTNTLAGTVSGTGNLRVDGAGSWILSSANTFTGDVGVNSGTLVVGNMQALGTTPKAATVNGGTLDLGAFDTTLSSLSGTGGNVNLGGATLTVKGSTSTDFAGSMTGSGNLLKQGTSTLTLTGASSFTGDTTINGGAISLNFKNATALTDNILSTSSTLNLAGGTFNVIGMDNAANSQTVDGLNVTTGNNKITTTSGSGGTLTLNLGAINRTGGFIDFGINADTTITTTSATLGGWATVNSTDYAKVDGGVIKALDESDYANKDDAGTWANGDIVSDAGGAANTPYFGTVGTGLQLGGLKYTAAANSTVTIAAGQTLGVNGTIIVANTVGNTNQTINGGSLTGITGGGVLGVLQTGTGTFTIQSTITDNGGAIGFTKAGAGSVTLTGQNTYSGVTTLSGGILTVTQMANAGMASGIGQSTADPANLMLESGTFRYTGGSVTTDRGFTLVNGGPARVIEVTGSGSNLAFSGLVTSPDDAGFEKKGAGTLTFLNGSNDYIGATTVSGGTLAVSTLADGGQVSSLGKSGSDATNLILAGGALNYLGSTTSSDRSFTLGAGNGSIGVANAGTTLSMSGTAVGTGGLTKLGDGTLILSGTNTYTGNTAVNAGVLRAGSAQAFGPSGLMTVGNGASLELGGYDITVSGLLGAGTVDLGGNTLTSSGSAANSFTGKITGTGGFTRTGGSTQTLSGCNSDYTGKTTIASNGTLSVDCLKNGGQASSIGASSNAPDNLVLNNGTLSYTGNTVTTDRGFTIQGGTGAISVTDAATTLTFSGQVVGTGALQKRGTGTLVLMNSNSYRGGTSVDAGTLRAGSSGAFGGGSMSLSNAAGAILDLDGFDTSVTSLSGGGALGGNVALGGATLTISSGNSNGTSYTGAITGIGNFVKNGNGTQRLTGCASSYSGSTTINGGVLEDSCLADGGSVSSIGMSSADADNLVINGGVLRYTGSGDSTDRQFTLGASGGNSIESEGTGAILFTSNAAVTFAAANTAQTLTLAGTNTDDNELGAQLTNNGSGITSLTKTDTGTWFLTNSDSTYTGVTKINGGVLSVDKLANGGLASSIGASSSAASNLIIGNDSTLRYLGTGDTTDRLFTLASGLTYIESSGSGAIVFTDTGQVALADNNQARTIALGGKNTGDNTLAGSIGDAGTGKTTLAKNDDGTWVLTGNNTFTGPTNINKGLLKIGNGGTTGSLTSDIVVTDGGLIFNRSDTLNYGGLISGAGFVTQSGSGTTILTGANSYTGATSVSAGTLLVNGDQSAATGQTSVANGSILGGSGIIGGNVVVTDGALAPGSNGAGTLTINGSLALSAGSILSMQLGQAGVAGGALNDLIEVKGNLTLDGTLDVAETAGGSYGPGIYRLINYTGSLTDNGLDIGMLPNGAGAIQTAVAGQVNLLAGGTNFNFWDGDVGPKFNSAVDGGNGTWQNSSGNNNWTDATGNINASYSDGAFAIFTGTAGTVTIDNSLGQVKAEGMQFAIDSYAVTGDKLELTGPQSTIRVGDGTTAGAAYIATINSVLTGNTQLEKTDAGTLVLTGANSYTGGTAINGGTIRISSDDNLGVASSDISFDGGALNTTANIATDRAIILTGAGTLLTDASTTLSLSGPISGTGALTKSGTGTLLLSGTAVHTGGTTITAGTLQIGNGGTDGSIDGNIVNNGALVFDRAGTLAYTGSISGTGTLTKNGSSTLTMTGTSTYTGETTVSAGTLALQAGGQIKGTASLTVDGGAEVLIDGSGSQFATGAGASVVGTGTVTVRDGGTASFDSLTTSNATGTNSTITVAGSGSQMTQTGIATFGLAGTATVDILDGGTMISSGASVFVGGQLPMDATGQVTISGAGSQWTIANALYARRGSITVDDGGVVTAGSAVIGYADTGINNPETDLVVTGAGSRFETTGELAITNSAANAARGSITIADGGVVKVGGGALAMGPGNAVLNIGAAAGGSPAHAGTLDAGTVTMAVGSNQINFNHDDASTTFSATISGAGSVSQNGPGATLLTGNNSYAGLTTVTAGSLYIDGDQSMATGLTTVNPGGTLGGTGTIGGDVTVASGGAINPGSFGMAPGTLNINGDLTLASGSTQSFSFGQANIPGGPLNDLINVGGDLVLAGTLQVDTSAGGTMDPGIYRVFNYTGTLSQNAWTVNLPSPDFYVQTSVAQQINLVNTAGLALRFWDGADPQNKNNGKIEGGNGIWQAFGSAPDNGNDNWTETGNINAPFQDATFAVFTGEKGTVTVDDSKGAINVSGIQFVTDGYIVNGDAINLVGASGSTIRVGDGTTGGTDTVASIDAEITGASQLIKADMGTLILTGDNSYTGGTKITGGTLQVAKDSALGARTGELILDGGTLNTTADMTIDRSVTVDQAGTLDIDTGTTLKIDGVLSGAGAFVKTGAGRLELAGDDHTYNGDASIASGTLALTGALGGTMNVGIDGRLEATGRVGATTNSGVIALDQEGFGSLTVNGNYTGKDGRLEIATVLGDDTSLTNRLVIDGDMAGTTQVSVTNRGGLGAQTVEGIKIIQVGGASNGMFLLAGDYMFNGEQAVVAGAYGYRLYKGGVSTPADGNWYLRSALLNPETPTNPTDPETPLYQPGVPLYESYAGSLQQLNKLGTLQQRVGNRVWAKHPVPAQSDENGAGPSGNNGIWARIEAAHAEFDPKQSTSRASYDADIWKFQTGIDGMFAETASGKFIGGVYVQYETVSSSVSSPFGNGSIESSGYGAGATLTWYGESDFYIDGVAQINWFDSDLNSATLGRQLVDGNRAVGYSLSVETGQKIEIGEGWSLTPQAQLAYSAIRFDDFKDAFDTSVSPENDHDLTGRLGLAINRDAEWLDAQGRRVAMHIYGIGNLYYGFAGASKVDVSSVRFVSGNERLRGGIGLGGTYDWADSKYSLYGETRFDTSLQNFGDSNVIAGSVGLRVRW

SEQ ID NO: 16756 - protein, 1297 aa, Nitrosospira multiformis
MSAPASLLAQAAQSTGQPPGAEVNEEDVIVLSPFEVSSTATTGYAATTTLAGNRLATELRDVGNAVSVITSELLNDIGATDNKTLLQYTTNAEVGGFYGNFAGLGDGSHLDESSKFINPNTNTRIRGLTSADNTRDYFMTDIPWEGYSVDGVDLQRGPNSILFGQGSPAGIINTRTKQASFRDATEVSFRVGSWGSTRGMIDYNKVLVKNELALRIAAVDNHEKFKQDPAYSRQKRIYGATRWEPGFLKKGSARTIIKANIEFGDIDSNNPRQLPPNDAITPWFYTGTYAGHNVQDQAFNFPELNKMTVNPAQNEDDNTGRPNSGFDRASHNGPNGNYLGYLIPRYANDPNFASGKFAGTPNEFYQPRIGGGMLGSFKSPAYNFQYDDPTQGVGAVWEPLGNHGMDSSGNIGTRNNAVVRYMRPASVSSYSSYAQKARLYYGNLPAWKFGVFKDKSLTDASVFDFYNQLFDGPTKHEFQNFRAYNVSLAQTFLNEAIGFEATYNNEWYKSGKVQLLNDDSLNIDINRVYSDGTPTGKDGMPYEDGTANPNLGKPYVGGRGLYGNNVSVKNREAGRVTVFADHDFNVNHTNWLTKLLGRHVLTGMASGDRVEQDSRDFARWTIDDPAWERVINSSPTDAINTRTSFIADTMTPFVFLYLGDSLASANTPAGAHIPNPRVDPSLASSSKAIQFDATWKPSTNPADPTYVNPGAVWHDDYYPLPGQVPFTTDGQYRGTTGTPGDVLTYSTVGAATNPPGYLTQSENLANYVGYRQYPVNILDSLASDANRDRNTHSARLTKSKVDSRAFNWQAHFWDNAVVGTFGVRKDTAKSWAYSLNQDSASSLKENYQRLNLSPTNYRLNENPDNTLSVTSHAWTAVVHLNQLPYLSRLPILVSFFYNKSTDFQPEAKRVDVYGEPLAAPSGKTKDVGLLLETKDGKYSLKLNKYNTDSVNASSSALSNAWFIGSSQAWAANWVNRFEFNWTGDTIANAADPTLADYETNTMYNYEPAPGESAEQAKARENSVIAAWRAWQKQVDPRFYAAWQINLDDKTRGVGATTPNGFAVTEDSSSQGYEIEFNASPTRNWRIALNGSKTTAQRKNIGGTNLRAFMEAYTKALTTPGAGYDGVKGGVGDLRIWWGGAGNTTTLLDWNGGIGSEFNQRKLQEGTNVPELRKWRWNAVTNYEFDRGMFKGVNVGAGVRYESSIIIGYKPIPGATASEISFDMADPYRGPSETNYDMWVGYTRRKVWRNVEWNVQLNVRNLGVGNELIPVTVQPDGSGAAYRIRPPQTWMLTNTLRF

SEQ ID NO: 16757 - protein, 598 aa, Nitrosospira multiformis
MADALIDSQVPAKSGGAGMLKKSFPGLSFLDNLSEMTMLRQIGLLVGLAASVAIGFAVVLWSQQPDYKPLYGSLNGVDANRVVEALTAADIPYKVEPNSGALLVKADDLGRARMKVASAGVAPTDNNVGFEILDKEQALGTSQFMEATNYRRGLEGELARTVSSLNNVKAARVHLAIPKSSVFVRDDRKPSASVLVELYPGRSLEPSQVMAIVNLVATSVPELDKSQVTVVDQKGNLLSDQQELSELTMAGKQFDFTRRMEGLLTQRVHNILQPVLGNGRYKAEVSADVDFSAVESTSEMYNPDQPALRSEQRNNEERQNSSGPQGVPGALSNQPPGPASAPQQATASAPADYVAPGQPLKDANGQTIIDPKTGKPELAPYPTDKRDQTTRNYELDRSISYTKQQQGRLRRLSVAVVLDDQMKVDAKTGEVSHQPWSADELARFTRLVQDSVGYDASRGDSVSVINAPFAPAQAEEIDSIPFYSQPWFWDIVKQVLGVLFILVLVFGVLRPVLSNITGGGKGKSLAGGGGRDGDLALGESGLEGSLADDRVSIGGPSSILLPSPTEGYDAQLNAIKNLVAQDPGRVAQVVKEWINADE

SEQ ID NO: 16758 - protein, 534 aa, Nitrosospira multiformis
MGYELDNSLNLYSFGSYSKREGNSGGFYRRAQDSRNVLALYPDGFLPQIETDVEDYSFALGLEGETGDWTWDVSTNYGRNDFALGVVNSLNTSLGATSPTEFDNGALVYDQFIVNGDASTTLDLGLPDDVFFTLGAEYRHESYKIEQGEEASYITALDSNGNPIAAGGAQVLSGFGPESVTDESRHNVALFVEFDTYLTENWNMVLASRYEDYSDFGNTFTSKLATRYSVNENLSLRGAISTGFRAPSLAQSSYRQISTVLENNQAFEVGLFPTDAPAAQALGAKQLDAEDSVNLTAGFVYTQGNFSLTVDAYRIDIDDRIVLSENLSGAAVQQILTDAGELNTESVRYFTNAIDSRTQGVDIVATYLLQLDNFGDVRLNAAANFNDTEVTHVDDNPEQLNSLGDDYVVFARREVGRFEEGTPDNKLNLSAVWNFNEWQTTLRATRYGEVADISTTADRDEYLDAKWITDLEVAYRPNDEWKFALGANNLFDQYPQATVDNIGYSTFSQIFPYTPYTPYSLDGRFLYGNITYSF

SEQ ID NO: 16759 - protein, 719 aa, Nitrosospira multiformis
MKTRITFILLLISTFTFAQNIISGKVVDQKGKPVAGANIYLDGTYDGATSSETGEFSFETTETGNKFLVVSFLLFETFKQEIDVANYKDQTVKLRENINALDAVVITAGTLESGDKARVSVLKPLDIVTTAGSAGNIVAALQTLPGTQSVGEDGRLFVRGGEASETQTFVDGIRVAQPYGATTNNLPTRSRFSPFLFSGIAFSTGGYSAEYGEALSSVLLLNTQDEADHEKTDIGLMTVGLSLGNTQKFKKSSLSVNMAYINLAPYQAVIPQNVKWNSPYQSLGGETVYRYNFTNGIFKLYASFDSERFDLNQKNVNFENPIRTDLNNNNFYLNSSYKGTFGTGWQLTSGISYGYSKNKIKYDINDVDSNENAAQLKLKLQKKISNHFKLSFGTDYFITKFNENFNDNVSIDVSNGYDSNIFAAYTEADILFSKNLAMKVGFRYSNNSLLNENNIAPRASLAYKVSKTSQFSFAYGDFSQTPVVDYIKYSKYHQFESEKARHYILNYQFTQPGQTFRAEAYYKDYSNLVQYDTRDIQYNSVFNNNGSGYAKGLDIFWRDSNLYKNLEYWISYSYIDSERQYKNFPTMATPSFVANHNLSVVTKYFITDWKSQIGFTNSFSTGRPYNDPNQTQFMNGKTKSYNNLSFNWAYLLTTQKILYFSVSNVLGTQNVFGYDYAKVPDASGVYQRQAVVPTADRFFFIGFFWTISQNKNENQLKNL

SEQ ID NO: 16760 - protein, 785 aa, Nitrosospira multiformis
MKYLIRIVFSFVFTAAAAQNIEVSGTVTEEKRSIPFANIYISGTNQGTSADMKGNFTISLKPENTELTIQAIGFKTRRISIDPEDYKETELNIAMQEDALGLDQVVISATRNRINLKDAPVIVNVLGSKLFNATQSVSVAESLNFQPGVRVETNCQNCGFTQVRLNGLDGSYTQVLINSRAVFSALNSVYGLEQIPTSILDRVEVVRSGGSALFGSNAIAGTINIITKEPVLNTWNIASNISLIDGEIPDRTLNFAGSVVTEDLNSGVTIYGMNRDRAAYDANGDGFTEITELTNNTLGAKAFLKPSETSKITLDLTALKEYRRGGDRLELAPHLTDITEQLDHNTFIGGLTYEFSNPEMTNNYSVYVSGQHTDRKSFYGGLGGGRTAQDSLAASNAYGNTSDLALLGGFQFTHNFKNNDVLTTGVEYNRSRTEDDIAGYKRFIDQEVNSYAAFGQYEWKPVENFTALVGARLDHVDILGEYAVENVERKSKINQTVLSPRLTILYDITNELQFRGGYARGFRAPQAFNEDLHISSVGGEPQFVILSDDLKTEYSNAYTASFNYSKSINKLQTDFLLEGFYTELIDPFTTVSTGASLPNGSILKEVRNGSGAYVTGTNFEIGVSPSSDLTFQLGGTFQQSIYKEDQILYEADPASEREEDIIISEFVRNPDFYGYLNVNTSPFENFSVDLTGTYTGKMTIPKVINANGFLELRESPSFWDMNLKLSQHLDITENFHINLSTGVQNVFNAYQDDFDTGPTRDSDYIYGPSRPRTFFFGIKFGNLHD

SEQ ID NO: 16761 - protein, 383 aa, Nitrosospira multiformis
MKRIPAAVAVLGALVASTAHAQSSVTLYGIIDAGLMYTNNVQKSGTRGPLWQATSGTINGSRFGLRGAEDLGGGYKAIFVLENGFNVQNGNLGQHSRLFGRQAYVGLASSNYGQITLGRQYDSLVDFVAPLSGTAGTFGDTGFAHPFDNDNLNHSVRMSNAVKYTSTNYAGFKFGALYAFSNSTDFAMNRAYSAGASYQWGPLNVAAGYLQINGSNSATNTGGAIDTAESSANGVGGFQVGAGVQRVIGAGINYAFGPAVVGFVYTNSHYQQSAAFGMTNGSMRFDNYELNAKYAFTPAISFGITDTYTDGHTSGSRTFGTDPKFNQVNAQAVYAFSKRTDVYAEAMYQHAIGHGYVAFINTSGGASSTANQVVATIGMRHRF

SEQ ID NO: 16762 - protein, 414 aa, Nitrosospira multiformis
MGLFLRLVSLVLLSLSFSTKANTTFTFKQALAMAYRNNPELQAEIDKAQAMRGAFIQSGLYPNPQLNLTAENFGGSGVYSSYESAETTASVTQPIPLGHRLQYLQKATYADYLTSLASIKVQKTVLYMAVGNAYVDALYAEQWHKVTKKLTKLNQDIVVAIERRVKAGAGAELDLRLAQVRLGEARIQETKASRDALLQRARLARLLGYGLRIDKPLVDKGLPGLTLDWSELIKKLPQSPQLVQMQLQLQARRATITAVKKSVWPDLNIQLGGRHFSDDGSNAAVMSAFAEVPVYNRNQGKIMTAEAQYTQAAHEFQSTRLEVRQNVYAVFLQAQQSQYEANLVTDSLLPSARKSIQLAQEGYQMGRYTYVELYTALSTLYEEERHYQQAHADYHKSLIQMTGLLGLEPIKESQ

SEQ ID NO: 16763 - protein, 794 aa, Nitrosospira multiformis
MQASQINLKHLALSAILALATPTWLVAAEVSVNIAPKSLAQSLKELAQEAKMQLIFASEIVEGKQSQEVSGRMEISEALRRLLEGSGLEGRIEGDTIIIQKISLLNAQTLKAVKVQADSENRSSEKSQSYTMKSMSTATGLGLSARDTPQSVSVMTRQRIEDQGLETLTDVVNNTIGISSRLYDSSRSGFSARGFDIDNIQIDGISKNWSTGWSAGETLMDTAIYDRVEIVRGATGLMSGAGNPSAAVNLVRKHADSKEFTGSVVGGVGSWDDYQGTVDVTTPLNAEGTIRARVVGSYRDKDSFMDLLSEEKSVFYGVVDMDITPLTRLSVGASYQENKPLGSTWGGLPSWYSDGTRTDWDRSKTTAAQWSSWATAHTTYFADLNHRWENDWRMKLALSRTKNEANMKLLYLSGTVDKSTGLGLGASAARYDVLREQDDVVLQVNGPVEILGRTHEIGWGLSHSKQDFKDYSYSGSGAPLVGSFFGWDGSYAEPAWGDRSLSEDYTTKQNALYGVARFSLADSLWLIAGSRLSYWEREGVSWGNGFSYKHNDTLTPYAGLIYDLNDIFSLYVSYTDIFTPQDAQDASGNYLDPITGETYEAGIKGEFFEGKLNAGFTLYRILQDNLAQLVGLNPVTGKSIHEAAKGTKSEGFELDVSGEIGEGWNLFLGYSQIFSTQDANGAEINTQHPKRMAKIFTTYRLPMMEKLTVGGGVNWESRSYALTTNPVTLASEEIAQSSFAVANLMARYEFTKEFSAQLNLNNLFDKKYYTNVGFYDQLAYGAPRNALLTIKYKF

SEQ ID NO: 16764 - protein, 261 aa, Brucella abortus
MFSLKGTVMKTALLASVAMLFTSSAMAADIIVAEPAPVAVDTFSWTGGYIGINAGYAGGKFKHPFSGIEQDGAQDFSGSLDVTASGFVGGVQAGYNWQLANGLVLGGEADFQGSTVKSKLVDNGDLSDIGVAGNLSGDESFGLETKVQWFGTVRARLGFTPTERLMVYGTGGLAYGKVKTSLSAYDDGESFSAGNSKTKAGWTLGAGVEYAVTNNWTLKSEYLYTDLGKRSFNYIDEENVNINMENKVNFHTVRLGLNYKF

SEQ ID NO: 16765 - protein, 149 aa, Actinobacillus pleuropneumoniae
LDDYTRLGGMVWRANSTQNKLTVLDIGDHDTGVSPLAAIGAEYALTKNWATRLDYQWVNNIGGANTVGTRPDNGMLSLGVSYRFGQGDVVAAPVPAPAPAPVVETKRFTLRSDVLFAFNKATLKPEGQQALDQLYSQLSSLDPKDGSVV

SEQ ID NO: 16766 - protein, 662 aa, Actinobacillus pleuropneumoniae
LDEVSVVSSGSMYKMGEVPVHQAKSAVAISREDLDKQDVKKADEIGRYQAGFANQVFGNDTNTNWFRVRGAEVSQAVDGLPTFSYGFFTPYVETFGLEAVEVTKGADSMTFGAANSGGLINYVTKRAHRDQIGRGEFKTNFGSNNLYGFGADYTGKITDDENVRYRVVASLNHADGEWKDTDNKTVYIAPSLEWDISERTRLSILTSYQKDSGTPSSNFYPQEGTLRALPDGSYYSRNLNFGDPLNDHEENKQYGIGYELSHDFGNGLRANSSYRYNHVENNHRGGYIYPSAYAADWSAVAPSANGYNVSGQTVFNQGKAISHSTDNRISWDFKNDWLKNTVVVGTDYRHNKVDAQYSLYALGYTANLRDYRATWNQTGTPVGTDTHIKSRQLGFYLQNQARIADKYLLGFGIRHDRARQNEYTSDQTIKNNHTSYSGSLMYEGAYGLNPYFSYSESFRLPVGLSGNQSLYDPNITRQYELGVKYLPTWLDGVITLAGFRAKDTGALVNNGTGATISSADPIYRKGFELQADVNLTENWNATLAYTYTKAESEAATGEKTRQSLIPTNTLAARTAYNFTDGVLNGLTVGAGVRYLGHSVTSKGSLYSHARVPSATVVDLMARYNINQNWSAQLNVDNVGNRKYVAACDYYCYYGAERKVNAT

SEQ ID NO: 16767 - protein, 695 aa, Actinobacillus pleuropneumoniae
MKKTFFYSTVASAVALAISPAIAQETAVLDEVSVVSSGSMYKMGEVPVHQAKSAVAISREDLDKQDVKKADEIGRYQAGFANQVFGNDTNTNWFRVRGAEVSQAVDGLPTFSYGFFTPYVETFGLEAVEVTKGADSMTFGAANSGGLINYVTKRAHRDQIGRGEFKTNFGSNNLYGFGADYTGKITDDENVRYRVVASLNHTDGEWKDTDNKTVYIAPSLEWDISERTRLSILTSYQKDSGTPSSNFYPQEGTLRALPDGSYYSRNLNFGDPVNDHEENKQYGIGYELSHDFGNGLRANSSYRYNHVENNHRGGYIYPSAYAADWSAVAPSANGYNVSGQTVFNQGKAISHSTDNRISWDFKNDWLKNTVVVGTDYRHNKVDAQYSLYALGYTANLRDYRATWNQTGTPVGTDTHIKSRQLGFYLQNQARIAEKYLLGFGIRHDRARQNEYTSDQTVKNNHTSYSGSLMYEGAYGLNPYFSYSESFRLPVGLSGNQSLYDPNITRQYELGVKYLPTWLDGVITLAGFRAKDTGALVNNGTGATISSADPIYRKGFELQADVNLTENWNATLAYTYTKAESKAATGEKTRQSLIPTNALAARTAYNFTDGVLNGLTVGAGVRYLGHSVTSKGSLYSHARLPSATVVDLMARYNINQNWSAQLNVDNVGNRKYVASCDYYCYYGAERKVNATVSYKF

SEQ ID NO: 16768 - protein, 684 aa, Actinobacillus pleuropneumoniae
MKKTFFYSTVASAVALAISPAIAQETAVLDEVSVVGSVSKAGKVEYMTPKSVSVLTEEQIKEKGYKQADEIGRYEAGILSQPYGGDIDTHDWIRIRGFSPTLRIDGTAMYSFGFYHWQPNMYGLESIEVVKGADSLTYGSAQSGGLINLVSKRPTKEPKGELKFTLGNRNERGFSADYSNVISENVRFRLVGDYNRRDGEPKGSYMDAYYFAPSLSWDISERTRLSILTSYQKDSGTPSSNFYPQEGTLRALPDGSYYSRNLNFGDPLNDHEENKQYGIGYELSHDFGNGLRANSSYRYNHVENNHRGGYIYPSAYAADWSAVAPSANGYNVSGQTVFNQGKAISHSTDNRISWDFKNDWLKNTVVVGTDYRHNKVDAQYSLYALGYTANLRDYRASWNQTGTPVGTDTHIKSRQLGFYLQNQARIADKYLLGFGIRHDRARQNEYTSDQTIKNNHTSYSGSLMYEGAYGLNPYFSYSESFRLPVGLSGNQSLYDPNITRQYELGVKYLPTWLDGVITLAYFDLKEKNGLVQGVVNGQVTQLQTEKAKSKGVELQADMKLNDNISPLLAYTYTNAKVNNARKVIIPRHTYSAFVNYSFTNEALAGLKIGTGIRYIGTSTNGVTEVKIPAYTLVDLMAKYDLNKNWTAQVNVSNLSNKKYISACDTYWCYMGEGRKVTANLTYKF

SEQ ID NO: 16769 - protein, 695 aa, Actinobacillus pleuropneumoniae
  misc_feature (124)..(124): Xaa can be any naturally occurring amino acid
MKKTFFYSTVASAVALAISPAIAQETAVLDEVSVVSSGSMYKMGEVPVHQAKSAVAISREDLDKQDVKKADEIGRYQAGFANQVFGNDTNTNWFRVRGAEVSQAVDGLPTFSYGFFTPYVETFXLEAVEVTKGADSLTFGAANSGGLINYVTKRAHRDQIGRGEFKTNFGSNNLYGFGADYTGKITDDENVRYRVVASLNHTDGEWKDTDNKTVYIAPSLEWDISERTRLSILTSYQKDSGTPSSNFYPQEGTLRALPDGSYYSRNLNFGDPLNDHEENKQYGIGYELSHDFGNGLRANSSYRYNHVENNHRGGYIYPSAYAADWSAVAPSANGYNVSGQTVFNQGKAISHSTDNRISWDFKNDWLKNTVVVGTDYRHNKVDAQYSLYALGYTANLRDYRATWNQTGTPVGTDTHIKSRQLGFYLQNQARIADKYLLGFGIRHDRARQNEYTSDQTIKNNHTSYSGSLMYEGAYGLNPYFSYSESFRLPVGLSGNQSLYDPNITRQYELGVKYLPTWLDGVITLAGFRAKDTGALVNNGTGATISSADPIYRKGFELQADVNLTENWNATLAYTYTKAESEAATGEKTRQSLIPTNTLAARTAYNFTDGVLNGLTVGAGVRYLGHSVTSKGSLYSHARVPSATVVDLMARYNINQNWSAQLNVDNVGNRKYVAACDYYCYYGAERKVNATVSYKF

SEQ ID NO: 16770 - protein, 695 aa, Actinobacillus pleuropneumoniae
MKKTFFYSTVASAVALAISPAIAQETAVLDEVSVVSSGSMYKMGEVPVHQAKSAVAISREDLDKQDVKKADEIGRYQAGFANQVFGNDTNTNWFRVRGEEVSQAVDGLPTFSYGFFTPYVKTFGLEAVEVTKGADSMTFGAANSGGLINYVTKRAHRDQIGRGEFKTNFGSNNLYGFGADYTGKITDDENVRYRVVASLNHTDGEWKDTDNKTVYIAPSLEWDISDRTRLSILTSYQKDSGTPSSNFYPQEGTLRALPDGSYYSRNVNFGDPVNNHEENKQYSIGYELSHDFGNGLRANSSYRYSHVENNHRGGYIYPSAYAADWSAVAPSANGYNVSGQTVFNQGKAISHSTDNRISWDFKNDWLKNTVVVGTDYRHNKVDAQYSLYALGYTANLRDYRATWNQTGTPVGTDTHIKSRQLGFYLQNQARIADKYLLGFGIRHDRARQNEYTSDQTVKNNHTSYSGSLMYEGAYGLNPYFSYSESFRLPVGLSGNQSLYDPNITRQYELGVKYLPTWLDGVITLAGFRAKDTGALVNNGTGATISSADPIYRKGFELQTDVNLTENWNATLAYTYTKAESEAATGEKTRQSLIPTNTLAARTAYSFTDSVLNGLTVGAGVRYLGHSVTSKGSLYSHVRLPSATVVDLMARYNINQNWLAQLNVDNVGNRKYVAACDYYCYYGAERKVNATVSYKF

SEQ ID NO: 16771 - protein, 157 aa, Actinobacillus pleuropneumoniae
LPLYTKVDGIRNATGKEKDSPLTRSFIAGGGAFGYKMDDIRVDVEGLYSQLTKDVNVVNDINAADDVTAFSGLVNVYYDIAIEDMPITPYIGVGVGAAYLSNPSKADGVKDQRGLGFAGQVKAGVSYDVTPEIKLYAGARYFGSYGASFKKATASTN

SEQ ID NO: 16772 - protein, 694 aa, Actinobacillus pleuropneumoniae
MKKTFFYSTVASAVALAISPAIAQETAALDEVSVVSSGSMYKMGEVPVHQAKSAVAISREDLDKQDVKKADETGRYQAGFANQVSGNDTNTNWFRVRGEEVSQAVDGLPTFSYGFFTPYVKTFGLEAVEVTKRLDSMAFGAANSGGLINYVTKRAHRDQIGRGEFKTNFGSNNLYGFGADYTGKITDDENVRYRVVASLNHADGEWKDTDNKTVYIAPSLEWDISERTRLSILTSYQKDSGTPSSNFYPQEGTLRALPDGSYYSRNLNFGDPLNDHEENKQYGIGYELSHDFGNGLRANSSYRYNHVENNHRGGYIYPSAYAADWSAVAPSANGYNVSGQTVFNQGKAISHSRDTRISWDFKNDWLKNTGVVGTDYRLTSGPQYTLYALGYTANLRDYRATWNHTGTPVGTDTHIKSRQLGFYLQNQARIADKYLLGFGIRHDRARQNEYTSDQTIKNYHTSYSGSLMYEGAYGLNPYFSYSESFRLPVGLSGNQSLYDPNITRQYELGVKYLPPWLDGVITLAGFRAKDTGALVNNGTGQRSAVPIPIYRKGFELQADVNLTENWNATLAYTYTKAESEAATGEKTRQSLIPTNTLAARTAYNFTDGVLNGLTVGAGVRYLGHSVTSKGSLYSHARVPSATVVDLMARYNINQNWSAQLNVDNVGNRKYVAACDYYCYYGAERKVNATVSYKF

SEQ ID NO: 16773 - protein, 364 aa, Actinobacillus pleuropneumoniae
MKKTFCTAAILSCAAATAHAQGSVTLYGLIDASVQFTTNQDGGKTWAMSSGTTRGSRFGLLGREDLGGGTRAVFRLENGFDVTDGSLGQGGLMFGRQAYVGIENDSWGALTFGRQYESMVDYVAHLTAADWSVYMEHPGDMDLTNRGVRVDNSVKYTKSYGAFTGSALYSFGGQAGSFGKDSMWSLGGSYDDGPLYVGFGMTYARQPGDRSAGTFWKATNSAIGEFVTVAHSFLTVGGGAAYRFGSIKLGGDITSTTYKDGFEGQNVNFMNYELNGVYYFTPAFSAGLGATYTDGKIDANDGDPRYIQYNATATYSLSKRTDLYAFATFQRAMGDAQVAQVTQFISPSNNQKQASIGVGLRHSF

SEQ ID NO: 16774 - protein, 664 aa, Actinobacillus pleuropneumoniae
MKKTFFYSTVASAVALAISPAIAQETAVLDEVSVVGSVSKAGKVEYMTPKSVNVINDAQIADENAQKVDQALRYEAGIVTEPYGGDNDTDWFKIRGFDASMTLDGTALGKNGFFVWLPNTYGLESIEVVKGADSFTYGAVETGGLVNLVSKRPSKEPKGEIKLTGGNKDERGVSFDVSNQFADNLRYRVVGDYNKRHGQLNGTWLESYYFAPSLTWDISNTAALTLLASVQKDVGVPVNPFLPAYGSLIPTPNGTISHGVNLGEPSQDYTDRSQYSLGYEYTNKFSEGWQFTQNYRFSRLNIDQYNTFAWSSDQVANASRGYAYTVGHTNNHTFDNRISKNWNIGEFDNTTTVGVDYQHSETKGINEGFGQTVNSINMFNPIYGQTPYNPIGKSYNLKTIQLGLYAQNQLRYKNWLWNVSARHDDVRANSESNGAITGYNVSHNSYSTGLMYQFDNGLAPYANYSESFRAVSGNDDYGRAYKPFEGKQYEVGFKYLPSFINGTFSLAWFDLEEKNTLIADPSNISVQAGKQKSHGVELQANLGFTDNLSGQFAYTYTKAKTDLSVSQSIRSALIPRHAYAAKLNYRFADNVLNGLTVGAGIRYVGSTTDEQYYKGYKIGHYTLADLSAKYEFAKNWVAQVNVDNLFNKKYLASCSFYCYYGRRT

SEQ ID NO: 16775 - protein, 647 aa, Actinobacillus pleuropneumoniae
  misc_feature (436)..(437): Xaa can be any naturally occurring amino acid
  misc_feature (462)..(462): Xaa can be any naturally occurring amino acid
MKKTFFYSTVASAVALAISPAIAQETAVLDEVSVVGSVSKAGKVEYMTPKSVNVINDAQIADENAQKVDQALRYEAGIVTEPYGGDNDTDWFKIRGFDASMTLDGTALGKNGFFVWLPNTYGLESIEVVKGADSFTYGAVETGGLVNLVSKRPSKEPKGEIKLTGGNKDERGVSFDVSNQFADNLRYRVVGDYNKRHGQLNGTWLESYYFAPSLEWDISERTRLSILTSYQKDSGTPSSNFYPQERTLRALPDGSYYSRNLNFGDPLNDHDRSQYSLGYEYTNKFSEGWQFTQNYRFSRLNIDQYNTFAWSSDQVANASRGYAYTVGHTNNHTFDNRISKNWNIGEFDNTTTVGVDYQHSETKGINEGFGQTVNSINMFNPIYGQTPYNPIGKSYNLKTIQLGLYAQNQLRYKNWLWNVSARHDDVRAVSESWLAXXQLFGSFRSVGNDDYDVLISHLKPTXEVVFKYLPSFINGTFSLAWFDLEEKNTLIADPSNISVQAGKQKSHGVELQANLGFTDNLSGQFAYTYTKAKTDLSVSQSIRSALIPRHAYAAKLNYRFADNVLNGLTVGAGIRYVGSTTDEQYYKGYKIGHYTLADLSAKYEFAKNWVAQVNVDNLFNKKYLASCSFYCYYGEGRKVTANLTYKF

SEQ ID NO: 16776 - protein, 277 aa, Actinobacillus pleuropneumoniae
MKKTFLCAAAGAAALAPLAAHAQSAGSNVVTLGWFHVMPQQSSTPMTTNVAPTPINTPLRLPPSFTSPGTGLHTSGADTVGLTVSHFLTDHIAVTSVAGVPPVFKVSGKGTINPPGPAGALGTQNIGIAAVNPIVKSVRQWSPAVLLQYYFGQATARFRPFLGLGVSYNWFSDLQLNSNFIKQTQDNLGAILAAGAGKPGTTSVEAKASSSWQPVFNAGVQYNMTEHFGLVASVTYIPLKTTSTVTIKAADGTVLAESKSELKADPIISYVGLTYKF

SEQ ID NO: 16777 - protein, 662 aa, Actinobacillus pleuropneumoniae
LDEVSVVSSGSMYKMGEVPVHQAKSAVAISREDLDKQDVKKADEIGRYQAGFANQVFGNDTNTNWFRVRGAEVSQAVDGLPTFSYGFFTPYVEAFGLEAVEVTKGGDSMTFGAANSGGLINCVTKRAHRDQIGRGEFKTNFGSNNLYGFGADYTGKITDDENVRYRVVASLNHANGEWKDTDNKTVYIAPSLEWDVSERTRLSILTSYQKDSGTPSSDFYPQEGTLRALPDGSYYSRNLNFGDPLNDHEENKQYGIGYELSHDFGNGLRANSSYRYSHVENNHRGGYIYPSAYAADWSAVAPSANGYNVSGQTVFNQGKAISHSTDNRISWDFKNDWLKNTVVVGTDYRHNKVDAQYSLYALGYTANLRDYRASWNQTGTPVGTDTHIKSRQLGFYLLNQARIADKYILGFGIRHDRARQNEYTSEQTVKNNHPSYSGSLMYEGAYGLNPYFSYSESFRLPVGLSGNQSLYDPSITRQYELGVKYLPTWLDGVITLAGFRAKDTGALVNNGTGATISSADPIYRKGFELQADVNLTENWNATLAYTYTKAESEAATGEKTRQSLIPTNTLAARTAYNFTDGVLNGLTVGAGVRYLGHSVTSKGSLYSHARVPSATVVDLMARYNINQNWSAQLNVDNVGNRKYVAACDYYCYYGAERKVNAT

SEQ ID NO: 16778 - protein, 658 aa, Actinobacillus pleuropneumoniae
  misc_feature (575)..(575): Xaa can be any naturally occurring amino acid
  misc_feature (631)..(631): Xaa can be any naturally occurring amino acid
MKKTFFYSTVASAVALAISPAIAQETAVLDEVSVVSSGSMYKMGEVPVHQAKSAVAISLEDLDKQDVKKADEIGCYQAGFANQVFGNDTNTNWFRLRGAEVSQAVDGLPTFTYGFFTPYVETFRLEAVQVTKGANSMTFAAANSGGLINYLTNRAHRDQIGRGEFKTNFPSNNLHGFGADYTVKITDHENVPYRVVASLNHTGGEWKDTDNKTVYIAPSLEWDISERTRLSILTSYQKDSGTPSSNFYPQEGTLRALPDGSYYSRNLNFGDPLNDHEENKQYGIGYELSHDFGNGLRANSSYRVFNQGKAISHSTDNRISWDFKNDWLKNTVVVGTDYRHNKVDAQYSLYALGYTANLRDYRATWNQTGTPVGTDAHIKSRQLGFYLQNQARIADKYILGFGIRHDRARQNEYTSEQTVKNNHTSYSGSLMYEGAYGLNPYFSYSESFRLPVGLSGNQSLYDPNITRQYELGVKYLPTWLDGVITLAGFRAKDTGALVNKGTGATISSSADPIYRKGFELQTDVNLTENWNATLAYTYTKAESEAATGEKTRQSLIPTSTLAARTAYNFTDGVLXGLTVGAGVRYLGHSVTSKGSLYSHARVPSATVVDLMARYNINQNWSAQLNVDNVGXRKYVAACDYYCYYGAERKVNATVSYKF

SEQ ID NO: 16779 - protein, 204 aa, Neisseria meningitidis
ADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYNAGLNYKM

SEQ ID NO: 16780 - protein, 206 aa, Neisseria meningitidis
PMFSLYGEIKAGVEGRNIQLQLTEQPSKAQGQTNNQVKVTKAKSRIRTKISDFGSFIGFKGSEDLGDELKAVWQLEQDVSVAGGGATRWGNRESFVGLAGEFGTLRAGRVANQFDDASQAIDPWDSNNDVASQLGIFKRHDDMPVSVRYDSPDFSGFSGSVQFVPIQNSKSAYKPAYVDEKKMVHAAVVGKPGSDVYYAGLNYKMA

SEQ ID NO: 16781 - protein, 209 aa, Neisseria meningitidis
ADVSLYGEIKAGVEGRNIQLQLTEPLQNIQPQVTKRKSRIRTKISDFGSFIGFKGSEDLAKGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPAHFVQQTPKSQPTLVPAVVGKPGSDVYYAGLNYKNGGFCR

SEQ ID NO: 16782 - protein, 216 aa, Neisseria meningitidis
ADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYA

SEQ ID NO: 16783 - protein, 212 aa, Neisseria meningitidis
AAAVADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFA

SEQ ID NO: 16784 - protein, 218 aa, Neisseria meningitidis
DVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHA

SEQ ID NO: 16785 - protein, 220 aa, Neisseria meningitidis
AAAVADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYA

SEQ ID NO: 16786 - protein, 192 aa, Neisseria meningitidis
DVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGS

SEQ ID NO: 16787 - protein, 232 aa, Neisseria meningitidis
DVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELFLLGS

SEQ ID NO: 16788 - protein, 182 aa, Neisseria meningitidis
ADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADV

SEQ ID NO: 16789 - protein, 217 aa, Neisseria meningitidis
ADVSLYGEIKAGVEGNNIQLQLTEPPSQGQTGNKVTKGKSRIRTKISDFGSFIGFRGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPATLANGANNTIIRVPAVVGKPGSDVYYAGLNYKNGGFAGNYAFKYA

SEQ ID NO: 16790 - protein, 237 aa, Neisseria meningitidis
PMFSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELFLLGSTSDE

SEQ ID NO: 16791 - protein, 201 aa, Neisseria meningitidis
PMSAWYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLN

SEQ ID NO: 16792 - protein, 245 aa, Neisseria meningitidis
ADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELFLLGSTSDEAKGTDPLK

SEQ ID NO: 16793 - protein, 220 aa, Neisseria meningitidis
ADVSLYGEIKAGVEGRNIQLQLTEQPSKAQGQTNNQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVDEKQVSHAAVVGKPGSDVYYAGLNYKNGGFAGSYAFKYAKHA

SEQ ID NO: 16794 - protein, 242 aa, Neisseria meningitidis
DVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELFLLGSTSDEAKGTDP

SEQ ID NO: 16795 - protein, 219 aa, Neisseria meningitidis
PMFSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHA

SEQ ID NO: 16796 - protein, 188 aa, Neisseria meningitidis
RCSAWYGEIKAGVEGRNYQLQLTEAQAANGGAGASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGV

SEQ ID NO: 16797 - protein, 201 aa, Neisseria meningitidis
AAAAVADVSLYGEIKAGVEGRNIQLQLTEPLQNIQPQVTKRKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPAHFVQQTPKSQPTLVPAVVGKPGSDVY

SEQ ID NO: 16798 - protein, 231 aa, Neisseria meningitidis
ADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELFLL

SEQ ID NO: 16799 - protein, 230 aa, Neisseria meningitidis
ADVSLYGEIKAGVEGRNIQLQLTEQPSKAQGQTNNQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVDEKQVSHAAVVGKPGSDVYYAGLNYKNGGFAGSYAFKYAKHANEGRDAFFLF

SEQ ID NO: 16800 - protein, 225 aa, Neisseria meningitidis
AAAAVADVSLYGEIKAGVEGNNIQLQLTEPPSKGQTGNKVTKGKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYKPAYVDEKKMVHAAVVGKPGSDVYYAGLNYKNGGFAGNYAFKYAKHANVGR

SEQ ID NO: 16801 - protein, 237 aa, Neisseria meningitidis
ADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELFLLGSTSDE

SEQ ID NO: 16802 - protein, 175 aa, Neisseria meningitidis
PLNTKVDGITGAQKDSKDTNDLYKPSFMAGGSAFGYRMDDIRVDIEGLYSQLSKSTLSRAPTPDIVDNLTAISGLVNVYYDVVIEDIPITPYVGVGLGVAYISNPAKAQVIADQKHGFGFAYQAKAGISYDVTPEIKLFAGARYFGSYGANFDKSEEVNKGTSEDKETKVTAGAY

SEQ ID NO: 16803 - protein, 199 aa, Neisseria meningitidis
RCLAWYGEIKAGVEGRNIQLQLTEPLQNIQQPQVTKRKSRIRTKISDFGSFIGFKGSEDLGEGLKAVWQLEQDVSVAGGGATQWGNRESFIGLAGEFGTLRAGRVANQFDDASKAIDPWDSNNVVASQLGIFKRHDDMPVSVRYDSPEFSGFSGSVQFVPAQNSKSAYTPAHFVQQTPQSQPTLVPAVVGKPGSDVYYA

SEQ ID NO: 16804 - protein, 192 aa, Neisseria meningitidis
ADVSLYGEIKAGVEGRNIQLQLTEQPSKAQGQTNNQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVDEKQVSHAAVVGKP

SEQ ID NO: 16805 - protein, 227 aa, Neisseria meningitidis
PMFSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFNMRDTPMSDVMLLS

SEQ ID NO: 16806 - protein, 219 aa, Neisseria meningitidis
PMSAWYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHA

SEQ ID NO: 16807 - protein, 226 aa, Neisseria meningitidis
DVSLYGEIKAGVEGRNIQLQLTEPLQNIQQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNQQNQPPTLVPAVVGKPGSDVYYAGLNYKNGGFAGNYAFKYPKHANVGR

SEQ ID NO: 16808 - protein, 280 aa, Neisseria meningitidis; identical to SEQ ID NO: 953

SEQ ID NO: 16809 - protein, 208 aa, Neisseria meningitidis
ADVSLYGEIKAGVEGRNYQLQLTEAQAANGGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYKPAYWTTVNTGSATTTTFVPAVVGKPGSDVYYAGLN

SEQ ID NO: 16810 - protein, 217 aa, Neisseria meningitidis
AAAVADVSLYGEIKAGVEGRNIQLQLTEPLQNIQPQVTKRKSRIRTKISDFGSFIGFKGSEDLAKGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPAHFVQQTPKSQPTLVPAVVGKPGSDVYYAGLNYKNGGFAGNYAF

SEQ ID NO: 16811 - protein, 239 aa, Neisseria meningitidis
ADVSLYGEIKAGVEGRNYQLQLTEAQAANGGAGASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLL

SEQ ID NO: 16812 - protein, 188 aa, Neisseria meningitidis
ADVSLYGEIKAGVEGRNYQLQLTEAQAANGGAGASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGV

SEQ ID NO: 16813 - protein, 211 aa, Neisseria meningitidis
DVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKMAVLPGAMP

SEQ ID NO: 16814 - protein, 365 aa, Neisseria meningitidis
DVSLYGEIKAGVEGRNIQLQLTEPLQNIQPQVTKRKSRIRTKISDFGSFIGFKGSEDLGEGLKAVWQLEQDVSVAGGGATQWGNRESFIGLAGEFGTLRAGRVANQFDDASQAIDPWDSNNDVGSQLGIFKRHDDMPVSVRYDSPEFSGFSGSVQFVPAQNSKSAYTPAHFVQQTSKSQPTLVPAVVGKPGSDVYYAGLNYKNGGFAGNYAFKYAKHANVGRDAFELFLLGSGSDEAKGTDPLKNHQVQLTGGYEEGGLNLALAAQLDLSENGDKTKNSTTEIAATASYRFGNAVPRISYAHGFDFIERGKKGENTCYDQIIAGVDYDFSKRTSAIVSGAWLKRNTGIGNYTQINAASVGLRHKF

SEQ ID NO: 16815 - protein, 227 aa, Neisseria meningitidis
ADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFE

SEQ ID NO: 16816 - protein, 201 aa, Neisseria meningitidis
ADVSLYGEIKAGVEGRNYQLQLTEAQAANGGAGASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKLRLLSASPDR

SEQ ID NO: 16817 - protein, 235 aa, Neisseria meningitidis
AAAVADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELFLL

SEQ ID NO: 16818 - protein, 192 aa, Neisseria meningitidis
AAAVADVSLYGEIKAGVEGRNYQLQLTEAQAANGGAGASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGV

SEQ ID NO: 16819 - protein, 218 aa, Neisseria meningitidis
ADVSLYGEIKAGVEGRNIQAQLTEQPQVTNGVQGNQVKVTKAKSRIRTKISDFGSFIGFKGSEDLGEGLKAVWQLEQDVSVAGGGASQWGNRESFIGLAGEFGTLRAGRVANQFDDASQAINPWDSNNDVASQLGIFKRHDDMPVSVRYDSPEFSGFSGSVQFVPAQNSKSAYKPAYYTKDTNNNLTLVPAVVGKPGSDVYYAGLNYKNGGFAGNYAF

SEQ ID NO: 16820 - protein, 369 aa, Neisseria meningitidis
DVSLYGEIKAGVEGNNIQLQLTEPPSKGQTGNKVTNGKSRIRTKINDFGSFIGFKGSEDLGEGLKAVWQLEQDVSVAGGGATQWGNRESFIGLAGEFGQLRAGRVANQFDDASQAIDPWDSNNDVGLQLGIFKRHDDMPVSVRYDSPDFSGFSGSVQFVPAQNSKSAYTPATYTVDSSGVVTPVPAVVGKPGSDVYYAGLNYKNGGFAGNYAFKYAKHANVGRDAFNLFLLGRIGEDDEAKGTDPLKNHQVHRLTGGYEEGGLNLALAAQLDLSENADKTKNSTTEIAATASYRFGNAVPRISYAHGFDFIERGKKGEHTSYDQIIAGVDYDFSKRTSAIVSGAWLKRNTGIGNYTQINAASVGLRHKF

SEQ ID NO: 16821 - protein, 233 aa, Neisseria meningitidis
AAAVADVSLYGEIKAGVEGRNYQLQLTEAQAANGGAGASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANV

SEQ ID NO: 16822 - protein, 361 aa, Neisseria meningitidis
AAVADVSLYGEIKAGVEGRDIQLQLTEPLQNIQPQVTKRKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPAHFVQQTPKSQPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINA

SEQ ID NO: 16823 - protein, 217 aa, Neisseria meningitidis
PMSAWYGEIKAGVEGRNIQLQLTEQPSKAQGQTNNQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVDEKQVSHAAVVGKPGSDVYYAGLNYKNGGFAGSYAFKYA

SEQ ID NO: 16824 - protein, 210 aa, Neisseria meningitidis
DVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGLPGAM

SEQ ID NO: 16825 - protein, 203 aa, Neisseria meningitidis
RCSAWYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYK

SEQ ID NO: 16826 - protein, 200 aa, Neisseria meningitidis
ADVSLYGEIKAGVEGRNYQLQLTEAQAANGGASGQVKVTKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAYYTKDTNNNLTLVPAVVGKPGS

SEQ ID NO: 16827 - protein, 224 aa, Neisseria meningitidis
PMFSLYGEIKAGVEGRNYQLQLTEAQAANGGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANV

SEQ ID NO: 16828 - protein, 207 aa, Neisseria meningitidis
PMFSLYGEIKAGVEGRNYQLQLTEAQAANGGAGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNY

SEQ ID NO: 16829 - protein, 236 aa, Neisseria meningitidis
DVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELFLLGSTSDE

SEQ ID NO: 16830 - protein, 172 aa, Neisseria meningitidis
PLYTKVDGIRNAPGKEKDSPLTRSFIAGGGAFGYKMDDIRVDVEGLYSQLTKDVNVVNDINAADDVTAFSGLVNVYYDIAIEDMPITPYIGVGVGAAYLSNPSKADGVKDQRGLGFAGQVKAGVSYDVTPEIKLYAGARYFGSYGASFKKATASTNKDINVLYSTVGAEAGV

SEQ ID NO: 16831 - protein, 183 aa, Neisseria meningitidis
ADVSLYGEIKAGVEGNNIQLQLTEPPSQGQTGNKVTKGKSRIRTKISDFGSFIGFRGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPATLANGANNTII

SEQ ID NO: 16832 - protein, 213 aa, Neisseria meningitidis
  misc_feature (190)..(190): Xaa can be any naturally occurring amino acid
  misc_feature (193)..(193): Xaa can be any naturally occurring amino acid
AAAVADVSLYGEIKAGVEGRNYQLQLTEAQAANGGAGASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVEXGVXKKVAAVVGKPGSNVYYAGLI

SEQ ID NO: 16833 - protein, 167 aa, Neisseria meningitidis
RCGAEKQTRPRQLTNVGTLENHGGTATLGYQWHELNTRLTYSHARPELNGKPLNDDTKGIGTAIGDTWLLTLDYQVSDQWLLGYGGRYVARLTEVAAGYDEKPGYALHDLYAQWNPMTDEPLTLSLSIKNLFDKAYRDHASYGVSNDVATGTLEAGRDIRFNLAYQF

SEQ ID NO: 16834 - protein, 232 aa, Neisseria meningitidis
AAAVADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFEL

SEQ ID NO: 16835 - protein, 215 aa, Neisseria meningitidis
PMSACTAKIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFNM

SEQ ID NO: 16836 - protein, 207 aa, Neisseria meningitidis
ADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKMAVC

SEQ ID NO: 16837 - protein, 259 aa, Neisseria meningitidis
AAAVADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELFLLGSTSDEAKGTDPLKNHQVHRLTAA

SEQ ID NO: 16838 - protein, 262 aa, Neisseria meningitidis
PKNLLFSSLLFSSLLFSSLLFSSAAQAASEDGSRSPYYVQADLAYAAERITHDYPKATGANNTSTVSDYFRNIRAHSIHPRVSVGYDFGDWRIAADYASYRKWNNNKYSVNTKELENKHNNKKDLKTENQENGTFHAASSLGLSAIYDFKLNDKFKPYIGARVAYGHVRHSIDSTKKTTEVVTSTHGGADTKPTIYNGESTQNAYHESHSIRRLGLGVVAGVGFDITPKLTLDTGYRYHNWGRLENTRFKTHEVSLGMRYHF

SEQ ID NO: 16839 - protein, 231 aa, Neisseria meningitidis
ADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHPNVGRDAFELFLL

SEQ ID NO: 16840 - protein, 241 aa, Neisseria meningitidis
AAAVADVSLYGEIKAGVEGRNFQLQLTEQPQTANTQQGGKVKVTKAKSRIRTKISDFGSFIGFKGSEDLGEGLKAVWQLEQDVSVAGGGATRWGNRESFVGLAGEFGTLRTGRVANQFDDASQAIDPWDSNNDVASQLGIFKRHDDMPVSVRYDSPDFSGFSGSVQFVPAQNSKSAYTPAYVDEQSKYHAAVVGKPGSDVYYAGLNYKNGGFAGNYAFKYARHANVGRDAFELFLLGSGSD

SEQ ID NO: 16841 - protein, 216 aa, Neisseria meningitidis
ADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKMAVLPGAMPLNMR

SEQ ID NO: 16842 - protein, 229 aa, Neisseria meningitidis
ADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELF

SEQ ID NO: 16843 - protein, 219 aa, Neisseria meningitidis
ADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHA

SEQ ID NO: 16844 - protein, 224 aa, Neisseria meningitidis
ADVSLYGEIKAGVEGRNIQAQLTEQPQVTNGVQGNQVKVTKAKSRIRTKISDFGSFIGFKGSEDLGEGLKAVWQLEQDVSVAGGGASQWGNRESFIGLAGEFGTLRAGRVANQFDDASQAINPWDSNNDVASQLGIFKRHDDMPVSVRYDSPEFSGFSGSVQFVPAQNSKSAYKPAYYTKDTNNNLTLVPAVVGKPGSDVYYAGLNYKNGGFAGNYAFKYARHA

SEQ ID NO: 16845 - protein, 185 aa, Neisseria meningitidis
NFQDKRRLTNDAPFFALGIGKFINPVWSIDGTLNYQNPQFKRNKDLNWSQYGFSVDFRRHFIQDNRGWNPYLLLGAGYQRSEEEFDNTPNVNSPGERKKGGFAAKVGAGLQTTFRSRVAVRAEVAYRGDHDKDSVRQPVAGVAAPSSKKWFGDTLASIGVVIPFGPAASSPTPPPAPPAPTPPPP

SEQ ID NO: 16846 - protein, 243 aa, Neisseria meningitidis
PMFSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELFLLGSTSDEAKGTDP

SEQ ID NO: 16847 - protein, 117 aa, Neisseria meningitidis
ADTTDTTDLYTASFIAGGGAFGYKMDDIRVDVEGIYSQLNQNTTVTGTSVPAGGIAKNLTAISGLVNVYYDIAIEDMPITPYVGVGVGAAYVSNPLAKKANDDKASGFGVAYQAKAG

SEQ ID NO: 16848 - protein, 248 aa, Neisseria meningitidis
AAAVADVSLYGEIKAGVEGRNIQLQLTEPLPNIQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNQRPTLVPAVVGKPGSDVYYAGLNYKNGGFAGNYAFKYAKHANVGRDAFELFLIGSATSDEAKGTDP

SEQ ID NO: 16849 - protein, 200 aa, Neisseria meningitidis
DVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLN

SEQ ID NO: 16850 - protein, 184 aa, Neisseria meningitidis
DVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVP

SEQ ID NO: 16851 - protein, 570 aa, Sulfurimonas denitrificans
MKRTIATDLFCCSLVAGLAALPAASRADGPLRGNPVDALPQLERPTAPAAPAPALQAPTPEQRAVQARLAQRIVPRNFDVAGVHALPFDQVAAFLTPLAGKEITVAQLVQQVDRITELYRSSGYPLSFALVQNQDFANGLVVVTVVEGHIGNVRIDGDIGNAKRRLETLAGPLLAEKPLTQATLERQLNLMRIVPGVKITPSLDLPRRADGATELVIAATHGKFTSNGGVADLGTGMQPLVDLGAHSLTPLGEQLKLTTSIPLNSDDVKYVAGEARLPIGADGFSIKVDGYHYQAKPQDDAIEYLGFDRKVTNDRIGVGVSYPFLLNNQRSLTGTLGMYAVNAKDRYTHRDSDRWLQQDTRVRAATAELRYIDILPQRSTDLTVSVSKGFDAMGAKKSIDTNYGYSAIPDVDLDFTRFNLNVRQAFTLPAQFGLVLSGAGQYSSDILPSSEQVSFGSWRFAMGYPQGEQSGDKGVGVSAEVNRRFGLGWRYLSAVQPYAMADYARTWYNNKGLQELNERHLSSLSLGVRFTDDKFYLFDFNVAKPVGSSTVNGDRDVRFNANYSLFYDAL

SEQ ID NO: 16852 - protein, 236 aa, Sulfurimonas denitrificans
MRKLLLGTAALMVLAAPAFAADLPAPTYTKAPAYTAPEVVYNWTGFYIGGHVGGAFAGDNNISGNDGQFLGGVQIGADYQFTRNWVVGLEAQYSWLPSNDNGGLAFPGGSLVTQDNRGLGSVTGRLGYTWGPALLYAKGGYAFRDSSLDLSNTGVGVPFTTSGNHRDGYTVGAGLEYMFAPNWSAKVEYQYYDFGNTTFTGGPPDVLGASVRNDEHTVKAGLNYRFGWGGPAVAKY

SEQ ID NO: 16853 - protein, 864 aa, Sulfurimonas denitrificans
MRMTMTGASRLALAVAMTAFAPGLAQAQDGAQDGAQDGAVEELVVTGQRLSQQRAIETKRSATAVVDAISADEIGRLADKNVAENVERLPGVGVSYDQGEGRYVSIRGAPAQLNNVTLNGVEVGNPDGDSRALPLDVVSGQLLGRIEVVKAVTPDMDAQGIGGTVNLVTQSPFDAGKDLFARGSVQAGYQEFNEKVPVQGDATFGAVFGDGRWGVIVGVNGSSRDYRSDGLYPDDWRSVPGYARGGLPTNIKFTNYTLKRERIGVSGALEFRPADADKLYVRGLFSRFTEDEYRQRSRLDFGANPANITLNSDGATGVARNVDARQDLRLEYKEKSISSASFGGEHERGPWLLQYDLSWGYNELVEPNQGWQFRLPSANLTVDFDMRPLLYTAEPRTMSAGALQFRQYTAQDEYGDETNLAAKVDLKRAIDIGQDSFFKVGLKVRDTDKMFDGRTERWDRGSAANRFTLADFGLQGPVMEVDLGDYTYLNRYTIDAEAMQRFTAENLASARFVRNAADSLANETLSDYDLTERIYAGYVMADVDLGGWRLIGGWRVERTETDVQGFRLDAEEGGVTPVSRSGEYVNFLPNVHLRFEPREDLVVRLAYTRTLGRPQYPQLKPGGELEWVEVTPGVFEGGLSEGNADLKPFVSDNFDATIEWYFARGGLLSAGAFLKKVKDPIFNFSETRTNFVLDGRTYARFGYSQPRNADEGEIKGIELAYQQQFTFLPGLWSGFGAAANVTITDSSLTVPGRGELAFPAQSDLLWGAQLFYQKGRFEAALSYHHTGKAVQGLGGNDEADTWDDDFKRLDAKASYALTDNVEIYVDLQNLNDEVLREYQGGRRDWLTNYERYGRTYYLGVSARW

SEQ ID NO: 16854 - protein, 700 aa, Sulfurimonas denitrificans
MKIFSVRQTVLPALLVLSPVVFAADEQTMIVSAAPQVVSELDTPAAVSVVDGEEMRLATSRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 16855 - protein, 403 aa, Sulfurimonas denitrificans
MKKSVIATALAAVIFVPAASAIEIYKDDKNAVEIGGFIDARVINTQGSTEVVNGASRINFGFTREMSDGWKAFTKLEWGVNPFGNSEIVYSSESNFESKSGDFLNNRLGYVGIAHDLYGSLTIGKQWGAWYDVVYNTNYGFVWDGNAAGVYTYNKADGAVNGVGRGDKIVQYRNSVGDLSFAVQAQLKNDKFYTCEYDPNLSTDCKERWDSQDPVLDSEEVKYNYTYGASATYQVNDKLSVSAGINRGEFDVTFRKTSEQITAIDVIYGMGVTWGNWDADGFYGAANFNKNENHDTDNLGRLIKDSYGVETLFSYKFDNGFRPFVSYNILDAGKDYVIQPNNVDPNSSFKRQFVVVGLHYVWDANTVLYVEGRKDFSKFEGADAEAQAKFEEDGIAIGIRYTL

SEQ ID NO: 16856 - protein, 726 aa, Sulfurimonas denitrificans
MKSKFNVWTGLASCLGLLAVAGEALSQTESDAALEEVIVRSHPLSAEGLSQPVTVLAGDELSKALAASLGDTLSVIPGVHSASFGPAVGRPVIRGLSGPRVKIMEDRIDSLDVSISSPDHVTTIEPFAAQSIEVLKGPSTLLYGSGAIGGVVDIHTGRIPHNIPEAMSADLEVRGSDNASQRAGAGRIEGGAGAFAFHVDGFYRDADEYDIPGYAESSLQRASEEHGDEHHDDEGHDDDHDEGHDEHEGEEEAFGTLPGSQMQVQGGSFGLSFIGDTGFLGVAVSTYEGEYGLPGHSHHHDEEHGDEHEGEHDEHDEDEHDDDDHEGEHEGHGEEEMPPILDLKQTRIDVEGGLEAPLPGIRNVNVRMGYNDYEHTEVEGEEGGTQFKTEAWEARLEATHHAVLGFEGAAGLQISNRKFSALGEEAFVPPVDTQSLGLFWVGQKSLGDISLETGLRYEKVEHDPSEGRARDFNLGSASLGMIIPLADSWTLSGQVDYSNRAPIAEELYSNGPHLATQTFEIGDASLDEETAKNISANLRYSSNRVNFALGAFSTDFDNFIYEANTGLEEDELPVLQWSQGDAKIIGMEAEASWTAMTWSEGALTLSAAYDLVEARLDEGSNRNLPRIPPQRWTLTGNFTQGPFQAEASWRTVSSQSDVAANELSTESYDDLRLYVSYAMDFGSTNVDLFVNGLNLTDEEQRLHTSFIAQMAPPAGRTIEAGFRIHM

SEQ ID NO: 16857 - protein, 447 aa, Sulfurimonas denitrificans
MKKQVAITVAAACLAFSATAHSESRIKEGALSVSPFGGYTFFDRDSDLKSRPTGGLRLGYNFTENVAVEGSGAYTDTKYDNGNGSSNVYRYGAELLYHFIPQSRVVPFLAAGLGGITYEGREGVPDADRTDGILTAGGGVKLFLVDRIALRADGRNIFTFNDALNHQEVTAGLDFQFGGGKAAPAPVKAEPKPEPKPEPKKVVATAPLDSDGDGVPDNLDKCPDTPAGVKVDSVGCPLDSDGDGVPDYLDKCPGTPAGVKVDSVGCPLDSDGDGVPDYLDKCPGTPAGVKVDSVGCPLDTDGDGVPDYLDKCPDTPKNAAVDKNGCPEKVCITLKVEFDFDKANIKPEFRDEIKRVADFLKEYPDATAVIEGHTDSKGTVKYNQKLSERRAKAVMKNLVDEFGISAKRLSAKGYGETKPVADNATEEGRQKNRRVVANIDCGLKKRK

SEQ ID NO: 16858 - protein, 1060 aa, Sulfurimonas denitrificans
MKKVICFFVCVLICIGFSVKAQVTTSVLSGKIIDDQNEYVIGATVVAVHEPSGTMYGAVTNVDGRYTIQGMRTGGPYKVEISYVGYKKAVFTDIRLELGNTYVLNATLYPSSEQLGEVVVTADAKANIGASENFSTGRIQETPTVDRNIYDVVKNMPMAMTSKNGGITFAGSNNRYNSFQIDGTVSNDVFGLAPSGTNGGQTNANPISMDAIQEIQVVVAPFDVRQSGFTGGGINAITKQGNNTYHASVYSYFTNEGLYGKYNAYKDNIKDKLTEQSTKTFGGTLSGPIIKDKLFFFANAENRKESYPSRFYAGYDEKGFSTDMAQKIADKYEEYTGIRESFGSRDVDQRAFNFLGRIDWNIDRNNKLAFRYQYNNSYDDIFSPSSTTYFFNGSGYRMKNKTNSFVAEWNSHWSDVLYNEFRAGVTTVRDERQVAYQGPNVKINGSDNSGTNNTTVNIGTEYSSGANALDQDIYTFEDNLSWYKGNHTFTFGTHNEIFRMKNLFIQVVTGSWEFGSMDAFLNDSPSKYVFKYTDPDVTGGNYRYTPIIKAGQFGFYAQDKWDVADNFSLTYGLRFDIPLLFNDPTVNHEFNEYAASKNIKERVGEMPGAKVMVSPRLGFRWYTDDSRTTLIRGGLGLFTGRVPFVWLSNAYNNTGVEQKGTTIFASGSTSAPSLGQYADDPIGAMNSQKGNPATPDIVTVSKDFKYPQVFRVNLALERVLPGDVKMTLEGLYSKTFNNVYFENLALSSNAKVYAVPGVETSATPYYSVDKKYFSITNLKNTNMGYTYSLSALFEKSFYFGLDLAASYTFGHSKSVYDGTSSVAYSNWKYNYAVDSNNPGLAYSMFDIPHRVMVSVGYRTPRYAKGFMATTVSLVYNGYVGQRYSLTMNESYYDAEKKKTVYIDYNGDGWGGNSLLYIPTEDELQKMDFKTEEDRRKFDEWIEGDSYAKKHRGAYAMRNSNSAPWENRVDLHVAQDIFVLKDRGSKFQVTFDVTNFANMLNKKWGTTYTAAYNVMPLQVIGSKKGEDGNYTNTYAYNSRNTITKNDVLSRWHAQIGFKYIF

SEQ ID NO: 16859 - protein, 771 aa, Sulfurimonas denitrificans
MILICLTSSLFKCKNTTRHLSLWSHRVSIRTLHTLSSPALALPALPRTPLAHAVFIGLALGSCTLAPIAAHADAANPHEAAEEKPAPPELPATLIDAQASAADPLPPVYAGGQVATGGRVGLLGNKDFMETPFSTVSYTDTYIQDLQARDITDVIAATDPSVFSNGLTGTYSENYSIRGFQTSVSDMTIDGLFGMAPYYRASPEMYERIEVLKGPSALLNGMPPGGSVGGIVNLIPKRAGDTPLTRLTATYASDAQLGGHVDVGRRFGEGNQFGVRFNGMYRDGDTAIDDQRQRNVLSSLALDWRGERGKLSLDLFDTDDHISGQNRGMGLAAGVPVPKPPKNDTLLNPDWAYVETKDKGVILRGEYELNDQLLAYGAVGTSKTDYRYSGALTATVNNSAGDFTTAMGQLQMEIHKTSAEVGLRGHFDTFGINHQWSVNATQYSDTQKDFGRRAAGSNWTTNIYNPVWGPKVSEAWPLIAHTENDLKSYGIADTLSVLDDRVQLTLGVRRQEVVTDTYNTNTGARNKPGYDTHATTPAGAILFKLTDELSLYANYIEGLSKGAAAPITAANYGDVFAPYKSKQKEIGLKLDLGTFSHTLALYEIKRPGSYTDPVTNIFSFGGEQRNRGVEWSFFGAPLPDVRLMGGVAYVDPKLTKTAGGANDGKTATAYPKVQGKLGMEWDIPGLDGLTLTGNVTSQSKQYINAENSLSIPGYTIFDVGARFVTQVANKPVTLRANIANLGDKDYWGVPLTQTLGLGAPRTYQLSASVDF

SEQ ID NO: 16860 - protein, 254 aa, Sulfurimonas denitrificans
MNKIKKSIWKAIGCGFLCVGLGLGFSSLKAQEVGSSSLSEGDEIAVGKDSDAKYQESKKAMEKAGGEAKRIVGAWYIAGGAGTAFVGANDGFVNPGGPITVNTNFSTVLGVLGGYHWLDTETHLAWTVEAEGAYIGTGHYLSLPNMNTALNIGALMVNGTVGYHIGNFEPYVGFGVGAVVVNAEVASANIGTNWAFAFQPIAGVRYFITAHWLAAAQFEWIWTDTLSGYNIGATQVTIGHAMIPLGLLAIGYAF

SEQ ID NO: 16861 - protein, 664 aa, Sulfurimonas denitrificans
MLSITAIRVVRRRGDRRGGVTTPRVKRAAAATAVAVLSLGATLGSAQAQFTRVYGFGDSYADTGTAPGGAFRLGHEPCVYPGVCSFTGSTTFVQTLQSLYAAPEMVNYAIGGARTSNSNTLGFLGSNYGFPYELARLAHDGVRFTDRDLIALSIGGNDSSQLVNDVGAARTLGTQAAARAVNGTGVGTITGTFDGVTYNDVATYGVQQLVAAGARNIAWFSAGNSKYFPEPEGGAAVQAPARDAFAHTYYQELQTLLRPMAQAGVRIFLFNYEILQRRIFENAAIYGFSAVPGCEANGGGSIPQVTGCFYENSVHPTGAAMALIASYMANQIDAPTTVVPQGSISTALATGFTGSVFGRLDAQRSLAPFGLGSALAYAGPPKAAPAANPADRWSIYGAASYANGSRDRQFYGSGYDYNSVGGIFGAEYRLDQNWRVGGVFGYSQPDVELGVQNARERIDAYQFAGYASYADAHWFADGLLGYGRHDFALQRQGIIDTIRGNTRADVFTVAGKAGYLFDVGQLRVGPLASLTYSNAQIDGYTETGDVLLTMTVDRQRVEALTGDTGVQLRYPLLIGGGIYSPFVNLTAAHDFIGEGRTITTMLVSAPLLPILTPVAGDGRTYGRVAAGVSALVSGNVSATLTVGSTFARSGGDDLALSGGVKLAF

SEQ ID NO: 16862 - protein, 214 aa, Sulfurimonas denitrificans
MNKKIVSSLIATALLTTGFSSSVFAHQAGDIIVRAGVAVVAPNESSQDVAGFGEFSVDDNTQLGLNFGYMLTDNIGIELLAATPFTHDISLDGVGKIAETKQLPPTLVAQYYFGDAQSKLRPYIGAGVNFTNFFDNEFTNDLDGALTDLSMSNSWGLAAQVGLDYQINGSWLINASVWYAQISTDVKFNLGADAQKVETDIDPWVYMISVGYTF

SEQ ID NO: 16863 - protein, 227 aa, Sulfurimonas denitrificans
MKLLIVEDEKKTGEYLTKGLTEAGFVVDLADNGLNGYHLAMTGDYDLIILDIMLPDVNGWDIVRMLRSANKGMPILLLTALGTIEHRVKGLELGADDYLVKPFAFAELLARVRTLLRRGAAVIIESQFQVADLMVDLVSRKVTRSGTRITLTSKEFTLLEFFLRHQGEVLPRSLIASQVWDMNFDSDTNAIDVAVKRLRGKIDNDFEPKLIQTVRGVGYMLEVPDGQ

SEQ ID NO: 16864 - protein, 196 aa, Sulfurimonas denitrificans
MKKKILAALALAALGGAATAAPTGGDWLVRVRALHLDPANKDSTGVGLAIDSKTFPELDISYFFTPNWAAELVLTYPQKQDVSASGTRIGSLKHLPPTLSLQYHFLPGAAVQPYLGAGINYTRFSSVDLPAPFSIEKNSVGLAVGAGVDVPLGDRLVLNVDVKKVQIRTDVSAAGVKAGTFKVDPVLFGVGLGWRF

SEQ ID NO: 16865 - protein, 1154 aa, Sulfurimonas denitrificans
MKIYFSVQLLWMIKSCRLILNKTPLPMKLSVLFLICSLSMTYAAESYAQKTMISLEVRNETVGTVLEKLKKESGFDFFFNNKHVDLKRIVSVSANNNNIFKILDQIFAGTNVKYSVLEKKIILSTEIVQGIQQEQNKVTGIVKDANGEPIIGANVIVKGQSTGTITDIDGRFVLDTPKDAVLQITYIGYVSQEVKVSGKKELNVVLKEDTETLEEVVVVGYGVQKKANLTGAVSSVKMDEILGDRPVTSVSNVLMGAMPGLQVTGTSGQPGAEMSFNIRGVNSINEGAPLVLVDNVEMDINMLDPNDIESISVLKDAASSAIYGARAAFGVILVTTKKGMKDTRFSINYSNNFSFSKPSNLPHKATPLQTVQAYKDMGTVSYQTGQNVDTWLELLKEYNTNSSNYPDGYAVVDGLRYSLQETDLLNDMMETGFQQTHNISVGGGNKSISYRMSAGMVNQNGILVTDKDSYKRYNISSYIRSDIHSWITPELDIKYANSHSELPYTSASYGIWGAAVAFPSYFPLGNMELDGEILPINTPHNFINLSAPKENDRNDLRIFGKLTITPFKDLKIIGEYTFNRKTREITTFDKKFAYAHGANFRKEQSVSNSKYEIENRATNYNAFNVYANYNKTLGQHDIGIMAGFNQESNSYKMMKASRTDMINEDLPSLSQATGDYKNSDEFEEYHVRGLFYRINYSYAGKYLLETNGRYDGSSKFPKENRFGFFPSVSVGWRVSEEQFMEWNKVFLSNLKLRGSYGNIGNQSIEPYAFIPGMDSPLANWVVNGQATTTLAPPALVSNSFTWEKVSTLDFGFDLGLFNNRLNVVFDWYQRDTKGMLAPGMELPGVLGAKAPLQNSADLRAKGWEISLDWNDRIGNVQYYLGFNLYDSRTKITKYDNEVGLLGKDSDDNLIYRKGMELGEIWGYTTDRLYTTEDFDSQGKLKNNIPKVEGYNPNPGDILYVDFDGNGIINNGKNTSNEPGDTRIIGNDTRRYQYGIRGGATWKGISLSFILQGVGKRDLWLMNELFYPHYDAYSTLFDSQLNYWTPEHTNSYFPRLYEKAEGNTKANQKPQTRFLQNGAYLSIRNISLSYTFPIKLIKPLGITNLSVFFGGENLFTFDHLPKGIDAERVVTDNLGQRGFTYPYMRQFSFGINLSL

SEQ ID NO: 16866 - protein, 680 aa, Desulfovibrio desulfuricans
MLYTPLRLSPLAVALWLAASPSQAVELEPQVITANPLGNRQLAAPSTVLEGDNLLQQQHGSLGETLNKQPGVASTWFGPGASRPVIRGLDGDRIRILRNGVGALDASSLSYDHAVPLDPVTVERVEIVRGPAALLYGGNAIGGVVNTFDNRIPDSPIEGIHGAGELRYGGADTTRSSAGKLEAGDGAFALHLDANSRQFNDLRIPGYARSAKVRDADEPGSKHRLENSDGRQDGGAIGGAYHWDHGYAGLSYSRYDSNYGSVAESGVRLDMKQDHYAFASELRDLDGPFSSVKVDAGYTDYEHSEIEEGEVHTTFKNKGYEARIEARHQPLGPIEGVIGAQVSRNEFSALGEEAFVPHTDTDSLALFMLEQWQATERLNLSLGARMEHTRVDPDAKGNENFVDADSASSFNAFSLSSGAVYQLDPIWSLAANLGYTERAPTFYELYANGAHVATGAFEVGDASLNKEKAISADLALRFDNGTHKGSVGLFYSHFRNYIGLIGTGNTREGEHDHEEEDHDHDHDHEGFPEYQYQGVRARFYGIEAQDRWQLAENRYGSFALELSGDYTRAKNLDSGEPLPRIAPLRLNSGLVWELDRWQARVDVQHAASQHRKPANETSTDGYTTLGASVGYRFDIGQSQWLAFVRGENLTDQTVRYASSILRDIAPAPGRSVEVGLRTTF

SEQ ID NO: 16867 - protein, 235 aa, Desulfovibrio desulfuricans
MKKLLLGAAAVIAFAAPAVAADISARPATKAPAYTAPEIVYNWTGFYIGGHVGGAFAGDDNITGSDGRFLAGVQGGADYQFARNWVVGIEAQYSWLPTDGNGGLLYPGNTLVTQDNRGLGSVTGRLGYSWGPALLYAKGGYAFRDSSIDVSNLGAQPFATSGNKKDGYSVGGGLEYLFAPNWSAKVEYQYYNFGNTSFTGGPPDIVGSSVRNDEHTVKAGINYRFGWGGPIVAKY

SEQ ID NO: 16868 - protein, 743 aa, Desulfovibrio desulfuricans
MRRFASVAGSRCGASLCALALLVTASEAQPQADATFDFRIEPKPRLSALADFTTTTGIQVVRLGGGAISGASPAVSGQLAAEAALREILAGSNLTYRFTGPRTVAIESSPDAAIALEPISVTEISIGRGGVSEIDITSADIERRNATDLRGVFRGEPSVVVGSSLPMSQKLYVQGIEETNLAISIDGSRQNNKVFHHNATTMIDPSLLRAVRVDAGVAPADAGPGALGGAIAYFTKDARDFLSADGFGGSIKSTFNFNGNVSTTNLTSYSRQGGFEALGSFTYGKGSEFRAGNGEQVLGSATDVLSGLGKLAYQSADGHRLSISHEQIRDDAIRPFRANAVQIYGPQTTPLVRPYKLDRQNTVVSYSNVSPEGWWNPNVVLGYNRTQVAVDQYAGATPDTYSYTSEGLTDSLNGKVENKFELSIADIVAGIDFYRDRARSIERTYRTAETADNVGAYAQARLKFADSAKLSFGLRGDHQQFGGISGFRSSDQGLSSNVSGEYALTSHLTAKAGYSNVWAGVPLAENYVQNPAWSYGTGPRSVTSDNATAALVALFTSFRIEGGVFRTRIWDARVPLWAADMALRAFDVQSQGFHVGGTYYWDDGFARLQFVRTDTSINGRPADSYLGKYLTAPIGDILTVQVAHSFASLSLTIGGDVEIAFEDDSLLNPVTGIGRLDGYEVVNIFAEHRPFALPSLTLRGEVRNLLNQTYAARGTYGLEYGSGVVRPLYDPGRSYLVSAKLTF

SEQ ID NO: 16869 - protein, 383 aa, Prochlorococcus marinus
MKLFKSLLVAPAALGLLAPMSVTANEINLTDVSGYTSTKEVKGISDFNPANELAVTNSRVDGLEARFNNFEAGSFSETTTASFSADFEIGSEDGSTTSEAVQAYYGFQIDLNTSFTGEDSFDVSIDAGNAGGSEFDLNSTSDALNIDGISYTFPLGDKTTVVVGDNIDGSTLYNTACVYGGPSNNLDDCGNGNSAMTEGAGTAAGASYDIGNGFTVAVGYTGAGSSTSGIATKEGSDVFGGQLSYAADSYGASVTYAKTDDYSGDDDRNFLGLNGYWTPSDTGAVPSISAGYEVGTGEGLADTTQWFVGLQWDEMGPGTLGTAVGTIGSSIGDVYDPEFLMYEAFYSYEINDGMSITPLVYIKETAAGSDDKTGIMVKTSFSF

SEQ ID NO: 16870 - protein, 371 aa, Prochlorococcus marinus
MKLFKSLLVAPATLGLLAPMAATANEVTINDFNPAEELAITNSRVDGLEARFNNFEAGSFSETTSASFSVDFAIGSNDDDDAGVDTDDAVQAGYAFQIDLNTSFTGEDSLDIAIDAGNPGAGSINDLLDLNSAGDGLTVDGVTYTFPVGDKATAFFGQNTDGNKLFTQACVYGGPSDLLDDCGNVNAGITGGAVGLGGSYDFGNGFTMAAGAQTVQANVFTEEGDDQYAINAAYTADKYALSVTYGVDENAALTDENKFTALQAYYTPDGNLPSISVGYEFGDIGGAADGADEQSSFFVGLTWAEVGPGSAGIAAGHSNTNESADELYQYEAYYAYPVNDSMTITPLIYTQDAAGDLDDTTGMMVKTSFKF

SEQ ID NO: 16871 - protein, 449 aa, Prochlorococcus marinus
MKLFQKLIAAPAIISLVSGFAVNAAEINTSDLSDYSSTNNLVSLDNFKSETLVPGDWAYDSLKDLTNSSKFNGNSVTRLEAAAELNNLIAGSEGLMNGAAIDRLSDELGSELAIMKGRVDGLESRVNTIEAGSFSETSTISFKARMAIGAVDGKGVTATVTDGDEAVNFQYTFDSAIKTSFTGDDSLTVKIDSGNGTSGNPVDEFDLNNTDDFLKVDGVAYKFPLGDNLTALVSDGYDGSKIFTTACAYGGPSNTLDDCGNVNANIDNAGASAMAEYDFGNGFTAAVGYAGNEEGLMTTAKNDAYGANLAYIADNYGVSLTYGMQEDGASNETYTALNGFYSFDNGLNISAGYEVGDLDVADANVDETLAYFVGINGDVGPGELGAAVGTNGSMTESAGSITEEMMYEVYYDYPLNDGMTITPLVFVKESSTAGTPDQTGVMVKTTFKF

SEQ ID NO: 16872 - protein, 612 aa, Thiomicrospira crunogena
MKKQFLFAILTGLALSTKAQTDTTTQHLDEVIIQENRIQIPFSKQSRNISIIDKQQIETTPGRSLQEILSFVPGVDVRQRGVTGVQADIGIRGGSFAQTLMLLNGIKLTDPQSGHHMMNIPVPMVNIDRVEVLKGPGSRIYGQNAYAGAINVITSLSEEKFLRVQGYAGDFGMKGINFAGSLPAGKYKQNIAVSYDDSNGYQYNSDYQVSNIFYEGGINLNDQNSLRGMIAYTDRTFGANGFYSSSFPDQWESIQTTLSSLSHTLNTGQFYLNSRAYYRRNVDEYRLRRNEPEFYQNNHTSNVYALEANGHFKSSLGTTGFGVETRQETIESNNLGDRERTMGGLFLEQLFNFGDLVDLRAGIYSNYNSNYGWKHFPGAEVGFQASKEIRLYSGYGVSYRVPSFTDLYYVGPTNIGNDQLVPEQAQNWEIGAKWSKANFRSELVYYIRNTDNLIEWTRPTDNAGEDIPWQPQNFTKVNFDGIELSLFYRVNPRATTFQIKEFSFSYNYINADLKEQPGVETRYALTSLKNQVIGGALFGIGKKTEWNTKMRYVERMNQDPYFVIDMRIDYNRLGKIGVFAEASNLTNTEYVEAATIQMPGRWFRAGFMLNLE

SEQ ID NO: 16873 - protein, 617 aa, Thiomicrospira crunogena
MTPKSVSVLTEEQIKEKGYKQADEIGRYEAGILSQPYGGDIDTHDWIRIRGFSPTLRIDGTAMYSFGFYHWQPNMYGLESIEVVKGADSLTYGSAQSGGLINLVSKRPTKEPKGELKFTLGNRNERGFSADYSNVISENVRFRLVGDYNRRDGEPKGSYMDAYYFAPSLSWDISKNTSLTLLASIQHDDGRPSSGFFPAGYERLSSLGLSNRTNFAENVPEYLRRNQYSVGYEFTHKFSDDLVYQSNYRYAYSNKDQFSASIGSDGSSLSTMTARGKTFTHSLDNRLSKTWAIDRIENILTVGFDYTTGKNYAANGYGSEILSNLYGNYPTAAQPFGAVSPYVNKERQLGVYLQNQFRFDNRLLVNLGARRDFAKGDYGDEGYDINHNSYSAGVMYITDSGLSPFYNYSESFRPISGSNINGQIVRYKPYEGTQHEVGFKYLPSFADGTLSIAYFDLKEKNGLVQGVVNGQVTQLQTEKAKSKGVELQADMKLNDNISTLLAYTYTNAKVNNARKVIIPRHTYSAFVNYSFTNEALAGLKIGTGIRYIGTSTNGVTEVKIPAYTLVDLMAKYDLNKNWTAQVNVSNLSNKKYISACDTYWCYMGEGRKVTANLTYKF

SEQ ID NO: 16874 - protein, 725 aa, Thiomicrospira crunogena
MIRYIVSLSARDSARDSVHPENTAPITAMDHHRRIAPPSARRLHPLSLLLAASLAHGETGEPAGRPSSAPPATALAPIFVTANPLGASALTSPTASLSGDALTLRRADSLGDMLNGLPGVSTTTYGPLVGRPIIRGMDGDRIRLLQNGVAAYDASSLSYDHAVPQDPLSVERVEIVRGPAALLYGGNAVGGVVNTIDNRIPREAVTGVTGALDASYGGANNARAGAALVEGGNGRFAFHLDAFGRETDELRIPGYAHSARQRARDGEDASEPYGKLPNSDGRRYGGAAGGSYTWADGYVGASYSGYESNYGSVAETDARLRMRQERVAIASEARNLRGPFSQLKFDFGYTNYLHREIEDGVTGTTFRNHGYEARVEARHRKLGPFEGALGVQVGQNTFSALGGEALAPTTRTTSVALFGLEEWQATDALKLSAGARIEHVRLDPSANGDDKFGVARSRDFNAGSVSAGALYQLAPAWSVAGNVSYTERAPTFYELYANGPHGATGQYLIGLPDARKEKAVSTDLALRYANGPNRGSVGVFYSRLRNYLAEYDTGRLVDDEGAPVAPGGDETLREAVYRGVRAEFYGVELEGKWRAFEKRGHRIDLELGADYTHARNADTGEPLPRIAPLRATLAADYGYGPFGARAQLTHAWAQHRVPENDLATDGYTSLGVVLTYKFRVGATNWLAYLRGDNLTNQDIRYASSVVRNIAPQGGRSVTVGMRTTF

SEQ ID NO: 16875 - protein, 728 aa, Thiomicrospira crunogena
MNYRVTPFASAIAVALSSFVVQQALAQTTLNEVVVKTGKIRDAAASVEIGSTEIAAQHAVTRDTASLLRDVPGVHLYGAGGVSSLPVIHGLADDRLRITIDGMDFISSCANHMNPPLSYLDPGNVAKIRVYAGISPVSVGGDSIGGTIVAETAAPQFAAPGQRSLIKGEVGSFYRSNNNAFGGNLSATLANEFFSINYSGAITTADNYKAGGNFKTTTATGRPGHTLPLDEVGSTAYKSLTHTLGLALRADNHLLEAKFGYQNVPYQFYPNQRMDMLDNEQKRINARYLGEYNWGTLDGRVYYEAVDHYMNFSDDKQLVYGTALNGMPMSSRGRTLGLNLKGDVYLTDDDLLRVGALYQHYTLRDWWPPSGTGAMSPLNFQNINHGKRDRLGFFAEWERHFNPQWTTLLGARYEHLETDADNVHGYGNMMGNQIPDSAAFNARGHKRNDNNVDLTALARYTPGNMVDLELGLARKVRTPNLYERYTWSTWSMAAIMNNFVGDGNGYVGNMDLKPEKAYTASLTIDLHAADREWEIKATPYFTYVNNYVDAIRIPAVTTNNQFVVLQYANHSAHLYGVDLSGRTVLVKTSLGEFGLRGLMNYTRGENKKTGDDLYNIMPLNGKLTLTHQYSNWSNAIELVGATRKNDVSSVRNEIHTKGYFLTNLRTSYTWKNVRVDLGVENLFDRLYYLPLGGAYTGQGMTMGINGIPYGIAVPGMGRSVYAGLNIKF

SEQ ID NO: 16876 - protein, 763 aa, Thiomicrospira crunogena
MNQSLSISTEPKRSAPRLLCVMIGVALGSLSASSWSAAVANSTKTASAVAETNSAESSNKADTITVVGTPDTFRAGGNDLIPTYLDGQVANGGRIGFLGQQDARNVPFNIIGYTSKMIEDQQAATIADVVKNDASVQNVRGYGNPSQNYRIRGFNLDGDDISFGGLFGVLPRQIVSTSMVERVEVFKGANAFINGISPSGSGVGGMINLEPKRAGDTPLTRVTVDYGSAAQVGGGLDVGRRYGDNDQYGVRVNVLHREGETAIKDEKNRLTAVSTGLDYRSDRARTSLDVGYQKQTIHHMRTTVGVGAVTVIPEPPSTTLNYGQPWVYTDLETTFGMLRSEYDVSQNWTVYGSIGASHNEETGQYGSPILTDNSGNATISRLYVPYISESIAGLGGIRGHFDTGFITHKVNLGYATNYRTTKSAFNMSESINTNIYNPGVIPFPPTSTNPNFYSPNQDPTLTSQVRASGFSLSDTLSMMDDKVQLMLGVRRQDVTIRNFNNGVPNSAGSLDAMKVTPIYGVLVRPWEKVSLYANHIEALGPGKSAPYSYSNASGVTTPVANAGQIPGIVHSKQNEVGVKFDNQRYGGTLALFEITRPTGTVDPATNTYGFYGEQRNRGVELNVFGEPVLGTRLLGSAVWLDPKLTKTQNGTNNGNYAVGVARYQLVFGGEYDIPSVEGLTATGTLTRSGSQYANDANTLKIKPWTRLDLGVRYTMPMKETNLIWRANLENVTNERYWESIEDSGVYLYQGDPRTLKLSVSMDF

SEQ ID NO: 16877 - protein, 366 aa, Thiomicrospira crunogena
MKLKIVAVVVTGLLAANVAHAAEVYNKDGNKLDLYGKVTALRYFTDDKRDDGDKTYARLGFKGGTQINDQMIGFGHWEYDFKGYNDEANGSRGNKTRLAYAGLKISEFGSLDYGRNYGVGYDIGSWTDMLPEFGGDTWSQKDVFMTYRTTGLATYRNYDFFGLIEGLNFAAQYQGKNERTDNSHLYGADYTRANGDGFGISSTYVYDGFGIGAVYTKSDRTNAQERAAANPLNASGKNAELWATGIKYDANNIYFAANYDETLNMTTYGDGYISNKAQSFEVVAQYQFDFGLRPSLAYLKSKGRDLGRYADQDMIEYIDVGATYFFNKNMSTYVDYKINLIDESDFTRAVDIRTDNIVATGITYQF

SEQ ID NO: 16878 - protein, 419 aa, Thiomicrospira crunogena
MNLKKTLLATSLTLLSQQSFAAAFQLAESSASGLGRAFAGEAAIAENASVVARNPALMTQFKEMQLSVVATYVKPDVSLNGQSAPRDVNANVLDDDSIAPSAVIPAVYFTMPINEQFAVGFGAFSNFGLATEFNDDYAAGQLAGDTEITTVNFNASLAYKVTDALSVAAGINYIYADAAIKRHFGTSLYPIPAQTEAVDLEGDDTGFGFNLGVAYEVKDGHRYGLHYRSETDITFDGTYSNQLPAALGGLAGKVLPGSVAITLPAVVEFSGSHQLNAEYGLHYSVMWTGWGSFDKLEAYVEGKDGPVFSKSEQFQDAFRIALGGDYQYNDTLKLRAGIAYDESPAEQAHLSISIPDTNRLWLSAGANYAIDAHSSVDVGISILRGKTQHFVETDNLGQAWGFESKGHAYLVGAQYNYQF

SEQ ID NO: 16879 - protein, 876 aa, Thiomicrospira crunogena
MTFKHSYLSAAILAGTAILAANTALAADNTTIEEVQVTGSYIKGTPGDSALPVQILDRNYIESIGATSVADVVSKLAISSGTENQADSFTAGSTQGTANVNLRGLGLSSTLVLINGRRQTISGGLANDGSVFVDTSSIPVNALERVEVLKEGAASTYGSDAIAGVVNFILRKDFEGFEITTNLSSVDRGDQEDKSVGFLWGGGNDTTRFTVAANVLDRTALAATERPELVDNAVSSLGASFVAMPHIASSPAASVTVDDGPYAGTYGPGQRFALAGCADKAGGSVVPTPAGPMCFFQYGTRFNLVAAEERTQLYSNMTHQMANGIEMTAELGYSMNKVTENPQSPSYPDLTFPLIPETHPSNPLGVPLVWLGRPLAFDAPSPNATRKNDTLRASLGFKGQFENGMDWDAAVTHSSNEYSARQPDTISSRLRAGLAGTGGPNNDEYYDPFDASNNSDALIADMSYMTDTMRTTDLTVLDGVVSGELMTLSSGAAVDFAAGFQVRSEGYKTETDDLYEIQFDADGAPIPIDLIFLGGVSEIDESRTSYSMFAEAQTNLAENVELTAAVRYENVDTGDSIDPKIALRWQVTDQLALRASASTAFREPSLSQINAQVVNLAGLQDFNEDGSANGGVAFVRVTSSGSDDLEAEESDNFNVGLLYQPTDKLDIKLDYWKVDYTNLITVENSQGKLAADINGPDIVRSATGTLAGVYVDYFNSSSVDVEGIDLEVQYKMSDNLNLGVNVAHFLQYDITAPTGEVIEAAGYFNNNNFARSMPETKANVVLAWSNGEQDASLNISYISDYQHSQPVDPMGISSYTTADAQYGFRVMEDALGLSIGVKNLTDEKPPRVSDAANFSYDPKQHSPLGRVFYLKAKYSF

SEQ ID NO: 16880 - protein, 107 aa, Thiomicrospira crunogena
  misc_feature (28)..(28): Xaa can be any naturally occurring amino acid
  misc_feature (96)..(97): Xaa can be any naturally occurring amino acid
  misc_feature (105)..(105): Xaa can be any naturally occurring amino acid
ADNLTAISGLVNVYYDVAMEDMPITPYXGVGVGAAYISTPLKTPINDQKSKFGFAGQVKAGVSYDVTPEIKLYAGARYFGSYGANFDGKKTDPKDXXKQVTDAGXYK

SEQ ID NO: 16881 - protein, 379 aa, Thiomicrospira crunogena
MKKNIFKFSVLTLAVLSLTACTLVPGQNLSTSNKDVIELPDNQYDLDKMVNIYPVTPGLIDQLRAKPIMSQANPELEQQIANYEYRIGIGDVLMVTVWDHPELTTPAGQYRSASDTGNWVNADGAIFYPYIGRLKVAGKTLTQVRNEITARLDSVIESPQVDVSVAAFRSQKAYVTGEVSKSGQQPITNIPLTIMDAINAAGGLTADADWRNVVLTQNGVKTKVNLYALMQRGDLRQNKLLHPGDILFIPRNDDLKVFVMGEVGKQSTLKMDRSGMTLAEALGNAEGMNQDVADATGIFVIRATQNKQNGKIANIYQLNAKDASAMILGTEFQLEPYDIVYVTTAPLARWNRVISLLVPTISGVHDLTETSRWIQTWPN

SEQ ID NO: 16882 - protein, 295 aa, Thiomicrospira crunogena
MKKTQKISLALFLSVYASSPLAQTNALEEVVVTATKRAQSLQDVPMAVNAFNADTIETAGINDAGDLAILTPALNINVNTNPFAARMVIRGVGTAQTDPALEPSVGLFIDGIYLGRTGLGMSDLTDIERIEVLQGPQGTLYGKNTNAGAISVITKKPSFEKSEGYIEASVGNYSMNKLTASISGPLTQNLAYRLSGNINQRDGYYDNSAGVDFNDADDWNIQGKLQWEPTESLSILLSGSRVERDTTCCGADAVQDEPVNNELVAQGLSPDSNDPYDYTCRACGHRFAWSLICCL

SEQ ID NO: 16883 - protein, 673 aa, Thiomicrospira crunogena
MRHLRFLLTAACVGLIAGPAWADDAAEIVVTGQGLPRSPGDAAFDVISIDRARLEASASGRMEDILRDAAGFQQFRRSDARSAHPTSQGATLRGLGGNASTRALILLDGVPMVDPFGGWVSWAALDPARIGHVRVTRGGGSGVYGPGALAGTIELSSMSPDEAHAVDASVAYGSRDSIDADATVTARLGGGFLMLSGGHAQGDGFIPVVEEDRGPIDRAARYKQSRAAARAVIPVGAETELQANGSFLLDRRDRGVPFTGNSNLAVDSSIRLVGRGRWGWEATAWLQHREFSSGFASIGAGRATVSQSLDQYNVPANGFGGRIELRPPLGEGISLRIGGDARHVNGRTEERVVSTNANRVAGGEQNVFGGFAELALLPATGLTLTASGRVDHWQLRDGQRTEISRATGALIAANSARYPDRSGTEATGRAGIAWSPPGAAAVSLRAAAYTGWRLPTLNELYRPFRAGNDSTIANPLLDPERVKGIEGGAEYAPLPGWKLGATIFWNRLDDAISNVTIAPNTRQRQNVDAIRSRGIEVDGMATLGEWRAIASYSHIDPRVRASGAALGLAGLRPAQTPRDQASASIEWNRPDTARIGVTARYVASQYEDDQNSRRLDDALTFDAVAALDLGRGFTAELRGENIANKRVEATVGADGTVERATPRTLWVALKYRR

SEQ ID NO: 16884 - protein, 525 aa, Synechococcus elongatus
MKNLFKVMLAALWPTIVAFAGAAQAESLNRDTINQVNAIANEELPAAQVTSITQLSDVKPTDWAYQALQSLVERYGCIVGYPDRTYRGSRALTRYEFAAGLNACLDKVIEFAASKEDLDTLKKLMEEFQAELATLRGRVDSLEARVTELEATQFSTTTKLQGEVILSLDRAFGPSGLDTGTSFSQRVSLNLNTSFTGKDLLKTRLRSNSITSPGLRDFNGGVPGSGIISPAAALDYDNATNAPNANFFLDTLLYTFPVGDVKFTVGTSNLQVEDILSTTGTFYAPYISYFFSTPIPGIYGDADTTNSAGAGFNWQLSKNFNFGAAYINQNGPTTGGNLASDPTSGVFGADSQTTAQLAFKNDSGTFIGALAYAYRKGPDLATDLSFLPSQFGGVNFGTLLVLWLGLGAPVHHQRSYGISFGNGFGANNTVQSWTVGFTFPNLFADGNEFGFAVGQAPYVISDSRGAAFQDSGNFAFEVYYKLQVTDNISITPALYAITNAGGGLSFPDSANGDFIVPVIKTVFTF

SEQ ID NO: 16885 - protein, 788 aa, Synechococcus elongatus
MHVLMVKLSMSVMPPGLRRIVWSMSVTSLGCALSMNAGAASTAPQKRAVGVHGRPEAAAGSGSGTAQPVKTEEVTVSVRRRSEPLQKVPVATSVYTASQARRDNVHDLQGIFEFVPSANFRANASSKDRAIFIRGIGTISTSPGVEPSVSTVIDGVVLARPGMATTDIVGLSQVEVMRGPQGTLFGKNASAGAVNIVTDRPTADFHAYTEGSYFSGNEYRLTGGVSGTLVPSKLIANADFLVGGFDGNVTNIASNTMVNGYEHRGVRSKFLWTPDDRTQVTLGLDYMYQNDLVPSGVYSSTSQIAFPTNVATSNPTLAAALKAEGITPSRNNTEVSNNIQSRSVDHSGGASITLDREFAGGYKLTSISGYRRWQNVQDQDYDGLGSVPAGVTNVHDHGLLNFWQASEEARVASPRGHFFDYVAGFYYLHSLDQEVYSRDVLVGTPATPNPGYGVSHYGIANNNYAVFAEGNLNFTKRFRGILGLRLLRDDLAYNMARNSTATAANPVLGIRPSYASTGSTSQNGYVDRIGLQYDVLSDMQAYFTYSHGYKGPAYNTFFNMQATDAQVLRPEQNNTYEIGLKSQFWHRRITANFAAFIEDFSNFQANFLDNVNGGAVYRMINAGSVSSKGVEGDISAHVLRDLTLGGNLTYDYAVVDRFNCPAGAPASCNVNGEPLPFAPRWKFVLNADYTRALNDRFSVSVDSDYTWQSRTQFALTETPDTVQKAYGIWNMSTTLRDSKLRLQLSLVMRNAINTHYLSYISYGVLGGTADFLPRDYGRYGGFVLRKEF

SEQ ID NO: 16886 - protein, 315 aa, Shigella boydii serotype 4
MKLKFLVLALCVPAIFTTHATTNYPLFIPDNISTDISLGSLSGKTKERVYHPKEGGRKISQLDWKYSNATIVRGGIDWKLIPKVSFGVSGWTTLGNQKASMVDKDWNNSNTPQVWTDQSWHPNTHLRDANEFELNLKGWLLNNLDYRLGLIAGYQESRYSFNAMGGSYIYSENGGNRNKKGAHPSGERTIDYKQLFKIPYIGLTANYRHENFEFGAELKYSGWVRSSDTDKHYQTETIFKDEIKNQNYCSVAANIGYYVTPSAKFYIEGSRNYISNKKGDTSLYEQSTNISGTIKNSASIEYIGFLTSAGIKYIF

SEQ ID NO: 16887 - protein, 241 aa, Shigella boydii serotype 4
MKFMKKAKILSGVLLLCFSSPLISQAATLDVRGGYRSGSHAYETRLKVSEGWQNGWWASMESNTWNTIHDNKKENAALNDVQVEVNYAIKLDDQWTVRPGMLTHFSSNGTRYGPYVKLSWDATKDLNFGIRYRYDWKAYRQQDLSGDMSRDNVHRWDGYVTYHINSDFTFAWQTTLYSKQNDYRYANHKKWATENAFVLQYHMTPDITPYIEYDYLDRQGVYNGRDNLSENSYRIGVSFKL

SEQ ID NO: 16888 - protein, 1285 aa, Shigella boydii serotype 4
MNKIYSLKYSHITGGLVAVSELTRKVSVGTSRKKVILGIILSSIYGSYGETAFAAMLDINNIWTRDYLDLAQNRGEFRPGATNVQLMMKDGKIFHFPELPVPDFSAVSNKGATTSIGGAYSVTATHNGTQHHAIKTQSWDQTAYKASNRVSSGDFSVHRLNKFVVETTGVTESADFSLSPEDAMKRYGVNYNGKEQIIGFRAGAGTTSTILNGKQYLFGQNYNPDLLSASLFNLDWKNKSYIYTNRTPFKNSPIFGDSGSGSYLYDKEQQKWVFHGVTSTVGFISSTNIAWTNYSLFNNILVNNLKKNFTNTMQLDGKKQELSSIIKDKDLSVSGGGELTLKQDTDLGIGGLIFDKNQTYKVYGKDKSYKGAGIDIDNNTTVEWNVKGVAGDNLHKIGSGTLDVKIAQGNNLKIGNGTVILSAEKAFNKIYMAGGKGTVKINAKDALSESGNGEIYFTRNGGTLDLNGYDQSFQKIAATDAGTTVTNSNVKQSTLSLTNTDAYMYHGNVSGNISINHIINTTQQHNNNANLIFDGSVDIKNDISVRNAQLTLQGHATEHAIFKEGNNNCPIPFLCQKDYSAAIKDQESTVNKRYNTEYKSNNQIASFSQPDWESRKFNFRKLNLENATLSIGRDANVKGHIEAKNSQIVLGNKTAYIDMFSGRNITGEGFGFRQQLRSGDSAGESSFNGSLSAQNSKITVGDKSTVTMTGALSLINTDLIINKGATVTAQGKMYVDKAIELAGTLTLTGTPTENNKYSPAIYMSDGYNMTEDGATLKAQNYAWVNGNIKSDKKASILFGVDQYKEDNLDKTTHTPLATGLLGGFDTSYTGGIDAPAASASMYNTLWRVNGQSALQSLKTRDSLLLFSNIENSGFHTVTVNTLDATNTAVIMRADLSQSVNQSDKLIVKNQLTGRNNSLSVDIQKVGNNNSGLNVDLITAPKGSNKEIFKASTQAIGFSNISPVISTKEDQEHTTWTLTGYKVAENTASSSAAKSYMSGNYKAFLTEVNNLNKRMGDLRDTNGEAGAWARIMSGAGSASGGYSDNYTHVQIGVDKKHELDGLDLFTGLTMTYTDSHASSNAFSGKTKSVGAGLYASAIFDSGAYIDLISKYVHHDNEYSATFAGLGTKDYSSHSLYVGAEAGYRYHVTEDSWIEPQAELVYGAVSGKRFDWQDRGMSVTMKDKDFNPLIGRTGVDVGKSFSGKDWKVTARAGLGYQFDLFANGETVLRDASGEKRIKGEKDGRILMNVGLNAEIRDNLRFGLEFEKSAFGKYNVDNAINANFRYSF

SEQ ID NO: 16889 - protein, 234 aa, Shigella boydii serotype 4
MLMIIKKSGGRWQLSLLASVVISAFFLNTAYAWQQEYIVDTQPGHSTERYTWDSDHQPDYNDILSQRIQSSQRALGLEVNLAEETPVDVTSSMSMGWNFPLYEQVTTGPVAALHYDGTTTSMYNEFGDSTTTLADPLWHASVSTLGWRVDSRLGDLRPWAQISYNQQFGENIWKAQSGLSRMTATNQNGNWLDVTVGADMLLNQNIAAYAALSQAENTTNNSDYLYTMGVSARF

SEQ ID NO: 16890 - protein, 448 aa, Shigella boydii serotype 4
MVMSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIRQSPAWLTPQGQALAATANGIDSNTKIAHLNGNQWGFGWNAGILYELDKNNRYALTYRSEVKIDFKGNYSSDLNPAFNNYGLPIPTATGGATQSGYLTLNLPEMWEVSGYNRVAPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 16891 - protein, 246 aa, Shigella boydii serotype 4
MKKTAIAIAVALAGFATVAQAAPKDNTWYTGAKLGWSQYHDTGFIPNNGPTHENQLGAGAFGGYQVNPYVGFEMGYDWLGRMPYKGDNINGAYKAQGVQLTAKLGYPITDDLDIYTRLGGMVWRADTKANVPGGASFKDHDTGVSPVFAGGVEYAITPEIATRLEYQWTNNIGDANTIGTRPDNGLLSLGVSYRFGQGEAAPVVAPAPAPEVQTKHFTLKSDVLFNFNKATLKPEGQAALDQLYSQ

SEQ ID NO: 16892 - protein, 362 aa, Shigella boydii serotype 4
MMKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEESSLGKGKKAEQWATGLKYDANNIYLAANYGETRNATPITNKFTNTSGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 16893 - protein, 1042 aa, Shigella boydii serotype 4
MNGSDFSLPGGPMNRWENIQLTHENRLAPRAYFFSYDSVAQARTFARETSSLFLPLSGQWNFHFFDHPLQVPEAFTSELMADWGHITVPAMWQMEGHGKLQYTDEGFPFPIDVPFVPSDNPTGAYQRIFTLSDGWQGKQTLIKFDGVETYFEVYVNGQYVGFSKGSRLTAEFDISAMVKTGDNLLCVRVMQWADSTYVEDQDMWWSAGIFRDVYLVGKHLTHINDFTVRTDFDEAYCDATLSCEVVLENLAASPVVTTLEYTLFDGERVVHSSAIDHLAIEKLTSASFAFTVEQPQQWSAESPYLYHLVMTLKDANGNVLEVVPQRVGFRDIKVRDGLFWINNRYVMLHGVNRHDNDHRKGRAVGMDRVEKDLQLMKQHNINSVRTAHYPNDPRFYELCDIYGLFVMAETDVESHGFANVGDISRITDDPQWEKVYVERIVRHIHAQKNHPSIIIWSLGNESGYGCNIRAMYHAAKALDDTRLVHYEEDRDAEVVDIISTMYTRVPLMNEFGEYPHPKPRIICEYAHAMGNGPGGLTEYQNVFYKHDCIQGHYVWEWCDHGIQAQDDNGNVWYKFGGDYGDYPNNYNFCLDGLIYSDQTPGPGLKEYKQVIAPVKIHALDLTRGELKVENKLWFTTLDDYTLHAEVRAEGETLATQQIKLRDVAPNSEAPLQITLPQLDAREAFLNITVTKDSRTRYSEAGHSIATYQFPLKENTAQPVPFAPNNARPLTLEDDRLSCTVRGYNFAITFSKTSGKPTSWQVNGESLLTREPKINFFKPMIDNHKQEYEGLWQPNHLQIMQEHLRDFAVEQSDGEVLIISRTVIAPPVFDFGMRCTYIWRIAADGQVNVALSGERYGDYPHIIPCIGFTMGINGEYDQVAYYGRGPGENYADSQQANIIDIWRSTVDAIFENYPFPQNNGNRQHVRWTALTNRHGNGLLVVPQRPINFSAWHYTQENIHAAQHCNELQRSDDITLNLDHQLLGLGSNSWGSEVLDSWRVWFRDFSYGFTLLPVSGGEATAQSLASYEFGAGFFSTNLHSENKQ

SEQ ID NO: 16894 - protein, 374 aa, Shigella boydii serotype 4
MAALLGSASTLHAGGIDRSGQSITALFESGRYAEFSLGSVSPNTSGVGVQATPGVKSGNMTDNFFTFGAAYKADINDQLSYAIIYDQPFGADVAYDTGTGYFAAGSTATFDSDALTALLRYKTPNNFSVHGGIRVQRIEASALIPFVTAAPNPNNPFITNPGAPYSVKGDQETGVGYVAGVAYEKPEIAMRVSLTYNSKISYDVDTTENSALGMGVKSTTEVDTPQSLNLEFQTGIAADTLLFGGVRWTDWSSFEIAPQQYATLTRGGKLLSYDDDVYSYSLGVGRRLNDTWSVAASIGYEKSEGGFSSNLGPTDGNKSLALAATYSRDNVKITTGIRYINIGDAETEAGLASPAATFEDNDAVAIGVKVGFTF

SEQ ID NO: 16895 - protein, 108 aa, Shigella boydii serotype 4
MESKSVDTRSLYRELGATLSYNMRLGNGMEVEPWLKAAVRKEFVDDNRVKVNSDGNFVNDLSGRRGIYQAGIKASFSSTLSGHLGVGYSHGAGVESPWNGVAGVNWSF

SEQ ID NO: 16896 - protein, 308 aa, Shigella boydii serotype 4
MGVDFRDKQLIENPPGHYTNALSKMHTNFQFMRITPAVSYKINEMISVGGALHIAWGSLDVGAEMCQFEDTDGDMMPSPTRCWNAGGGQSQDFGIGVSLGIAFNMGDFIYAGLMYQSPVSMKYKNVFDSNGDGKFEDMKLQQPQEVGLGIGVKPLENLKLGLDIRWIDWSGADGYGDFDWEDQWVFGLGVEYKPMDSLALRAGWNYGKTPIRDKDNLDPMTPKNSVPSFDTRFSDFQLYWFNLVGFPAFAEHHLTLGLNWKITPNFNIDLSYVYALPKTVTAKAAQGAGEVSTKMVQHSIGVGLNWAF

SEQ ID NO: 16897 - protein, 185 aa, Shigella boydii serotype 4
MRKVCAAILSAAICLAVSGAPAWASEHQSTLSAGYLQPHTDMPGSDDLKGINVKYRYEFTDTLGLVTSFSYANAEDEQKTHYSDTRWHEDSVRNRWFSAYAMAGVAYSRVSTFSGDYLRVTDNKGKTHDVLTGSDDNRHSNTSLAWGAGVQFNPTESVAIDLAYEGSGSGDWRTDGFIVGVGYKF

SEQ ID NO: 16898 - protein, 790 aa, Shigella boydii serotype 4
MKRVLIPGVILCGADVAQAVDDKNMYMHFFEEMTVYAPVPVPVNGNTHYTSESIERLPTGNGNISDLLRTNPAVRMDSTQSTSLNQGDIRPEKISIHGASPYQNAYLIDGISATNNLNPANESDASSATNISGMSQGYYLDVSLLDNVTLYDSFVPVEFGRFNGGVIDAKIKRFNADDSKVKLGYRTTRSDWLTSHIDENNKSAFNQGSSGSTYFSPDFKKNFYTLSFNQELADNFGVTAGLSRRQSDITRADYVSNDGIVAGRAQYKNVIDTALSKFTWFASDRFTHDLTLKYTGSSRDYNTSTFPQSDREMGNKSYGLAWDMDTQLAWAKLRTTVGWDHISDYTRHDHDIWYTELSCTYGDITGRCTRGGLGHISQAVDNYTFKTRLDWQKFAVGDVSHQPYSGAEYIYSDAWTERHNQSESYVINAAGKKTNHTIYHKGKGSLGIDNYTLYMADHISWRNVSLMPGVRYDYDNYLSNHNISPRFMTEWDIFADQTSMITAGYNRYYGGNILDMGLRDIRNSWTESVSGNKTLTRYQNLKTPYNDELAMGLQQKIGKNVIARANYVYRAAHDQISKSSRTDSATKTTITEYNNDGKTKTHSFNLSFELAEPLHIRQVDINPQIVFSYIKSKGNLSLNNGYEESNTGDNQVVYNGNLVSYDSVPVADFNNPLKISLNMDFTHQPSGLVWANTLAWQEARKARIILGKTNAQYISEYSDYKQYVDEKLDSSLTWDTRLSWTPQFLKQQNLTISADILNVLDSKTAVDTTNTGVATYASGRTFWLDVSMKF

SEQ ID NO: 16899 - protein, 338 aa, Shigella boydii serotype 4
MRKTVVAASIIGTMMALPVVADDGFYLGGRLGGSQLSDACNVSAAPCTDSGFSAGVYTGYDWNDYIALEFAYDWLGSYETSFVDGAEYRRDANLSALTLAPKFSYPFNDEWAIFGKVGAAYTMYDDRKSTALMGGVGLEYDFATAWSGRLEYQRINDAKDDWFNTDVDTFWLGISYSFGSASEAAATAAAASSTQEASAEEPHVAEAVVMTKTFEQVSGQENFEFNSTKLNENTKSDYDPLIALMQDHPDSTVTITGYTDSSGPEEVNQRISEERAESIAAYLESQGIDRSRMTVSGMGEANPIADNSTKEGRAQNRRVEITVPEFEYTTEEMVEKAQ

SEQ ID NO: 16900 - protein, 679 aa, Shigella boydii serotype 4
MSVALPLLSRCPLALTLAFCCAPALAQQQPGADAVELDAVNVRGEGVETSTALSGFGATRLLDAPASIAVIDRAQLLDRQARVLSEVLRADASAGDAYAPIGYYENFVVRGYSLNAANSYRINGMSAVGEQSIALENKQQVQLLKGLAGLQSGVNEPAGLIDYRTKRPEHVRSVTLGTDEQGSRYVAADLGDWFGAERTLGLRVNAAREDIDSYVDHADGYRNFLSLAGDWKISPQALLQLDVEYQHRQQRSVPGYQLLGGTQVPRDIDVHRLLGYQPWARPVEMDSLDAQLRYAYQFNDDWRATTEASRSRSKINDFSAFAWGCYGAASCADIATPNVFSAQGEYDIYDYRSPDDTRVHDQLRATLEGHVATGALEHHLSIGGEWLRRTIDRFGSVNEFVGSGSIDRDPDVFAQTDVALDPKQRRLDSRQRALLMADRIGLGAGNCRLARAMCNWTNAASIATASWNDARAKTRCCRRQRCCSSRSRTCRCMPATPRAWRPAARRRGLPITPTRSCRPPMRTSWKPAQRSTCRACAWARHCSTSARLTSSPNRRPMAVCSTCSRVACITAAWSCLPTAQRPGSCVCSPASRQSARARRTPALASTKAIRRSTCPGCAPACRPITACQVSMVWHCWAACNTAGASLPTVSATPACRPTPSPTWVPATPRRWAGWRLPGA

SEQ ID NO: 16901 - protein, 186 aa, Shigella boydii serotype 4
MNVSKYVAIFSFVFIQLISVGKVFANADERMTTFRENIAQTWQQPEHYDLYIPAITWHARFAYDKEKTDRYNERPWGGGFGLSRWDEKGNWHGLYAMAFKDSWNKWEPIAGYGWESTWRPLADENFHLGLGFTAGVTARDNWNYIPLPVLLPLASVGYGPVTFQMTYIPGTYNNGNVYFAWMRFQF

SEQ ID NO: 16902 - protein, 746 aa, Shigella boydii serotype 4
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKAAQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSINTHF

SEQ ID NO: 16903 - protein, 423 aa, Shigella boydii serotype 4
MLDTRRGAAGAALLLLAQGTAQGGFIEDSQGSLTLRNFYFDRDYKGESNVSARREWAQGFILNLKSGFTEGPVGFGLDLQGMLGVQLDSSRDRAGTGLLPVERGSGEAQDSYAELGLTGKLRYSQTELHVGTVMPRLPILISSPARLLWQTFKGGHLRSTDIPGLSLQAGYLNRMNQRDSTDYQKIAIAGPNGRFDGTAESDEFLFLGGDYALGKNLTLSYWHARLDEIYQQNYLGAIHQFKWGPGEFKTDFRWFLSDEEGEGKAGSVDNQYVGLNFGYKLGGHRLTVGGALSSGDSAMPYIAGSEPHLISEYAISSEFLNADEHFWHVRYEYDFAAAGLPGLIGVARFMKGTNAELPERLGGGNREETERYLELSYVVQSGPLKNVALRLRNSRYQNSFAPNATMRDDNETRINVDYTWKLW

SEQ ID NO: 16904 - protein, 351 aa, Shigella boydii serotype 4
MKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 16905 - protein, 747 aa, Shigella boydii serotype 4
MARSKTAQPKHSLRKIAVVVATAVSGMSVYAQAAVELKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLDLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 16906 - protein, 326 aa, Shigella dysenteriae serotype 1
MDISTKKVEFSMKLKFFVLALCVPAIFTTHATTNYPLFIPDNISTDISLGSLSGKTKERVYHPKEGGRKISQLDWKYSNATIVRGGIDWKLIPKVSFGVSGWTTLGNQKASMVDKDWNNSNTPQVWTDQSWHPNTHLRDANEFELNLKGWLLNNLDYRLGLIAGYQESRYSFNAMGGSYIYSENGGSRNKKGAHPSGERTIGYKQLFKIPYIGLTANYRHENFEFGAELKYSGWVLSSDTDKHYQTETIFKDEIKNQNYCSVAANIGYYVTPSAKFYIEGSRNYISNKKGDTSLYEQSTNISGTIKNSASIEYIGFLTSAGIKYIF

SEQ ID NO: 16907 - protein, 165 aa, Shigella dysenteriae serotype 1
MNQIFMVIFLVLSGFIVGNVWSDRGWQKKWAERDAAALSQEVNAQFAARIIEQGRTIARDEAVKDAQQKSAEISARAAYLSDSVNQLRAEAKKYAIRLDAAKHTADLAAAVRGKTTKTAEGMLTNMLGDIAAEAQLYAEIADERYIAGVTCQQIYESLRDKKHQM

SEQ ID NO: 16908 - protein, 774 aa, Shigella dysenteriae serotype 1
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEGHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYVNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 16909 - protein, 448 aa, Shigella dysenteriae serotype 1
MVMSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIMQSPAGQTQQGQALAATANGIDSNTKIAHLNGNQWGFGWNAGILYELDKNNRYALTYRSEVKIDFKGNYSSDLNRAFNNYGLPIPTATGGATQSGYLTLNLPEMWEVSGYNRVDPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 16910 - protein, 720 aa, Shigella dysenteriae serotype 1
MVDKLIHPWDLDLLVSGRQKDPHKLLGILASEDSSDHIVIFRPGAHTVAIELLGELHHAVAYRSGLFFLSVPKGIGHGDYRVYHQNGLLAHDPYAFPPLWGEIDSFLFHRGTHYRIYERMGAIPMEVQGISGVLFVLWAPHAQRVSVVGDFNFWHGLVNPLRKISDQGIWELFVPGLGEGIRYKWEIVTQSGNVIVKTDPYGKSFDPPPQGTARVADSESYSWSDHRWMERRSKQSEGPVTIYEVHLGSWQWQEGRPLSYSEMAHRLASYCKEMHYTHVELLPITEHPLNESWGYQVTGYYAPTSRYGTLQEFQYFVDYLHKENIGIILDWVPGHFPVDAFALASFDGEPLYEYTGHSQALHPHWNTFTFDYSRHEVTNFLLGSALFWLDKMHIDGLRVDAVASMLYRDYGREDGEWTPNIYGGKENLESIEFLKHLNSVIHKEFSGVLTFAEESTAFPGVTKDVDQGGLGFDYKWNLGWMHDTFHYFMKDPMYRKYHQKDLTFSLWYAFQESFILPLSHDEVVHGKGSLVNKLPGDTWTRFAQMRVLLSYQICLPGKKLLFMGGEFGQYGEWSPDRPLDWELLNHHYHKTLRNCVSALNALYIHQPYLWMQESSQECFHWVDFHDIENNVIAYYRFAGSNRSSALLCVHHFSASTFPSYVLRCEGVKHCELLLNTDDESFGGSGKGNRAPVVCQDQGVAWGLDIELPPLATVIYLVTFF

SEQ ID NO: 16911 - protein, 362 aa, Shigella dysenteriae serotype 1
MMKRNILAVIVPALLVAGTANAAEIYNKDGNKVDLYGKAVGLHYFSKDNGVNSYGGNGDKTYARLGFKGETQINSDLTGYGQWEYNFQGNNSEGADAQTGNKTRLAFAGLKYADIGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQPLGNGKKAEQWATGLKYDANNIYLAANYGETRNATPITNKFTNTSGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 16912 - protein, 729 aa, Shigella dysenteriae serotype 1
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQQFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGTPRNFSITGTYQF

SEQ ID NO: 16913 - protein, 845 aa, Shigella dysenteriae serotype 1
MRLARLLSTSALFAFGTVSAFAAPADSTASSNKKSPTKVAAAAPSMMGNTAPTDEHEEHVSVSGHHTYFDGVTRRDVGGGLMQKQDSAKSVSAISRDYIEKQAPGQDPMQLIALLPGANVSSSDPAGLTGSHMSARGLDQSQMGFTLEGFPINDIGSFSVYSQEIVDSENLRKVSLAQGSADLDSPHLSATGGVVDMYMIDPKMKKGGAFDVSYGSYDYTRGFLRLDTGKIGQTNLRAYFSGSYATEDAIHSMATNRKLHAEAKFVNDWGDGNRVSLAIVGNRLYNYLTPSVNQASWETYGFGVKDQYIAPCYSGSTCTRPNGTTFKNTSGSTISNTSYNGVYKDPTGKTTAGDASYYKLHQNPFTNIYASAPSTFKLTDHLVLTETPYFWYGDGSGGAAYSLPTSWGATSMSGTLDGKTQTKGSLIYEPSITTTYRPGAVTKLTLTTGVNRLMVGYWFEYAKQSQTAPATGIASDGTPWNLWGAGPNFVFNDGTTYQYRQSLTQTRTHTMFIGDSLSLLHNKLTIDGGLKYAIVTRDAHNMLPDTSTGPYINKTYYQPLPTAAIRYQINPEMQVFVSGSTNFRIPTNYSLYDAGTYYKNGGYSTHGSTNLQPEISISEEAGWRYTGPTVMASVTYFHYNFTNRFFSQSECLDESCSSYATGSINAGGQSTNGVDAEVGTRPIFYHIRPYVSFEYVDARTTSNLRAGSGSSIDYLPTKGKFAPETPKYQVGFNLDYDDGNVFGAYNLKYVAKQYSTFMNDESIPGYVKMNITVGYRFKNLGFLQAPNVKLNLTNITNKHYLGFPIGLQTNATTMRGIFGNTVKGSTPTYMIAAPFAATGSISAGF

SEQ ID NO: 16914 - protein, 67 aa, Shigella dysenteriae serotype 1
MTTYDRNRNAITTGSRVMVSGTGHTGKILSIDTEGLTAEQIRRGKTVVVEGCEEKLAPLDLIRLGMN

SEQ ID NO: 16915 - protein, 690 aa, Shigella dysenteriae serotype 1
MVINKAFGLHLLLLSFVGFSQEKQLSDSVKVATLNDVVITATRTERQLSSLPLPISIITSADISKAGISRLNEILTEQTGLITVPDFGGAEGIQVQGLDAAYTLILIDGVPLVGRSAGTLDLSRISVGNIDRIEIVKGASSSLYGSEALAGVINIITKKPKSDHFSGNLSYRYASFNTHDATANFVWKKKKFSGSFFTNYFDTNGYDLDKKNSLQTVEPYYNTTIQPKLYYDFSDKLKLIVGTRFYHQKQDNKTIINNKNYQGDAVINEWNSQIKLEHNWNSKINSEYEIYLTNYKTDAFLNNSKNILFEESFYDQWLIRPEIRTTFSINNNKLTAGIGINHETLDRTYFGINANFNSQYGFLQYDYNPSKKWNILAGFRYDNHNQYKSQLSPKIAINYKVTDHLSLKTAVGYGFKAPDFRQLYFDFTNSSVGYTVLGYNVADTRLNALDNQGQILKRIKDISFDNPLKPESSLNFNLGIFYQRSKLKIEVNAFYNAISNLIDTRAIAIKYTGQNVFSYYNVGKIFTYGTEFNSAYSFSNNLKISLGYQYLIAKDKSVIDDFETHQYIRDSQTLETIKINKVAYFGLFNRSKHTANVKFLYMIPKIKTDINLRVFYRSKYGLFDTNNNQILDVYDDFVKGYFITNVSISKQIKEKFSFQVGANNLLDYTNPKEISNLSGRQIFGKLQFNF

SEQ ID NO: 16916 - protein, 212 aa, Shigella dysenteriae serotype 1
MKKLTVAALAVTTLLSGSAFAHEAGEFFMRAGSATVRPTEGAGGTLGSLGGFSVTNNTQLGLTFTYMATDNIGVELLAATPFRHKIGTRATGDIATVHHLPPTLMAQWYFGDASSKFRPYVGAGINYTTFFDNGFNDHGKEVGLSDLSLKDSWGAAGQVGVDYLINRDWLVNMSVWYMDIDTTANYKLGGAQQHDSVRLDPWVFMFSAGYRF

SEQ ID NO: 16917 - protein, 705 aa, Shigella dysenteriae serotype 1
MRLKITLICIRFRRANANVLFGTRMPARSGPRCPNADQFLKDRYEQEELGGCTDGHRRRHGRTERGRCAGAVAPRDRNLRTTDESAVPRARLDERDAHRHRRDGDSVRRQQRRREADPDGRGNARRRPVRLGRRRRAAEQFRRTVGQLRGARLRRRRQHVGHRLPRERVLVEPRDERAARHREHRADGSAQGAGVRAVRPRRPRRPDQLYDEAAAVRAREHDRRVGRQLRRAARDARFDRPRHEIARLPLRRDETKDNGSFRDTVSSKRYLFAPSFTWDIDADTTLHYEFETVRQRAPLDRGVLAVNGQLGAIPASRFLGEPRDGDYDVRNSGHQFTLEHRFNADWSINAGFAQRDTDLSGRSSEAFALQPDGRTLWRRYRQVAFHSNDVQGRVEVAGNARTAGIAHTFVMGVDAYRFNYDQFVARSTPTAAAPYAIDIFDPVYGQPAPAVRTATNLLERDDGQGLYAQGHARVSGRTGRVLAGLRWDRFHQSVENRLKGVTTSQLQTALSPRIGIVYEASAALSLYANTAYSFRPNNGADANGHAFDPEKGHGYEAGVKWAGTRWLATVAAFYVNKRNVLTADPANPGFSRAAGEVRSRGVEFEWNGELGHGLRGIVNFAYVDAQVTRDTVLTPGARLVDIPRLSGSALLMYETALPLVDKAGAGAGVIYVGRRAGNTANTQDGFDLPAYATVQLNGYVQVNKR

SEQ ID NO: 16918 - protein, 777 aa, Shigella dysenteriae serotype 1
MAFRRTCLLACAASLLPQLAAAQTASPPAEAEAAVTGAADSGEIIVTARRRAESLQDVPISVSAISGKALTQGGVTDALSFQSRVPSLSLTNQGTTRSELGFSIRGQRTQESQLLTDPPVGTYFAEVVQARSTGFANTLYDLESVQVLKGVQGTLFGRNMTGGAVLVEPAKPTDQLAAEVRGQIGNFDLRDAYAMLNLPISDGIAVRFAGKTHERDGFTKDVSSGRDYDDQNYDTFRVSLAINPAENIESTTIFDWVRTREHGTALVGTAANPAAPAIAGYAALRGFGIPVSDVLAQFAAQAARPHYRFDTAAGEDGTLDAYGVKPFEHLKNYGITNRSSIDLGGVTIKNIFGYRRLKFNQIMDLDGVPAFLINSNRFRDIKQYSEELQAQGKAFDDRLTYVVGAYYFLEKGTDGSTSSQFPELAIAGQGLPLTTPASTFLNAYVGQGRAKTGALYAAGTYNFTNQFKLSAGIRYTEDKRRATVTAYYPNLGACLFRLADGTTPSLANCPQTNAKKWDDVTWDVTLQYEPNDGLTAYVSTRRGFRAGGFSLRAASTAELAPFNPETVQEYEIGLKNRADLGGGAALRTSLALFYQDYKNVQKQASSIDAAGNVNTIITNTARQKHYGGELEATLSAGAIDLTAFYSYVKVDISKGRQPGEFELVGAPHHQLGANLSYRLPLSESVGAASLNANVAYRSKQHLDKNDVLATEPGYALVNLRANLDNIAGTGFGAALFVNNATDKYYRIGVIGIYNEAGYISSVYGEPRTYGLEVSYRF

SEQ ID NO: 16919 - protein, 725 aa, Shigella dysenteriae serotype 1
MRINKILWSLTVLLVGLNSQISVAKYSDDDNDETMVVEATAEQVLKQQPGRVVITSEDIKKTPPVNDLSDIIRKMPGVNLTGNSASGTRGNNRQIDIRGMGPENTLILIDGVPVTSRNSVRYSWRGERDTRGDTNWVPPEQVERIEVIRGPAAARYGSGAAGGVVNIITKRPTNDWHGSLSLYTNQPESSEEGATRRANFSLSGPLAGDALTTRLYGNLNKTDADSWDINSPVGTKNAAGHEGVRNKDINGVISWKLNPQQILDFEAGYSRQGNIYAGDTQNSSSSAVTESLAKSGKETNRLYRQNYGITHNGIWDWGQSRFGVYYEKTNNTRMNEGLSGGGEGRILAGEKFTTNRLSSWRTSGELNIPLNVMVDQTLTVGAEWNRDKLDDPSSTSLTVNDRDISGISGSAADRSSKNHSQISALYIEDNIEPVPGTNIIPGLRFDYLSDSGGNFSPSLNLSQELGDYFKVKAGVARTFKAPNLYQSSEGYLLYSKGNGCPKDITSGGCYLIGNKDLDPEISVNKEIGLEFTWEDYHASVTYFRNDYQNKIVAGDNVIGQTASGAYILKWQNGGKALVDGIEASMSLPLVKDRLNWNTNATWMITSEQKDTGNPLSVIPKYTINNSLNWTITQAFSASVNWTLYGRQKPRTHAETRSEDTGGLSGKELGAYSLVGTNFNYDINKNLRLNVGVSNILNKQIFRSSEGANTYNEPGRAYYAGVTASF

SEQ ID NO: 16920 - protein, 350 aa, Shigella dysenteriae serotype 1
MKKTAIAIAVALAGFATVAQAAPKDNTWYTGAKLGWSQYHDTGFIPNNGPTHENQLGAGAFGGYQVNPYVGFEMGYDWLGRMPYKGDNINGAYKAQGVQLTAKLGYPITDDLDVYTRLGGMVWRADTKANVPGGASFKDHDTGVSPVFAGGVEYAITPEIATRLEYQWTNNIGDANTIGTRPDNGLLSLGVSYRFGQGEAAPVVAPAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 16921 - protein, 352 aa, Shigella dysenteriae serotype 1
METYLMKKRLIALAALALVSGMASAQSSVTVYGNIDIGVLTQNNAPAGGSSTSIANGGISPSIWGFRGSEDLGDGLKATFNLEGHFYADTGASDPRLFRRQSNVGLSSATLGTLTLGNQYSPAILAFAATDPRGLRENFSGLYPWAYNSGALTTGNNGNNDVGVFLQNAVSYSNKFGPVGIAGAYSTSETKGAVYSLGATYTGPVSLSAAYQATNLANTSERGSTIYTVGAGYTMGAFTGKLNYLRGTNKNAALVETSKVGVTGVGVDWKTATNNTVMAAAYYGKDKKNSTDKTTTFILSDEYALSKRTTMYGQLVFANAKSGATLLTTMVAGGTAPDKTTTLFNVGIKHSF

SEQ ID NO: 16922 - protein, 375 aa, Shigella dysenteriae serotype 1
MKVKVLSLLVPALLVAGAANAAEVYNKDGNKLDLYGKVDGLHYFSDDKSVDGDQTYMRLGFKGETQVTDQLTGYGQWEYQIQGNAPESENNSWTRVAFAGLKFQDIGSFDYGRNYGVVYDVTSWTDVLPEFGGDTYGSDNFMQQRGNGFATYRNTDFFGLVDGLNFAVQYQGQNGSVSGENDPDFTGHGITNNGRKALRQNGDGVGGSITYDYEGFGVGAAVSSSKRTWDQNNTGLIGTGDRAETYTGGLKYDANNIYLAAQYTQTYNATRVGSLGWANKAQNFEAVAQYQFDFGLRPSVAYLQSKGKNLGVVAGRNYDDEDILKYVDVGATYYFNKNMSTYVDYKINLLDDNQFTRAAGINTDDIVALGLVYQF

SEQ ID NO: 16923 - protein, 797 aa, Shigella dysenteriae serotype 1
MIKFTKHFIFVAIMLISSLAWAQSGKISGRVFDKKNNESIPFATVVIQGTSNGVTTDIDGKYALTGLKGGLYNLEVSYIGFKKKVVFEVEVTPARPAIANIGLEEETTKLETVTVTASSSFLKTTESPVSLRTIGTNEIKRNPGGNRDISKVIRTLPGVAAVPAFRNDVIVRGGAPNENRFFLDGIEVPNINHFATQGSSGGPVGLINVDFIREVEFYSGAFPANRGNALSSVLEFKQKDGRTDRWTANGIVSATDVGITLEGPVTKNSSVILSARRSYLQFLFAALELPFLPTYNDFQLKYKHKFGKKSQLSIIGLGAIDQFRLNLDANDTEEQRYTLNNLPVTEQWNYTIGAKYDWFRENGSYSLIVSRNALNNNLYKHPGNDESLPRILDYKSREIENKFRLEDYIEAGGWKLNLSLQYELAQYTNSTDNQVVIPNSAPITKSVQSELDINKWGASVQVSRSFFEDKLALSLGLRADANDYSEEMSNLANQLSPRFSASYSFTPTFSWNFNTGIYYQLPAYTILGYKEGDTFVNKANDIKYIKNSQLVTGFEYNLPASNTRITVEGFYKFYENYPFLIREQISLANLGADFGVIGNDPVNSSSVGRAYGLELLVQRKFSKGIYGILAYTLVRSEFKDRNDEFVASAWDNRHILSLTGGYKFGNNWEFGTRILFSGGAPFTPFDLNATLTPANWDIAGQGIPDYTRLNTERNSAFYQVDVRLDKKWFFKKWSLNVFFDIQNVTNAQVQFQDNIDVVRDDQGNPVRDPNNPNLYQGKFLDNIAGNVLPSIGIIVEL

SEQ ID NO: 16924 - protein, 468 aa, Shigella dysenteriae serotype 1
MRTFSGKRSTLALAIAGVTAMSGFMAIPEARAEGFIDDSTLTGGIYYWQRERDRKDVTDGDKYKTNLSHSTWNANLDFQSGYAADMFGLDIAAFTAIEMAENGDSSHPNEIAFSKSNKAYDEDWSGDKSGISLYKAAAKFKYGPVWARAGYIQPTGQTLLAPHWSFMPGTYQGAEAGANFDYGDAGALSFSYMWTNEYKAPWHLEMDEFYQNDKTTKVDYLHSLGAKYDFKNNFVLEAAFGQAEGYIDQYFAKASYKFDIAGSPLTTSYQFYGTRDKVDDRSVNDLYDGTAWLQALTFGYRAADVVDLRLEGTWVKADGQQGYFLQRMTPTYASSNGRLDIWWDNRSDFNANGEKAVFFGAMYDLKNWNLPGFAIGASYVYAWDAKPATWQSNPDAYYDKNRTIEESAYSLDAVYTIQDGRAKGTMFKLHFTEYDNHSDIPSWGGGYGNIFQDERDVKFMVIAPFTIF

SEQ ID NO: 16925 - protein, 1151 aa, Shigella dysenteriae serotype 1
MAFIESTFIKEIRNIRLPLFIKLFALLLCTTIGTYGTEKVNLQSSNLSINMTNCTLKDVLKELENKSKYIFFYYDKNIDLKRKININVKNETIENILDKLFEHTDNTYSIHERQIVISKRKVVAEQNKEQTVVPAKKMLKGKVVDNLESPLPGATITIEGSTRGVTTDIDGSFSIEVTPTDKIIVQFLGMESQTITVGNQNDITIKLKEKADLLDEVTVVAFAKQRKESVIASVSTIKPSDLKVPSSNLTTSFAGRIAGLISYQRTGEPGQDNADFFIRGVTTFGKSSRANPLILIDGVEMTSDELSRLTTDDIASFSIMKDANATALYGARGANGVILVTTKEGKEGKVHVQLRLEGSYSTPTEHIKLADPVTYMRLHNEAVRTRDAMAALPYSTAKIMNTERGLDPLRYPAIDWQDMLFKNHTFNQRYNLNISGGGKVARYYIAASYSKDNGILKEDKRNNFNNNISIDKYLLRANVNVNLTKTTEAIVRLYGSFEDYSGPLDGGSALYKKAMHANPVLFQPFYPADQANEYTKHILFGNYDTGDYLNPYAEMVKGYTTRDRSNMFAQFELKQNLDFITKGLSARGLFNVSRYSLLKVNHSFKPFYYQIANTTNLNDYTLIPLNPDGGTDYLDYNKQPQTLNSTMYFEGAIQYNREFADKHNVSGLMVYTMREYLDGNANNLQLSLPYRNIGLAGRFTYGYDKRYFLEMNFGYNGSERFAKNERFGFFPSAGLGWVVSNEKFMEPYQKFISKLKLKATYGLVGNDNIGEESDRFFYLSQVNMNDSGKGFTFGEDFNYTRNGISISRYADSNITWEVSRKMNLGFELGLWNSLEVQFDYFTEKRTNILQIRQDIPPTMGLQAQPQANIGEAKGHGIDLSVDYNKSFTKNFWAIFSGNFTYATSKYLVYEEPDYVQTPWRSRIDQKLSQRWGYVAERLFLDDEEVKNSPKQMFGEYGAGDIKYKDINGDMKIDENDQVPIGYPTTPEIIYGFGLTTGYKNFDFSFFFQGSARSSFWIDPTATAPFVSDSSLGGNNQRALLKYWADSHWSEDNRDIFALWPRLSNVANENNQQTSTWFMRDGSFLRLKSVEIGYSLPQKWIRPISLQNVRLYATGSNLLVFSKFKMWDPEMAGNGFSYPLQRVFNFGINIEF

SEQ ID NO: 16926 - protein, 739 aa, Shigella dysenteriae serotype 1
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGANTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATRDVTKNVSLTGGVDNLFDKRLWRAGNAQTTGDLAGPTISRVPGRIPITSRDVRGT

SEQ ID NO: 16927 - protein, 802 aa, Shigella dysenteriae serotype 1
MVGVANAQTPGSSGRGTAPAARSAGYNFSIPPQPLTGAISAFSRVTGIDVVGDGGIGRGVGSPGVSGNLTPHQALTRLLAGTGLSYRFTNASTVAIQRPNADGGAGAVPSGAIALDTIDVQGASNPNALIGNLPPEYAGGQVARGGQLGLLGNRDLMNTPFNQTSYTSKLMQNQQIKYIADVLQNDPSVLVDTGPSGGADNFIIRGFDAGNGDMLFNGMAGIAPTWFNSMMSESIERVEVLKGPSALLNGAGALGSIGGMINLVPKRAGDDPLTQATLDHASNSQFGGHVDIGRRFGGNKEFGVRFNGVYRDGDTPIDHQSRESRLATLALDYRGERLRLSADLGYQYQNLKGVRVWSSVDPGVAVPPPPNTRTNASPPWGYVAPEVFYGVARGEFDLTSNITAFAAVGGNQRKQPSFYVIRSITDSAGTLGPTTAFEEADAMYTLSTEAGVRGNFETGPIKHQATVAYSKVSIDWRRVDGNSAPVPTSNIYSPVFGPGPAGPRPNASDARPLQDISLSGITMADTLSIFDDRIQVTGGVRFQEIEATRFNISTGAVRSNYDEKTATPMVGVVLKPWSNVSLYGNYIEGLQQGPVAPLGAANAGEIFSPYVAKQTEVGLKVDFGRITTTLSTYQLAKPVGYVDPTTNLFGVYGDQRHRGIELNVFGELTESLRLLGGANYIESVQLNTGDSATAGKRGVGVPEYRLVAGAEWDTPFVRGLTFTGRFIYNGSQFVDPANTQEISGWTRVDFGGRYTIEGYGMPIVIRANIQNVFDTRAWIGGTFGGLTPNDPRTFRLSTTFQF

SEQ ID NO: 16928 - protein, 729 aa, Shigella dysenteriae serotype 1
MARSKTAQPKHSLRKIAVVVATAVSGMSVYAQAAVEPKEDTITVTAAPAPQESAWGPAATIAAKHSATATKTDTPIEKTPQSISVVTNEEMQMRQFQSVKEALGYTPGVTVSSRGASNTYDFVIIRGFSSVGLNQNNYLDGLKLQGNFYNDAVIDPYMLERVELMRGPTSVLYGKSNPGGIISMVSKRPTTEPLKEIQFKMGTDNLFQTGFDFSDALDDNGEFSYRLTGLARSTNEQQKNSESQRYTIAPSFSWRPDDKTNFTFLSYFQNEPETGYYGWLPKEGTVEPLPNGKRLPTDFNEGASNNTYSRNQKMVGYSFEHGFNDTFTVRQNLRFSEMKTSQKSVYGTGIAGDGHTLNRGTVVDNERLQNFSVDTQLESKFATGDVEHTLLTGVDFMRMRNDINASFGSAPSIDLYNKYHPEYFAFGSAEPYQMNESKQTGIYVQDQAEWNKWVFTLGGRYDWSKQATTVRENSYTPTEGYIERNDHQFTWRGGVNYLFDNGISPYFSYSQSFEPSAFDLWSNPRISYKPSKGEQYEAGVKYVPNDMPVVVTGAVYQLTKTNNLTADPTNPLAQVPAGEIRARGVELEAKAALNANINLTASYTYTDAEYTKDTNLKGKTPEQVPEHMASLWGDYTFNEGPLSGLTLGTGGRFIGSSYGDPANTFKVGSTAVMDAVVKYDLARFGMAGSSLAVNVNNLLDREYVASCFQTYGCFWGAERQVVATATFRF

SEQ ID NO: 16929 - protein, 1115 aa, Burkholderia sp.
MKKRKICVSRVLKMTSLFFLSCAMCAQAETVSSQSIRITLNKNNVRLENILNDIESQTNLLFIYNKNVNVNRKVSVNAQNTSLQEVLQNLFDNNVSFKIEGSYIVLSPAGATGSPQQAKHTVKGVVEDALGPIAGANVVEKGTTNGTITDMDGNFTLNVAPNATLVISYIGYKDQEIAVNNKTNIQIKLVEDSQALDEVVVVGYGVQKRASVTGSVASLQAKDIATVKTPNVSNALAGKLPGLRAVQRSGAPGDDDASIDIRGFGNALVIVDGVERDFKQIDANDIESISILKDASAAVYGFKGANGVILVTTKKGEIGKPKINYNGYVGLQNITRYPEYYNGYEYATLYNEAQQNIGVSAPYSAEDLERFKQGIGTTDWYDEVIRKTAPTTYHNLSVSGGAEKVKYFFSLGFTDQEGIYKSKAFNYKKYNVRSNISAEIVKGFTVDLQLSGRLDTRMKPYEAEPLSRSIQMAKPIFPIYANNNPDYWSNPGDKGNPVHLSDIDNVGYDRRDRREFNGSITLNWEVPWVKGLSAKALLSYDYNNKYSRKWYKEYYEYTYDAVNDVYNKSGSHTISELTTQSDNYFKPNGQVSLNYKNTFGKHDVGVLALWEFYNDRTDWVKAYRQFTVGAIDQIGAGDKTNINNDGKASVSAHTGLVGRINYAFASKYLAEFSFRYDGSYKFAPGKRWGFFPAGSLGWRISEEDFFKESLPMFDNFKIRGSYGKVGDEGDFAAYQYLTGYTYPSGNYVLGSGGLTNGAKDKGMPNTNLTWYESTTANVGFEASVLSGLINVEFDYFIRKRDGLLATRILTLPTTFGQSLPQENLNSDKTQGFEIVLGHRKTIGDFTYDVKANFSTTRNYNRHVERAASANMYDNWRNNSNDRYKDIQWGKVCIGQFQSYEEILNSPVQDNNGNKSLMPGDLKFEDWNNDGIIDGKDDQPIGFGNTPRMYYGLNLYGEYKGFDLTVFFQGAAGHEVFTTGDFMAPFIQQGLGNGITLNLDRWHREDPSDMSSEWIPGYMPALRPTGFSANASKNTWTRQKANYLRLKTIEIGYTFPKKWMQRAGIENLRVYVNSFNTATITSRTGIMKYMDPENSESMFRYYPQMKTFNFGVNLTF

SEQ ID NO: 16930 - protein, 363 aa, Burkholderia sp.
MTKKTFLALAVCTLPAAAFAQSSVTMFGLMDAGISYVSNQGGHGAAKFDDNIFFPNLLGFEGKEDLGAGTRAIFRLVNQYSLGNGSIIGGGLFARTAYVGLQNDRYGTLTLGNQYEFMVDALAASGSEIAQDLVGLYGFRNGPFDRLALPNNPTGAFDWDRVAGSNRVANSVKYTSPSLSGLTVGALYGFGNVAGSIGANNTVSIGASYDRGPFGAGAAYTNQKYGAAGGLPPTSVRNWGAGVHYTVGTVTGKALVTTVHNARNGAGAWSAEAGAAWRPSPVWVIGASYTYMKGNDTLDNAHAHQLLAAVQYWLSKRTMVYVAGVHQRASHGSNAQINGVMDANGASSGALQSIARVGFSTRF

SEQ ID NO: 16931 - protein, 363 aa, Burkholderia sp.
MNKTLIVAAAAASFATVAHAQSSVTLYGVLDAGITYQSNVQPAPGQAGKSLWSMGSGIDQSRFGLRGSEDLGGGLKAIFTLESGFDIGNGRFRNNGGMFNRQAFVGLSSQYGTVTLGKQYDSVQDYLAPLTATGSWGGTYFAHVGNFDNLSTNGGYSPNNSIKFTSANYAGLQFGGTYSFSNNTNFGNNRAYSGGVSYQFQGLKIAGAYSQLNNPGQTTGGAVDTLQTQGRVRTYGAAAGYAFGPAQVGAAWTQARLDNTGATGTSVRIDNYEVNGKYNLTPALGLGVAYTYSNARLGQDSAHWHQVGLQADYALSKRTDVYAQAVYQRASGANASIYNGNIDTLPSSSINQTAATVGLRHRF

SEQ ID NO: 16932 - protein, 708 aa, Burkholderia sp.
MSSKPSHCVVLFTLLAVAGCTSAPGKDFFTETIDSLHAKNSPLRAGYSGPAAVTSASSAAQRFNGAQYQGTGQFVSSGAPVTKVTSDGSGKFELNLVNAPIADAAKAVLGDALHLNYIVDPRVQGTVTLQTSQPVSQDALVDILQSALAVNAAGITSRAGTYQIVPLSEIMASTPPVSVPSTSPSGPGVKVQVLQLQFIAADEMKTILEPITRQGSVLRVDSTRNIITVAGSDSDLNAIREAVSVFDVDWMRGMSVALHPLKTSKPEAVAAELDSIFGTKEGPGAKLIQFIPNDRLNSVLVITSRPAYLARAATWINKLDRLAETNESQLFVYQIQNRPAKELASVLSSVLGTTVKTEGQSGGSNVAPDQTPIAMQSDGVTPAPLTGPSPSLPQQDNQAPAHATVVADVENNALLIQTTARDYQRIEQILSKVDVLPTQVMLEAVIAEVTLNDDLKYGLRWFFENGGTKVSVTDVAKAAAAATLPGFNWSYATDNIQVTLNALSKITDVNVISAPTIMALNNQKAILQVGDQVPILTQQSQDTGNGSAPIINSVQMKDTGVILTVTPRINNAGRVMLDIQQEVSNVTKTDSSDIDSPTIQQRKVQTRVLVNDGESLALGGLIQQNNSVDRSQVPILGDIPILGNAFKQKDDTIRRTELIIFIRPHVVRDINEAREVTDEFRGKISLQTPIQKRRGGTKLQQDLKRLAY

SEQ ID NO: 16933 - protein, 756 aa, Burkholderia sp.
MRKFASAAVLNCGVSMFAVALAVADVPEARAQANNAYSFNIPAKSRLAALADFTAATGIQVVHQGAGAIGGTSPVVSGRYPADTALRTILAGSGLNYRFTGPRTVAIEAPGGAAGAGGAVAGSGIALDTISVTGAGQGIGRDGVSEINITSVDIERRNATDVKGLFRGEPSILVGSSLPMSQKLYVQGIEETNLAVSIDGSRQNNKVFHHNATTMIDPSLLKAVRVDAGVAPADAGPGALGGAIAYVTKDARDYLPNDGFGGSIKSTFNFNGNTSTNNLTSYTRQGGFEALGSFTYAKGSEFKAGNGQDVLGTATNFLSGLGKIAYQSLEGHRFSLSHEQMRDDALRPFRANAVQIIGGKPTPLVRPYTLDRQNTVFTYTNVSPDGWWDPKFVLGYNRSKAAVDQYTGATLSTYSYTSQGISDSLNGKLENKFAFSIGDVVAGIDFYRDRAEYIDVSYRTMEKADNIGAYAQARLRPWERTKLSFGMRGDHQNFKGVNGFSSSDQGLSGNASGEYELTSFLSAKAGYSHVWAGVPLAENYVQNPAWIYGVGPKSVTSDNYTAGLVAHYGDFRFEGGVFRTQINDARVPLWAANQALRAFDVQTQGFHVGGTYNWGDGFARVRFARTDAEIDGKPADTYLGQYLTAPIGDVLTFQLAHTVVPWNLTFGGDVEIVFDYDKLLNPVTGIGKLEGYEVLNAFVEHRPFALPSLTLRGEVRNLFNRNYAARGTYGLEYGTGVVRPLYEPGRSVLVSAKLDF

SEQ ID NO: 16934 - protein, 370 aa, Burkholderia sp.
MPTGPDYQLARIGFEGRSGVDSVSIDNRLEGETEIGGATHNLLVGLDYTYYRLENWQACCGSNSISATDPTYGTTQGANFVYADGVVTKNQIGVYAQDRIHFGDGWLLTLNGRYDYVDIDQDAVIGTTYSTNDSALSGRIGLAYEFDNGLTPYVSAATFFNPLVGTGVSGALKPEEGEQFEGGIKYEPAFIDGSLTASVFHITKRNNTVTNPLTFAQSQLGEVVSRGAELEGKVNINENWKLLASLAYTDMEVMENDANPALVGNSPYIVPKVTASLWVDYTLTTGAFEGMSLGAGVRHQGWSWADEANTEKVPAATLVDAAIRYEKENWGASLNVANLFDKEYVKGCGGLTVCGYGDARTITFKLSRKW

SEQ ID NO: 16935 - protein, 203 aa, Burkholderia sp.
MKKILALCLMFAAVNVMAGIDGGLEAGQTRIGVYGGISMPQDWTFDYGIGNFDEAPGETGPIFGAEIIRTVVPAFSVGLDVSYATHGDNKFDNNLTKLNSNVMSAHVVGRANFFAEEATRLYIPFGAGVSRFEAEAKALGMTDKAHETTFSFLAGVGFEFDLSPVWTMGIEGRYFYMPLDKDKFANNDKFDSFNLLLKLGARF

SEQ ID NO: 16936 - protein, 227 aa, Burkholderia sp.
MNRFTRGLLAATALTFAAPAAFAADAVVAQPASEIQAIPEALSPWQIRVRALGVIPQNSGYVNGISGSDLDYSKSITPELDITYYFTDNFAAELILGTTYANINGAGSIDGLGKIGKAWILPPTLTLQYHFTNFGAFKPYVGAGVNYTMFYNQDATGVEYLKVKNAFGGALQIGFDYMLNEHWGVNFDVKKLFLEPKFDATLIGGTEVSGKAKLNPWLIGTGVTYRF

SEQ ID NO: 16937 - protein, 386 aa, Burkholderia sp.
MKRTTLSLISLASFAAMPVAHAQSSVTLYGVIDTSITYVNHEQGKDNAWMLGNSSAGNLAGSRWGVKGTEDLGGGLKALFQLENGFDPSNGRQGQGGRLFGRQAFVGLTSDRYGTLTFGRQYDPLVDLVQGITADNYLGSVFATPGDVDNYDNSFRVDNAVKYTSAVYSGLQFSAMYSFGGIAGSTGAAQSYSAAVSYNNGPFSVAGGYFHATNSPASGGLRTGWTSSSDGTFDGPINNGYASAHSIGIGRIAGQYVAGPFTFGVGYSNAQYRRDASSVFGSNEHYNTGQGFVNYQATNALLVGVGYSYTRSGGDTSATYHQVSAGADYSLSKRTDVYLTAAYQHASGQTGDGKGGSMAAQASIGSYGYAGTSSQTMVNLGLRHRF

SEQ ID NO: 16938 - protein, 397 aa, Burkholderia sp.
MKKTLSLITLLAAGTTQAAGFQVNTQSARSSGMANAAAAWLDDSSAIYSNAANILGVEKLDVTAGVTGILPSLQFTPTGGSVQGQKTTLSPPPHVFAVYKITDSLAAGVGFYTPFGASSRWKDDFVGRFRAQESGLSIYNINPTVAYQVHDRFRVGAGLNITRGTLEIKRALGFVTSEGQVHLGGAGWGLGFNAGVQAVVVPKLVTLGVQYRSPISMTFKGDADFRDVPPAFQGRLPDTRVEGDVKLPQSVVAGIAVTPLDRLTLAFDANWVGWSSFPELAIEFPDNPAINNPLPKNWRSTWNFHLGGEYGITDALQVRAGVLWDPAPSPDETLTPDLPDANRFGVSAGVGYSFGAVRVDAAYQFVNLFDKDSTAPGMTGVYNGTAQVFGLTLGYSM

SEQ ID NO: 16939 - protein, 213 aa, Burkholderia sp.
MKKTISSLAVVAALVSPSVFAHSEGDFILRVGAASVVPNDSSDKILGSQYELEVNSDTQLGLTFGYMFTDNISLEVLAATPFSHDISTDLVGKDIGSTKHLPPTVMVQYYFGDSQSKFRPYVGAGLNYTIFFDEGFNSTGKGAGLSDLKLDDSFGLAANVGLDYMINDKWFLNASAWYANIETEATYKAGGAKQKTDVEINPWVFMISGGYKF

SEQ ID NO: 16940 - protein, 362 aa, Burkholderia sp.
MKLRFGAAAMLVIAQSAHAQSSVTLFGLIDSGISYVSNEGGGKNVKFDDGIFTPNLFGLRGTEDLGGGYRATFALVNQFSMANGSIIGTGIFGRNAYVGIESDRFGNITLGNQYDFMVDSLFAKGNAVSMDISGLYGFRNGPFQRLALPNNPTGAFDWDRTAGSKPVANSVKYSSPTIAGFSGGVMYAFGGVAGSIGADNAVSAGLNYEVGAFGIGAAYTNEKYGPAPGTPSTSVRNWGVGMHYDFGAVTAKALLTTVHNSFNDAGVWMAEAGGTWRIRPDVFLGAKYMYMKGNEAVNDNHAHQVSVALQYLLSKRTMVYVSGDYQRANSGANAQINGVLDPNGASSSATQAVARIGLHTMF

SEQ ID NO: 16941 - protein, 606 aa, Burkholderia sp.
MKFRITLLLAVLLSVSTVNAQSNIVQNDTLKEVVITSTRIDLPFKENSRTINIVTSKDIANSAATNVADLLQLVAGVDIRRRGTAGSQADLYIRGGGFDQTLLLIDGIKMDDAQTGHHTMNAALPIEVIERIEIIKGPAARVFGQNAFTGAINIVTKKNLENTVSANVEAGSFGQLNGSVTVGKEFANSSFIAHVGALTSDGYRNNSDYNNYNYFLKGVFNKNKQPIEMIATFFDKKFGAENFYTTNPAWNEYEETQNSLVGFSTTFNTGNFKIKPRIYWRRGQDIFLLKRDDPSFFRNLHITNKIGVETNVSYTSSLGITGFGIDVSRFSISSNNLGDRNRTLANFFLEHRFKIGDNIDLTPGVAVTYFSDFDFNAFPGLDLGIQISDNFKAYGNVGYTYRVPTYTDLYYSDPATSGNPDLEPESAFAQELGVKFNGNNFFASFAIFNRDSDNLIDYIRPDTATGVFTATNIAEVNTKGLEFDATYLFKLNDFNQSLKVGYSYLEDDIIDQNSDLSRYSLNTLRHQFITQLSTSFFKNLRQNIMYKHAERTTGQSYNVWDASIILDVNKFSFTITANNIFDAEYIESGFVPMPPSNILFGLRYNL

SEQ ID NO: 16942 - protein, 922 aa, Burkholderia sp.
MFTRSLLSIAIASSISLMCQNAYAEEEKKVDEIEVIQVTGIRDSLTKAIELKRQNVQIVDSIIAEDIGKFPDNNVVEALQRVTGVQVTGRGGGEVSGVTIRGLGDVSTTINGRQIFTSTGRSVALADIPASLLNSVDVYKTRSANLIEGGIAGQIDIKTQRPFNFSGEKIVVAARGIYSDATEKVDPNFSILASDRWDTGAGEFGALINASYAESNYRDQNIWVGSSDPYRADNFERINAAFVTRGEELSTTPGSTLNVNGVDTEYVLLRDAMGLTDYTGTRKRPAVNLSLQWQPNATSEYLFEAFYNGYRNEDFNSLLFSFVNGNSHFRNPEFYDNTNVVKKNYINNAALFTSGDGSTGETDSYVYALGGKWDIGDDLRLRSEINYQTSKFTRSFVAMQTNAVRDQLAVDFNYNGTGNPAFAYLDDPSTTDIDEGSLTNAADFNMGSLFDTSGKDEGDAISWNLDGDYAIEAGLFDTIDFGVRYDKRTAKSKSKDQSSGSCSINGTTCRLTDIAGLSTTSESGFYDGQAYVPSNWLSADGGYLLDNVGQMREYYDLAVNGGGYLDSRSFDIEEQTMAAYLQTNYSTELFGLPLDGQIGVRVVNSSTDLAFNESAASKVTQSTDATDVLPSFMARYYLTDDLLLRLSYGKTISRPAFGDLNPTMTLTPPNAGTEAEFGYASSGNPDLKPVESQNYDLSLEYYFAPSSSLYGVLFKREVDGFVYTTSRNIEVTDNPNPDYNAKYVLTQPSNAGKGSLDGLELGFTYFPDELPNWLQGIGIQTSYTYIDGKTKDPIFAADTDGGAGELIGYETKPLVGVSKNSYSVVLAYEKAGYSARLSYVYRDKFLTGYNFCCSMPTGIYSDSEANMDFQFSWDVTPDWVLTFDATNLTGEEFHSAYTDFNLYNSGSSLYSRTFAIGTRYSF

SEQ ID NO: 16943 - protein, 773 aa, Burkholderia sp.
MFRKKLIVTALGGLLTGGAVSLPAWAEDGAATATAGAPDAKPAQQASDDAAAAAPKAVRANRGTAVRETNLGTVTVTARRRKERIQDVPVAVSALSGDAIKNNELRVINDVTKYVPNFTGQSTEGRERPRWFLRGVGSNDPSDLSLSPIGVYFDDVYINSVFGQGFPLFDLDHIEVLRGPQGTLWGKNTVGGALNITSQKPTFDVSGYGKLGFGQYNSRLAEAAIGGSIGKNDVLAARVSVYHENADSFYTNTVQQGRFGGFHDNAVRFQVLAVPTSDTDFLFNIHGRNYTGGGNAWHAEGAGRGGTNQFGFVGSSDPYTVSLNAPSSDHISTWGTSLTAHWRINPAVSLTSITAFEGLHRWYQDDEDYSPFDAARSHDRLSSRQFSQEFRLESPQSDRLSWIVGTHLFTEQLAEQGAGGGLPGSPSPAYYHLTDLTQHTQSAAIFGSVKYRFTDRFNVTGGLRYTIERKTINLTGLQDTGNVTFSDPNSWWSPSSVSSPLAVSARQNQTNTWRAPTWDLTPEYALSSNVRAYFRYARGFRSGGYNGNAYTQSTVSTVSPEYLTDYEVGIKSEWFDKRLIVNASVFHYDYRDIQVFALAPNPFGGPPVSTLSNAGQGRADGFELELKAQPVNSLYLFANLGMLNTRYTEFRNVPTAVGNSFARSPHTTLNAGFDYRVPVSFGTLTAGGDVNYRSREYFSATRQTMPQLWQGGYTVLNAHVSYTTPNQKYIVTGYVTNLTNKVYKKLELLPSYGAYPTLYGDPRTVGITLTAKI

SEQ ID NO: 16944 - protein, 394 aa, Burkholderia sp.
MNWRLVFVAIPALCAAPAFAQGSVTLYGLVDAGIDYTNNVGGHAAWQMASGFAQGSRWGLKGTEDLGGGYSALFQIENGFNVNSGTLAQGGRMFGRQAYVGLGNTRFGTLTLGRQYDSVVDYLAPTTANGSWGVYPFSHPLDNDNTGNTFRVNNTVKYASPDFAGFSFGGTYSFSNDTGFANNRQWSVGAQYEQGGLLVGAAFLNADNPGATAGGAIAGSGSVGADANFASARLRIFGAGVNYTAGPATLGFAYTNSNVTRPTANVGYLFGDETIEPVAGPLAGGTVTAIKYQNFEVNGKYQFTPAFFVGAQYVYTTVRYDATTGSAKPKIHSIGLMADYNLSKRTDVYLMGAYQRVAGDATGSSLDQAYIPGAADLSSTSKQLMVHAGIRHKF

SEQ ID NO: 16945 - protein, 252 aa, Burkholderia sp.
MNQPLLSVNNLTHLYAPGKGFSDVSFDLWPGEVLGIVGESGSGKTTLLKSISARLTPQQGEIHYENRSLYAMSEADRRRLLRTEWGVVHQHPLDGLRRQVSAGGNIGERLMATGARHYGDIRATAQKWLEEVEIPANRIDDLPTTFSGGMQQRLQIARNLVTHPKLVFMDEPTGGLDVSVQARLLDLLRGLVVELNLAVVIVTHDLGVARLLADRLLVMKQGQVVESGLTDRVLDDPHHPYTQLLVSSVLQN

SEQ ID NO: 16946 - protein, 765 aa, Burkholderia sp.
MKKLYVQSFFTIFLLLSVLASPAVHAQDAGIIEGSVIDRDTQQPIIGARIEVLGTTLGAIADMNGQFFIEGLQSGTYRLKATAVDYQPIVKSDIAVGSAQSVKLVVEMQIDAYQAGEIVVTATQLFNKAEDVKVSSNELSQEEIRRSPGSAEDVSRMVQALPGVATAADSRNDLIVRGGSPIENFIMIDGIEVPNINHFGTQGASGGPIGMINVDFLQEVTFSAGGFPVKYGDRLSSIMDIQYRDGDKNKLTGKFDLGLAGAGFIVEGPIQKGKSSYIVSARKSYLDLLLSSTGLTAVPNYTNFNLKATYELSPTHKLAVIGLGGIDRIEFKGAEDEDDPSNDHIEYDAWQSVIGLSHKWLAGKQTYVQTSLSQNNYHYGIDVDSAGTSEFSNNSLDSEVLLRSDLSHRFSPADLFELGLQLCYLRTNNDIFQNSWIDYFSVQHETLHIDKLTEAFKLGFYTQYTKTFYRRFSLTGGLRYDYFNYLNDPHAISPRASLSIDLQQNLKLNFAYGLYRQAVPLIWLIGDEANKNLKYIKATHAIAGVEYYPMEDVKVTVEVFNKNYDDYPASVANPQVSYATVGTEYGLLGMEALESASTGYARGIEFFVQKKLTQTLYGLVNYAYSQIRFKALDGVERPSSFDYRHMFTIMLGYKFSNTLELSGKWRYTSGKPYTPVDLEASTALNQLQLDFSKVNAYRFAAYHRLDIRIDKRYEFDGWNLVAFIDFENLYNRKNIDQLQWDEKKKRVDTVYQWSFLPAGGIKVEF

SEQ ID NO: 16947 - protein, 357 aa, Burkholderia sp.
MNRFGATTWPVAIGLALSGPAFAQSSVTLYGIVDQSVRYTTHANAANDSAVQMANGAITNSRWGMKGAEDLGGGLKAIFRLENGFEPQSGQADGARLFGRYAYVGLSGRFGTIELGRQTTEGFNLFGDLDPLAIGNYTANMWPYFLTQGYANNVASYANTLGGLAVGASYGFGGVAGSMSRNAYWGVRSAYTHGALTIGAVYQQTRDADGRAQQMWGAAGRYAVGAATLFVGYLGGKDATGTIDRDDLNDPGRTVAYGSFADHPRYDTIGYAGAAYRIDPAITLTGAFYYDAIRNVNGIDGNGGKRWAGVLEAEYALSRATQLYASVDYNKVSGGGATEMPGRGDQTGVAVGLRHMF

SEQ ID NO: 16948 - protein, 743 aa, Burkholderia sp.
MTVNRTTAAPARRRRAKVGLGVGLGVTLFTAQAAVAQGDTPAPGAEAAGNATLPAITVSGERGQSLRAREASVAGLDDAPLRDTPASVNVITRALIDDQQAKRLSDVVRNDASVVNDYAPVGYFEGFAIRGFPVDLASAIRIDGLTVSGEQNVPLENKERVEILKGLAGIDSGVVAPGGVINFVTKRSANVASVTGGVDSRGSTSAAVDLGRRFGPDHQFGFRINAAKENMHSYIDGTNGRRTFGSIAADWDISPRASLQLNAEFQQWIQRSAPGYQLLGGTVVPSVKTTSKALGTQPWAKPVTTDALNLNARFDYQFNDDWKAYIAAGRSRTMIDDNSAFAYGCSYAASCAAGATSPFFFGANGDYDVYDFRSPGEYRRNDDLRAVTTGKFATGPLRHELTLGVSVQRRVVHMADAVYDYVGSENIYGPDLTFPPSPNSPGPSYPRLDAWQYGVFGLDRISIGEHWQVLAGGKEVLLRQRSWSSLDGETTHTDRSVFLPQVALVYKPVNVLSLYASYSKALSLGDQAPVRATNAYAFLPPVESHQIEVGAKYDWLDRLSLTAAVFSISKPFQFADPDASGTSYTFVQRGTQRHQGIELGAAGRVTERLGLTASVAAIRARAYDSGSPAYEGHQIINVPALRASLYADYAVPGVAGLNVLGGVEYSAARNANEEGTARVPSWFVFNLGARYTTKIGGHRTVLRVSVDNLFNKFYWRDAGEQQGDAYLFPGAPRTARVSLTYDF

SEQ ID NO: 16949 - protein, 386 aa, Burkholderia sp.
MKTPVRIVMMSGALLTTAHAAHATEVTLYGLFDTSLTVVWNADAQGRNLVGLGNGNLLGNRFGVKGAEDLGGGLKAIFTLENGFNPNTGALGQGNRMFGRQAFVGLESARWGTLTLGRQYDALADVAWPITGDFYFGSVYATPGDVDNYDTSSRTDNAVKYTSPVVGGFQFVGMYALGGVAGKSGAGQTWSAGLSYNHGPFDAAGGYYYAANRASLANGVRTGWNGTSDGTFDGSLVNGGYLSAKSIGIARGALRYTFAPFTIGIDYSNAQYKADAMSAFRSTQKYDTARGFFNYQATASLLVGVGYSYTKARGDTSATYHQVSAGADYVLSKRTDLYAVGAWQRANGEQRTLDGGTQAAQASIGSYGYGGTRTQGIVNLGLRHRF

SEQ ID NO: 16950 - protein, 187 aa, Burkholderia sp.
MKKATLKTATLLALMGAVSAPALATSDSGFYLGTYLGAMSAKNTDNVVNSKTETSVKSNFRSLGLKAGYDFNSMFGAEMRHSRDSGKIEKNSQGLAVDHQTALYGKVKFNVSDSIELYGLAGVNNIRLKQAGYKGNDNKKTINSFSYGVGAQYNFTNSLGANLELMKLSNHKQFDAHSINLGLAYKF

SEQ ID NO: 16951 - protein, 390 aa, Burkholderia sp.
MKKQLAGFALIGGFAQMACAQGSVTLYGVVDEGLTYNNNAGGHHQFGLVSGVIQASRFGLRGSEDLGGGMKALFVLENGFDASSGKLGQGGLIFGRQAYVGLSGNYGTVTMGRQYDSVVDFVGPLNIGAQWGGFYNAHPGDIDNLNNSARVNNAIKFRSQNYGGLSFGGVYSLGGVAGSPARNQIWSLGAGYGSGPLLLGIGYLNVRNPNTSFYGTGVTANTTGSAPLNTLTNIGSPVQSGYASARSQEVFAAGAAYSFGAATVGTTYSNTRFKDLGDLSSGPNPFGYRGTATFNNVEVSFKYQVTPALLMGVAADYARGSGINDASYRQFVLGADYSLSRRTDVYAMAIYQKASGIDSTGKRAVAAINGVRPSADDSQAVLRVGLRHKF

SEQ ID NO: 16952 - protein, 548 aa, Burkholderia sp.
MTIFLRPASIKSCKLIKLQALLAIMTGWLLLVLSAPPAFASVAEQFAICTRGISLGNAVTASPPGVFSIHYNPAGLIKLRGKELELGAMLPNFNVSQQWSKPDSYTAFFGQGDDPVAGSSSTSEGMVISLPFNGPVSNVSFAPYTGMGYHPVGKKWAVGVAMYAPMAVGMENPAGPATYGAQMMHLSRVVIGPGIAYQVNDTLALGASIGLGFSSMGIRMQMRAPNDMVALTGTLGELTADIDESLFLGLIPLPLFGGGMYAFDDMGAMHAERLEDNFSPGFNVGMLWEPKDWFSFGLCYQSEVKQELSGHFTLEYSQKFQNMMDWLVANDLIRIFTESLGLPTEGGLAYQSGRGSVEMIQPRHIQGGIMIRPFKRLKLTADLQWTQWSTMESNVFEFDYDLQVLKLAQLLGYQYGSRTIVFERHMIDTLHACFGLEFAATPWLDLRLGYEDRPTSVREEYRDAMMVLPDMKILSGGFGLKITRNATLDMGIGLIMAEDIEMDYDNGGISRNLNTRELTALIYNPYANLNYYQQTTGMFISMGLRYNW

SEQ ID NO: 16953 - protein, 389 aa, Burkholderia sp.
MKKLALSTLSLALLGAAGAAHAQSSVTLYGLIDTSITYVHGNNGQGNNSWQMLSGNLQGSRWGLKGSEDLGGGLKTIFQLENGFDPGTGRLGQGNRMFGRQAYVGLEHAQYGTLTLGRQYDPTVDLVQAVTGDNYFGSYFATPGDVDNNDNSIRVNNAIKYTSPVFAGFQFEGMYALSGVAGHPGTGQTWGAAAAYNNGPLGIAAGFLRVQNSNDRSINASGEGGWTSQTATGLDVSNNPIVGAYATAKAINIAQVAAQYGIGPVTFGLGYSNSQYKPDSLSAFTSTEKYNTGRAFVNFQASPALLLGVGYAYTKASGDTDAKYHQVSLGADYSLSKRTDVYLLGAYQHASGQQRGVGGVHDAQASIGSYGFAGKSSQEMVSLGLRHKF

SEQ ID NO: 16954 - protein, 1070 aa, Burkholderia sp.
MFFTVCNSDLYAQTPGKKTITGTVTDTLGLGLPGVVVAVVNKANVGTQTDNNGKYVLDVEPGTIIRFSFVGYKEQRITVGASNVINVKLLENNIQADEVVITALGQKQRKEALVGSVTTVKVGNLKIPSSNLTNALSGQIAGVIGYQRSGQPGQDNSQFFIRGVTTFGYKQDPLILIDNVELTSSDLARLQVDDIESFSILKDASATALYGARGANGVILVSTKEGKEGKAKINFRLENSASQSTQTLQLADPITYMKLFNEASLGRGLEPKFTQNEIINTQNTVNRGANYNEYVYPAVDWLDLLFKKRTTTHRANLGLSGGGGVARYYVAGSYNLDNGVLNQDLRNNNSSNVKFRNYQLRSNVNIDVTKTTELIVRLSGTFSEYTGPLATDGGFSTDLYNVAVHTSPVAFPAYFPIDAANQGVQHILFGNEVGEGGTNSIRFNNPYAALLRGHKNSSESRMSAQFEVNQKLDFLTEGLSFKSIFSTNRYSYFDSQMAYSPFYYEVGAYDRQANSYTLNWLNSSVQNGAPNIAQEYLTYNAGEPNISTFLYGQASVNYNRTFGKHTVSSTLIGTGQQTLYSNAKDPKTNTKTLQYSLPYRNLGLAGRLTYSFMDRYFVEANFGYNGSERFSADHRFGFFPTIGGGWIVSNEKFFEPLTSVINRLKLRGSYGTVGNDAIGSQRFFYQSDVNLNGGGNYAQFGFNYGSERPGVFINSYENPNITWETSRQTNLALEMTLFKNMSIIAEAYNNYRYDIFMQRKNVPTSMGLEAIDPRTGVPDIGANIGVARSRGIDFSLDYKMNINDFSFAVRSNMTFAKNKYLNFEEPQWAESYRYTTGQAISRNFGYIAERLFVDDKEVANSPTQIFSNGGVIPRGGDIKYRDLNGDGRIDEADKAYIGFPQSPELVYGFGFSSSFKNFDLSAFFTGQGRMTFFINPVKVSPFVPSDEQYIYGNTQLMKDFADNHWSPENQDLYALYPRLSVTAQHLENNAQTSTWWMRNGRLLRLKSVEIGYTLPPSVSKTLKLNSCRIYFNGLNLLTWSPFKMWDPEQGGNGFAYPIQKVFNVGLNVNL

SEQ ID NO: 16955 - protein, 395 aa, Burkholderia sp.
MKAPVNRYAILILSAASLGTTAAHAQSSVTLYGVVDDSLAYVNNQQGHSNIYMRDGNLYASKFGLRGDEDLGGGTHAIFDLQAGFNLNTGAQAAAGTLFNRQAFVGLRNASYGTVTAGRQYTPYFLFVGPYASSSWLTGATGAHPGDIDGLDTTIRVNNSVTYTSPTFAGLTASAMYAFGGIAGATGKGNTFSAALRYANGPIGIAAGYLRINSSGSSAGFLNPATASSGSFAVSVLNQGYLSAKAVEQVAAAGNYTLGDLTMGLNYSNVKYLPGNGSAFTDTAVFNTYGALAAYRFTPTFSVAGAFAYTLASKANGVASAARYQQYSLKESYSLSKRTTLYALQAYTHSSGQTLGAQGAGHIVDAAPIVGDSQQLTPSTTHGQFVGMAGIAVTF

SEQ ID NO: 16956 - protein, 415 aa, Burkholderia sp.
MASRMFSRGVTSLVLLSSLASPSFAGGLERGGYNIDQLFDTSPFSFQSGVTYVTPQRKLKDVRDTNTSILTGGGNLSSRPDTADDTSNYTIPYIGFKAGFGDAVDCLVDYSEPFGAHTSPGLNWAGANDNIETEIKTRNYGGTCSYRFDVGPGQLRFIGGAFYQEVEGFKERLVSTLPLLLGTGTGVGRLDIDDSGWGWRAGLAYEIPEYAMRASLVYNSRVKYDDLSGTVDLRQVPVVPLYGGLVTPVSGSAEAPDSLELKLQSGIAPDWLAFGSVKWTNWSVLQSVAFCPTNGLPCPAGGLTSLDLLYRDGWTISGGIGHKFNEQWAGAVSLTWDRGTSQGYGAQTDSWTLGLGAAYTPTEHIEWRFAGAVGVLTSGSSGAVTRNGVTYGDDVSYSFDDDLVAALSTSIKIKF

SEQ ID NO: 16957 - protein, 363 aa, Burkholderia sp.
MKSRAERSLRAAVLTGSAAVAGLAAAGAHAQSTVTMYGIMDAGIEYTNHAGPQGGNAFKLKSGNKNTSRWGLRGVEDLGGGLKAIFRLESGIDLANGAFDDGPDSIFARRATVGLKGKWGELSLGRNFTVTYDYMLPFDPMGYAQNYSWATSSTATGGRKDGLFTRSSNAVRYDGEFGGFKFGAMYGFGNVPGSVKTSSKYDFALGYEAGPFAAVVTFDRQNGAADSVTPADPVNSIQGIHAGVSYDFGNLKTMAGYRNYRRTYHTSAANQLSDMMWVGGSYQFTPTFSLIAAVYHQNIKGGTDADPTLLSMRAQYALSKRTVLYAAGGFAIAQHGRAVGVSRDFEAYGTTQVGVTAGIQQRF

SEQ ID NO: 16958 - protein, 183 aa, Burkholderia sp.
MKKRVAGIVAGCLALACYATPAQAQMPYISGAVGLATLSDVNNVAQGAFEDGHRLMGAFGIDSGSTRIEAEIGVQNNGVKTLADDIKITTFMGNLYYDFELPMAPIKPFAMAGAGMVDVEQKQLGQDTSFAWQVGAGVGFSIIPMVTVDLQYRYFATASDAQLGATDYSIDASHVMLGLRVGL

SEQ ID NO: 16959 - protein, 732 aa, Burkholderia sp.
MKKKLARKPAAQAAAAPAQPVRLLPLGAALMAGGLSLSAMAQDTATPAPKEKALSAVTVNATTEAPPEDGYRATATRVGKTLQDPHDVPQAITTVTRSLMEEQQVGSLKEALRNVSGLTFNAAEGGRSGDNMMLRGFYTYGDIYLDGIRDTAQYNRETFNLEQVDVLRGAAAMLFGRGQAGGVINQVSKTPMLVDRNRVTGSVGTDDYRELTGDFNKVLGDTTAVRLNVMKRDEGSWRSNPATGTEPEIHREGAAASIGFGLFTDNELIVSHQYLRTDDNPDYGISFDNATHKPTKRFDESDFWGIDQNFDESETNISTVTHTYRFTGKTQLRTQLRYSNYKRAYWASAPSNTVAPSDRGNAPKTRKSDTDNLVLQSDFSTEFNALGMKHELVTGIEYLHEDSVRWGLLNLGTNARPYYSSSVVNRASASKYEGDTYSVYAQDSIEFVKDWKVVLGARRDFMDAEYSAVRSPELKFNENSYRAGLSWQPSEYAHYYLSWSDSFSPTADLYQLSGGEFPPERSDVVELGAKFMFFEGDLAFRTALYRATKDWERNNDLESTASILTRKRRTDGLEFELAGRITDKWEVFAGLALMDSEILKVAVNRNATTGVVTSANPNFKGERARNTPTYTFNFWSTYALGNGWKVGGGAEGKGERYGYNPSAGGTAAFNPNKAPAYVRWDAMVAYEQPKWAVRLNLRNLFDEVYYDAIYDNGGFTVPGTRRSAILTTEFKF

SEQ ID NO: 16960 - protein, 380 aa, Burkholderia sp.
MKKTLIAGACAATLFAPLAHAQSSVTLYGLIDAGIAYTNNVNGASQWRMATGTINGSRFGLRGTEDLGGGLKALFVLENGFNVNNGGLGQDGKLFGRHAYVGLSRAGYGTLTLGRQYDTMVDFVAPLSATAGDLGDAGFAHPFDNDNLNHSLRINNAVKYTSDTIAGFKVGALYAFSNSANFSANRAYSVAASYTNGPLKLAGAYLQMNGTKGSTSASPGATDSAEAKSLNQGGWSIGSDRMRTYGGGVSYVFGPATVGFVYTRSQYDNTGSFGSSGQIAFNNYDVNVRYAVTPAVSLGAAYVYTDASVSNPDSKHGTDPKWHQVDLQAVYKLSRRTDLYAEAMFQHASGRGYQAFINTSGGASSTANQVVGTIGMRTRF

SEQ ID NO: 16961 - protein, 418 aa, Burkholderia sp.
MHSYEIDQRARARAAAPHAICRGHRTGALPATAIAACVVALIPCVAHAQSSVTLYGLIDTSITYATNQRTQGAGSPGSGSVALTSGALNASRWGLRGREDLGGGTAAVFALENGFSGTNGKLSQKGVDMFGRQAWVGVSSRTAGTLTFGRQYDPILDFVTPLGASGPGWGGNLAVHPYDNDDSNRNLRINHAVKYTSATYRGLTFGALYGFSNTAGAFSNNAVWSAGFGYANGPLKLGAGYLKISRDRNAPNPDGALSTVDGSATITGGNQQIWAMAGRYAFGLHSVGAAWSHSATDGVSGVLQGGGITPLKGESLVFDNFTVDGRLFVTPAFSLSAAYTYTMGRFDTRTGQTRPKWNHVVTQAGYAFSPRTDAYLEAVYQSVSGGNGNPAFNATVWTMTPSANSNQLVVALGLRHKF

SEQ ID NO: 16962 - protein, 693 aa, Burkholderia sp.
MRDLPRLPLRPLSPVSLMLFAAVAQAQAADTPASPTPTQTTPLAPIFVTANPLGDTQLIAPTAQLSGDALTRRQADSLGETLNGLPGVSTTTYGPMVGRPIIRGMDGDRIRLLQNGVAAYDASSLSYDHAVPQDPLSIERVEIVRGPAALLYGGNAVGGVVNTIDNRVPREAIEGVTGALDARYGGANSVRAGAAQVEGGNGRFAFHVDAFDREASKLRIPGYARSGAQRAIDGPDTPQPYGNVPNSDGRVHGGAAGASYTWADGFAGLSYSGYESNYGSVAEDDVRLRMRQERLAFASEVRNLSGPFTKVKFDFAYTDYRHKEVDNGETATTFRNRGYEARIEARHRKIGPFEGAIGVQFGRNTFSALGDELLVPSTRTNSVALFGLEEWQVDPALKLSLGGRFEHVKVDPDPAGVEKFAGAQPRDFNAGSVSAGALFSLTPVWSVAANVAYTERAPTFYELYSNGPHDATGQFLIGNPNASKEKAVSTDLSLRYASGPNRGSVGVFYNRFSNYLTEYNTGRVVDDDGEPVAPGADGSLNEAIYRGVRAEFYGVELDGKWRAFSRRGHTVDLELTADYTHARNVDTGQPLPRIAPLRATLAADYGYGPFGARAQVTHAWSQHRVPDNDFSTDGYTSLGVMLTYKFRVGATHWLTYLRGDNLTNQEIRYATSVVRGFAPQGGRSVMAGLRTTF

SEQ ID NO: 16963 - protein, 166 aa, Burkholderia sp.
MDGNYVRTSGTTEPNGATQRNGLELIASYFNRSGFEVDGFITLVDARFVNVADNGIPNAIEESAAVSIGQTLGDFKLGYKLKYIGSAPLVEDRSIKSDSVINSDLFVNYEVNNHLSLNFSIFNLFDRDNSDIQYAHDYFLAGNQAFGKTFHPALPRHVRVTANWLF

SEQ ID NO: 16964 - protein, 964 aa, Burkholderia sp.
MPMLPLPLTRTTSATTRPLPSMLTTALLLALSAGAVAPVAAQQAAGGDATQTLDSVVVTGSRLRRVDTETANPVVTVSQEQIAATGKATVGDLLQELPSIAGNATNPYINNGGGTGASAISLRGLGDKRTLVLVNGIRLAYNDVNAIPSSMIERIEVLSDGASAVYGSDAIGGVVNFILRSRLDGVQFSSDFGTSSEGDGNRRNFTLTAGKTWERGSLIGGLSYHNIDAVSAAARDYSKDALALTNGQPVKQGSSATPTGTVNFNDGSDQSQLLAQSNGCGRVTLNSGVSGRASPGDFHCYNAASDSYNYQPFNLLQTPQKRTNAFLLGTYRFSDSVEGYVNTWFSKTESASIIAPIPIFSNGDNILVSAQSYYNPFGVNFGTDRTTGTSYNDLNTRATVLGNRRYQYNTYNFQISPGLRGRFGDSSWQWDATFNYGKVKQKSINNGFLDYAAFNQAIGPSFLDSDGVVKCGSAGAAIAGCTPLNFFNLNDSANLATLQGMVVNPIVTSVYTVKQFEANANGTLFELPAGEASLAAGISYRKERSTTASDPLWTGDENGLCGVIEFCSSSLSGSFDVKEAYAEALFPLLKDLPGINALNITVGTRFSDYSSVGSKTNSKLSLEYRPVETLLLRGTVSQVFRAPNINELYAGVAGDAATVNDPCNGYTGGNTVACANVPTDGSYQQSDGQVSGKVSGAAVAGYQLKPETGKSYDVGFVYDPQWIDGLSLSADWWRIDLEDTITTVSAQTVLNQCFANSASAFCALIHRNGNGTINYIAEPTVNLGKLWAKGMDFNLTYRLPAMAWGNVTAGLNGTYLTRYDVLPDTTDPSSVTIHNVGRYTQAYGNFPRWRALGTVSWALDDWSATWRIRYVGHTAIGNSDPDQSLSADSSEPTVVRNIGAYVYNNLQLGYNVEPWHTRFEVGVDNIANKQPPLYYANNVGNANTDVATYDLLGRFYWARATVKF

SEQ ID NO: 16965 - protein, 1035 aa, Burkholderia sp.
MRLKFTFILTLLMLICTQFSFAQERTISGVVTDGGGAVPGVNVIVKGTKNGTQTDFDGKYSVKAKTGDVLIFSYMGMQDFTATVGTSSVVNAKLQEAGKELQEVVVVGYGVQKKKEVTGSISKISGNEIANIVTPSFEGALAGRATGVQIVTNSGIIGVAPKIRIRGIASISGGTEPLIVVDGMPIVSGDIGGVANTNGLADINPADIESYEVLKDGASTAIYGSRAANGVILITTKSGKKGTMKVNFSSTLGIASAAKKYDLLQTPDFLVISNEKRTNAGQSPWAIGDTYNTDWQSAILRNAPQLTHNVSFSGGSDKTKYYLSLGLTDQDGINKGNNMKRYSIRANIDQDINRWLSIGTNLSVTRTEYNGLNTNASGLSGNIFNAIRQQPNVPIYDPNNPTGYNLSEDNTTVGKWDNTDPVGDNITNIVYVLDHNRYYSKVNRTLANIFANAKITSDLTYRLQISADNAITDGFQYWNPIHGDGRTSNGILYNDNTEYLRWNWQNILNYKKTFAENHNIGVTLVSEYQKQTYKNFWGEGTDLMSDFYNKNLVDNSYSTKDSGGSVTENGIISYLGRFTYNFKEKYFIQASIRRDGISKLDPDTRWTNFPGVSAGWTISKEEFMQPLSSVITDLKLRGSYSKVGNTDILNGANYPYLGLTISSPYAKLNGLGYYQFGNDKLQWESSAKSDFGVDLGLLNNRLTIAFDYYRNNIDKLILAAPTAPSLGVPNNTINKNIGKLYNQGYEFAVSFKAFKNEKFTWDLSSNLTLSKNVVTNVYNGQDIIGGSSTDTNIAPNIIIREGESLNSLYGFRYWGVNKANGNPVYYKADGSLVQGLIGQSTYAVFDPADPTNTSTPSSLNSATDKVILGKTLPTYYGSFTSSMKYKNLDLGFMFRFSGGNKIFNGTRRELMNQNFNNNSTEILGRWQSVENPGDGWTPRLYASSNTFTNLSGSASSRFVESGNFISLDNITFGYTLPKELMDRIKVDNFRFFVQAQNIWLITKYKGLNPEMETSGVDINGTPRTKVMSMGINVSL

SEQ ID NO: 16966 - protein, 384 aa, Burkholderia sp.
MKKHVIFAAALAAFAAPAFAQDSVTLYGLIDEGFNYTNNVNVNGVGKTDYQLASGYAQGSRWGLKGSEELGGGLKAIFTLENGFDVNNGRLNQGGRMFGRQAFVGLSASRFGTLTFGRQYDSVVDYLAPLTANGNWGGTLFSHPFDNDNTDNSFRVNNTVKYASPDWNGLSFGGTYSFSNSTGFSTNRQYSLGAQYSLAGLQVAAAYLQANSPGVGNAGAIAADDANFVADRLRIFGGGINYTFGPATVGFVYTKTDVKNPVSTVYLPASTFSGLGLTATKFQNFEINGKYQLTSDFYLGAQYVYTDGKFDAATGSFKPKYHTVGLMADYSLSKRTDVYLQGAWQKVAGDKTGTAADGGYVVGTDGPSSSSNQFAVRAAIRHKF

SEQ ID NO: 16967 - protein, 1120 aa, Burkholderia sp.
MTIIKRRTEDTLIKIGVICIYMLLSINLTYAQIKNITGIIIDEESREPLTGASVTVKGSRQGCISDLDGKFSLQPTLPGQQMLVISYIGYQTIEVPARHNMMEIRLRPNVNELDEVVVQVAYGTVLKRSITGAVSVVDSKQIEMRPVSSVISVLNGAVPGLQTIDGVGQPGIEAEVRIRGYSSVNGSNKPLYVVDGMPYTGWITDLNPADIESVSVLKDAASCALYGSRASNGVILITTKKAKKQGVSLQLDIRHGFSARGQGDYERMNANQFMETMWQGYRNQLISNGSSPEEATIATNNDIISKVGINIYNKADNALFDANGHLASDARILDGYKDDLDWYSPYTRNGHRQEYNLSGESGNEKNRIRFSLGYLNEDGYTRKSDFNRLSGSLNADFTPRPWLKTGLSLGGTHQKTNWDIGAAGSAQSNNLSNAFYFARRIAPIYPVHLHYTEDVFASDGSLLHSKGDYILNEEGGKQYDDGSESRSESDAASNGRHLLWESEKNKLWNAANTLQGNAYVDVSFLRDFTFSLKGNISLRNIEDSQYGNAEIGAYKDTGFISKIDQEYKEYTLQQLLAWKHQFGRHFVEWMVGHENYDYKLNFDAIQKKNESFPGIDELSNFTTTTYSEGYKDTYRTEGHFTRARYDYNETYFAEASFRRDGSSIFHTDHRWGNFWSVGIGWMLSNEAFLKNVSWLNRLKLRVSYGQVGNDNFGSSNGLYQWMSLYGSAVNGGEAAYYKVQNENPELKWETNSSLNIGLETRLFNRVNLSFEYYNKHSDDLLFKFIQPLSAGATDSSTGLSTVWRNIGDVSNKGWEFSADGDIIRNREWEWNVGLNLSKVKNKIGKLPDKDREEGITNGDFQKFKEGHSIYEFWLYQYAGVDQMTGRSVYLPDFNAYYIAGEDGKTPVNGEESTEGKNPIPTDSWVDINGQYYTGDPRYARKDWSGSSLPKINGSVTTSLRWKDLTLSALMIFSCGSKVFDQPYQTLTSVGVHSLTPDLLNAWTAIPEGMTPTSPNRLDPSGIPQVNLDATINGYNSQKASTRYIVSGDYLSIKNITLSYRLPATWSKRLTLGGIRLHAAIENVALFSKRKGLNPVQTFDGIVNNYTSIARVFSFGVNINL

SEQ ID NO: 16968 - protein, 1153 aa, Burkholderia sp.
MEGEVRRLSIALFSSTFLLPAYALAQQVPTSPPVNFVNSTTPATGTTLTKVLDAYTDLMVNHPEVMVKNYQTVVSMTQNRTAAQTEAAIRADRTSQAYNVMNGLGPLTNFYLTGAGASTSGTAPQSLTPTTYVTGTLADYQRDINYLSNASAGSQTFGNGTKTPLASAVNFIDNIARANASTEPAKRTFDRYQGATPAINPLDSRYQNYSAATKTGLTTADTASFVVPGYLSQFTVPAAYGTVDNWVKGFTVTAAMVAANGGQPISVPNVGSYDAAGNFTPTLFNVGDYVPGIGTSPRPFRVTSAVNIPTLLYQRINGTNPYADGGFPSGHTNSGYLQSYAVAFLVPQRGQEMLMAASELGNNRILAGMHSPLDVIGGRMESSAIVATNIYGALYDSTGNRLDWTNPANASAYAVYQAYNDTQNYLAASCNAVSVQACIQQAQAAGFGATDPLAYSAANKALYTARLTYGLPVIGPVKAMTAADVPVQAQVLLLTRFPYLSDAQRTEILATTALPSGYAQLSGNTYDGWGQLNLYAAFDGYGAFNSQVNVTMDASLGGYNAADAWRNDITGTGGLTKGGTGQLTLSGNNTYTGPTVINGGYLIVNGSIVSPTTVNSGGTLGGTGRVGNVTVNGGGTLMPGTLGSAGTLTVNGNLAMAANSKLLITATPTATSNVQVNGTATLQGGTVQVGATGTFLPFTQVALISATGGVNGQFAGVTTSGSNLTSALSYDAKTVTLTMNRTDVNYATVAATANQRSVGAALNAAAPSAATAAAGTLVNGVFLSNQASAGLGQAALDSVSGAGLTASQGAALQATSAFTSNIQDQQDTWFTYGRTAPAASASSPALNYAAAPKTKFPPVKAVPAPAPEQRWNVWGGAFGSTTSIDSAPGLTGQSSTTWGGLVGLDYRVQPDWLVGIALGGSTSQFSTTSLNTSGTVDGAHISLYTTYALPSDSYVRGVFTFSGFSNDVKRVAGGVGALAAENEKGSFDSYEARVRGEIGKRFGFGAFGVTPFAAMEFATLNSSAFNEVNSQTGTVGNLSLQVNGQSTQSAPLFLGTRFDAAMPMDGGRALRADATLAYVHDFYSDRSLTNSFVALPGSSFLVQGVSPSADAVQTKVGLEFGVTANTAVFANFNGLFSDNSTSYAGSGGLKVQF

SEQ ID NO: 16969 - protein, 359 aa, Burkholderia sp.
MVKHAVAAAVIGMGAASGAWAQSSVVLYGSMDAGVAYVNNVGGHAKWAMIQGNTQPDRWGLKGKEDLGDGLSAIFQLENGFYTNNGQFATANTIWNRAAFVGLSAERYGTLTLGRQTPLSFDYLDPLSTAYLALSWYAFHPGNIDGLAATGNVPYNNSIKYRSPTFAGFSAAATLALGNTTNFSTGKSVGVALNYANGPFKASAVYSNEHDRSLLISQTGITSFQGQNTANGYLASKVENIGAGASYQIGDFLVHGLYTRVKMQSNGFSDTFQSYDAGVNYRSSAFNTIAGGAATTTLAGRRWTQVELGDIYALSKRTQLYANVLYEHGSGGAKAAFFTAGVSSTANQVIVLTGIHHSF

SEQ ID NO: 16970 - protein, 362 aa, Burkholderia sp.
MNKTLIVAAAAASFATVAHAQSSVTLYGVLDAGITYQSNVGGKSLWSMGSGIDQSRFGLRGSEDLGGGLKAIFTLESGFNIGNGRFANGNGGMFNRQAFVGLSSQYGTVTLGKQYDATQDYLAPLTATGSWGGTYFAHPLNNDRLSTNGDVALNNSIKYTSANYAGLQFGGTYSFSNNTNFGNNRAYSGGLSYQFQGLKLGAAYSQANLGDGTNTNGASTLGGQGRVRTYGAAAGYAFGPAQVGAAWTQSRIDNQAAGVPTLRADNYEVNAKYNLTPALGLGAAYTYTNAKVNNGSSHWNQFGVQADYALSKRTDVYAQAVYQRGAKGNNIVGTGIYNGDNTTASSSSVNQTAATVGLRHRF

SEQ ID NO: 16971 - protein, 731 aa, Burkholderia sp.
MKKRALVVAIGAAVGCHPAAWSQSTQQNQTTTLQEVQVTGFERVYKEPTTNTALGFEADPMSTPLTTISIPIDILEDQQVNNVEDALRNVAGVTKFKQGNGGEEKFSIRGFDASQSLYKDGARINNVFNATNIATTETANIERYDILKGPAAILYGQGEPGGVINYVTKKPKFTEYRAAEVIAGSDDYYRVEADFTGPLSDTFAYRLIVSSEDSGSHRDFTFRDRQLVAPSLTWKLSPQTLVTAQYEYITDTYTQDRGQVLDGNNATGYSYSGRLNGTQFYGIPGWNENTESDYNRFALLAEHFFDNGSSITANYSRTRVDKTLFDSSPRALGPNMQVVADNGDVAIRASQQGGQGESDSMVLKYQWQLDGGSMFGQNIGHKFLLQGDYERIVNNTISASGTQITYNVNTGQYSGIPPGGVVVGPFTQGGSSARQQGFVIQDLISIGEKWNLLAGLRSTQFEDRQANVDSDDISPRFGLVYKATNTLSYYGSWAKGFTPTTATGFNPATGNGIGGAPLDPERTEQYELGVKKQLLNKQLDITAAIFDLRKSDVAVTDPASSGLPAGEQWSTNLGETQTLGFDIQAIGKVNDAFRVVAGYAYLDNQLLAVDPSLAGQEGNALPGIPEHSGNLFGVYEVQRGQYKGLGLGLGVFAQTGSFVSTENRAKYDGWAQLDALAYYKADGWKVQLNLKNITDEEYNYAQAGTTTDSFGAVRVGTSTPRTVNVSLSVEF

SEQ ID NO: 16972 - protein, 402 aa, Burkholderia sp.
MKIGRRLAAAAATLGCMHAHAQTSGSVTLYGTVDTGIIYSTNQQFTRADGSTGGGHAWQMGGGNLVPSRFGFQGAEPLGGGLDAVFSLEQQFLSANGQALQGGTAFSRQAWVGLRQDGIGTLGLGRQYDSYTDMLGAYVSSNNWATPYGSHFGDVDNLNAAFNFNNAVKFTSADFHGLTVGGTFSFGGQAGDFSAKRGYAVAATYTRAPIAFSVGYLDLHQPLDAALGGANGYIGDFACSNPGAMYCLLQDAGSMRAFGAGGSVTLGAATLALTYTHTRLGDSRYFSTDAQPRTQAFTFDIGELNVTYMFTPALQGGVAYLFNAAHTDGRGTTRFHQVNVGTNYSLSKRTALYAVAIGQIASGAGLGTDANGNAANYAQIPVLANSNSSRQLAVMAGIRVNF

SEQ ID NO: 16973 - protein, 1594 aa, Burkholderia sp.
MKSRNKCVFMLHAEPIVLTKMKPLSILIASLLGIAVFPMLPVSKVIASECMTANGTSNGASVSSGGTCSFTSGYTPVINDNQVDGANINSGDTITISGLGTDIISGDRGIQQNSLGTLNSATNGLERLLLGSRTSGVNTLDPVTGSNIVVATYDSNSFASSDWGQYNNVATQTPKNAGDNQYIDARLGTVQNGTMIVSIGDSGQLPSSDVNTINMAAKQTILTLATGINSTIEWNSKNRVLMGDTMVAAAGATTKTIQIEVPVYAGTFKAYDGGTWTVSNANELKVYNNALINALQSGTLSTQAAYDEAFAKAVTFSQKDIDYNYSIYAGDDVTADTGVNYTMYADGAGAKAVLKSGGQIDQRGAGVAVVNGATAIIEEGAQLSGHFNSLFIGSGSNGENNGVISGGYFAEDGWDTTGKGNYFDEYSEAYTVTVDGENSHFNNNGIINVAGWTQYEGYSPDAWGIRVQSNASATNSGIINTGVNNNSLSHSISAVRVANGGKSQFINTSTGEIYLGHAAQYDTANPEAVVDVANALPQYGILLTDGQATNEGKILIGSLTENAVGMAAVASSPTGSLINKGSVLVKGNANSAPLQNVGILALNNGQTQVLNSGTVTLSGVNGIGMKILATSGTATATSDANSAIVVAGGVDPESGTRNYGVWTEGEKAAANIQGDIELSGRGAIGVLARDGAAVVVGSDSAVRFHEVTNPSCTENCSEQIGYLVYGKSSSINNQAEQLEVSSSGSTLFRIEDGATFDSNGKTLTASGKNSTILAASGKGAVVTASSGTLNVSGPGATGVHVDGGATGQIDEKTSINLLGQGSTAGMVDGRKTGLSGVTGTEELKSSLTNNAKIQSAIQDVVGFVAQYGGTVVNNGEISLSSDTNSTGVIVREGGQLINNEAITITKGTGILVDGGASASTLTNQSSISVHDGIAGIHLQNGAKLNALGSGRIITDGTADGILLGTGATGAELGANLITSQGSGSGIHNIQSGTSIILNGTTIVSSSGSAILNDANATFAGSNVTLDSSRGWAIQNNQNQADIRLANSVVSGETGVLLTNPGAITNLDVTSGTLNGRIVTDNAKANVTLKDSSIWNMTADSNVTSLNNDKGSINYTHGGAFNTLTVNGNYAGNDGLLRMSTALGDDNSPTDRLIVEGNTSGSTLVSVTNAGGSGASTINGIELITVKGDSRGVFSQSGRVVAGAYDYSLVRGQAEKDKNWYLTNYVKPVEPTIPIDPTTPVDPTAPVDPVEPTNPAVPVTPTKPSEPVFRPEMGSYSANLAAANNMFVLRLHDRLGETQYTDMLTGENKVTSMWMRHVGGHTRFKDQSGQLNTQSNRYVLQIGGDVTQWSNNGNDRTHLGLMAGYGNEHSNTRSHQSHYRSDGSVNGYSVGAYGTWYANDEDKNGLHVDSWIQYSWFDNTVTGEDIDPEKYKSKGLTASLESGYTFSMGTFKGSQGSTNEWYIQPKAQVIWMGVKADSHKESNGSTVTGEGNGNIQTRAGLRTYIKGHHKMDDGKQREFEPFIEANWIHNTREFGTTMNGVSNKIDGSRNLGEIKTGVEGMINPNLNLWGNVAVQVGDKGYSDTSAMIGVKYSFK

SEQ ID NO: 16974 - protein, 913 aa, Burkholderia sp.
MKNYIYIILLIGFQVAKAQDAPVKISINFENITLNDALNNLEELTGFQFYYVDTWIENQTVTKNYENVIIEDLLKDLFKDAVINFYITSENKIVLTRNVLIYDDLLKNFRANEEEGSFVTEVEPRPAPIFVMERKGTQNIETSRVGKEDPNNKTRKFLLSGYAQNTRTNEKIINLAIVVKGSDIGTMTDANGFYSLELPAGYNQLELSTLGIEKLVRNVIIFNDGNLNFELNESLEVLDEVIVEADAAKNVDRAITGVAQIEVKKIKTIPLVLGERDILKVATTLPGITTAGEGASGFNVRGGKTDQNLILLDNALIYNPAHFFGIFSALNPFTTGSVNIYKGSIPAEYGGRLSSVFDINTKDGNKEKFGGEASLGPVTSNLTLEIPLIKDKASLLVGARATYSKWILRSLKDASLKKSNASFYDGIVKYHHNINKKNDVRLTGYYSKDAFNITSDSLYGYSNGLISLRWDRRFNKKHSSSLLLSNSNYKFNIAFDDNSPNDFDLGYDIDETEVKLKFRYNHSAAHNFGYGLSSKLYKVNPGNYKSIIEDITIPKEKGLESAIFISDEFKISEKFLMNLGFRYSMFTALGEGMQRVYEEDVPKSENTLVEVRDYDKNEAIKTYGGPEFRLSTRYFLAPDLSVKASYGNTFQYIHTLSNNTTVSPTDTWKLSDLNIKPQKANQFSLGIYKNYDGNLFELSAETYYKKSTDIIDYKVGSELLLNEAIETEVFQGEGKSYGIEFLLKKNSGKLNGWLGYTYSRSLIKFDSDFRDEQINNGEYFPANFDKPHDISLVTNYKLSKRYSFSANFVYQTGRPITYPIGNYVYRGEEFVVYSDRNKFRIPDYYRLDISFNVEGNHKIKKFAHSFWNISVYNVLGRNNPYSVFFVTENRRVRAYKSSIFSIPVPTITYNFKF

SEQ ID NO: 16975 - protein, 395 aa, Burkholderia sp.
MSADAEGFIEDSKATLNLRNAYFNRNFVNPNYPQGKAEEWTQNFILDAKSGFTQGTVGFGLDVLGMYSQKLDGGKGTGGTQLLPIHDDGRPADNFGRLGVALKAKVSKTELKVGEWMPVLPILRSDDGRSLPQTFRGGQITSTEINGLTLYGGQFRGNSPRNDASMEDMSMNGRGAFTSDRFNFGGGEYTFNDKRTLVGVWYAELSDIYQQQYFNLSHSQPLGDWTLGANLGFFTGKEDGSAQAGDLDNKTAFAMLSARYGGNTFYIGLQKLSGDDAWMRVNGTSGGTLANDSYNASYDNAKERSWQIRHDYNFVVLGVPGLTLMNRYISGDNVHTGTITDGKEWGRESELAYTVQSGPLKNLNVKWRNATIRRDFSTNEFDENRIFISYPISLL

SEQ ID NO: 16976 - protein, 455 aa, Burkholderia sp.
MASKKAGRQLLRATRIAGILALGFGLTQGGTAARAADVAPPAQVAVSPAPPVPEHDWALGTWGGVRSDLYRKGIDFQFVWVSEVAYNMTGGAENRIAQAGQLNLGVTFDLEKLFGDPGAIFQMTFDKREGRNLNHDAGLDMLVQPQEVYGRGDIWRLTQFWYDQKFANGVIDWKIGKMAVSEDITQYPCVFMNLSFCGSAPGRGLAGNYFFNYPIGQWGTRVRFNAPEAYFTLAAYQMNPNVLKQSYGVNFDFSGGNGVLLPIEFGWLPAFDGGRLPGVYQFTAWYGSQQAQDVVALNYPNLVPLSDLPVGGRWGVSFQMSQQLTHPSDDHPKQGLSLIGSMVMLDRATSTLNNQETIGLVYHGPFENRQGDEIAIAWGRTEVNSRLTNAAILSNVLVPGSAVVRRAEYPLEIYYNFHAYNGIDVRPNFQWIHCPGGVCNKPDVAILGVKTVINF

SEQ ID NO: 16977 - protein, 984 aa, Burkholderia sp.
MRYETGVTVVEAGRFGSSGYAIRGVEENRVAVQIDGLAQAETISSQGFKELFEGYGNFNNTRNSAEIETLKEVKINKGANSIKAGSGALGGSVSFETKDARDFLTEKDYHFSYKRGYNSVNQQNLNTLTTAGRYKWFDFIVVHTERQSDESKNYGYHHYDGNIQGKTREKADPYRYKLKSTLLKVSFQPTENHRLTLAADLYDNTSKGHDFSYNLNSSNLIKGCSDGHCAEKALRHTNDQVKRNNYSVIYENYSVNPLYDTLRISFSNQKIRTRARTDDYCDGNSRCEGFNNPLGLHFNNENKLVGADNNPVDYKNIPDKVTDKVITVEKTFTVDMTDKWWKYDKKFDEYKTNLNNLYKTQGVSFSRDSIKINGRNSVTVPYEIPQGKEIIPGDRHLTVNGKTYKNDEVHKQPFSLTSTYNDLILPCYQEGGVNCKKSTIEAFDKEGNIVNIPITIEKAATGDDVAHLQKQEFDKNNRRYTQISAPNLLLPSGAGYLENTWTKRDLNTITKQLNLDLTKYIEIGRTQHNLSYGGLWSEIKKEMINHSGFNTVYKTWWAIYPQDCQSGDGFNPFCNRIDTYSFLIPVKTNTTALYFADDVKVNNYWGFDWAFRYDRVKHSPEYVPGKTPKVPDGLVANPTLEPKFNIANVYSDPEELAKMQKNALARIQEIAQKRKHAAHSYSLGLTLDPFDWLRVQTKYRKGFRAPTSDETYFTFLHPDISIVPNTDLEIETSKNKEIAFTFHKPFGYLTTSIFRTDYNNYIDLAHICDSGKGNCPTLIGRNLEYPIHKNVNRPTAKLTGFELQAKLILGEIAKPLTGFSIGYKFTYQKGKMTYDPKIDEVKPTDGYIPMNAIQPKTSVINLSYAHPKDYFGIDVYLTHVSAKKGKETYNRYKPKFNDLKNSYVKWRSNAYTLIDLIGFVKPIPNLTLQAGVYNLTNKKYITWDSARSIRPFGTSNLINQETGAGINRFYAPGRNYRMSVQFEF

SEQ ID NO: 16978 - protein, 379 aa, Burkholderia sp.
MKHTKVAVAAALACAACIPAVGHAQSSVTLYGILDAGITYVNNTGGSHVVKFDDGVAYGNRFGLKGTEDLGGGLKAVFTLESGFRLGNGQLGFGGAEFGRQAYVGLQNDWGTLSFGNQLDITNELVSIYNISAWGSGYAIHQGDFDRFNGDRLPNSVKFLSNDLNGFKFGAMYSFGNVAGNFHRDSAWSAGASFTKGDFSIGAAYTRLNNPHGIYAFDPYAMIGTHTFLGQQTVTVDPATGARTDLFANTPMDVDSQGTFGIGTSYTIGKLTLDANYSYTTIKGFGQSSHMQVYEGGGLYQFTPALSFIAGYQHTRFEGHHWNQGTAGLHYLLSKRTDIYISGDYLRASQGVDAVVGYSFTPSTTQTQADVRIGMRHSF

SEQ ID NO: 16979 - protein, 274 aa, Burkholderia sp.
MKKLIVAGVVAGVSTLASAQQAGDNVATLGWLHIMPQDSANGLTTNLATMPINGPLRLPGSFTSPGTSLTVNNADTVGLTLTHFFTDHIAVTSVLGVPPEFTLTGHGVIRPPGPAGALGSVDMDKTSNQPAVKNARQWSPTIILQYYFNAPTAKFRPFVGIGVAYSWFSNIELNGNFAKDINENLGSVLAAGAGKPGPTSVEGKASSSFTPVYNVGASYAIDKHWGLTATLTYMPLKTYSSLVIKAADGSALATTRTRLKADPLITFVGISYKF

SEQ ID NO: 16980 - protein, 308 aa, Burkholderia sp.
MNRTARRLAAAIACAAASTLAAPLAHAQSTAEANVAASASNGSGMSSGGGGGFSGFMDNYVWGRNVMALGWFYIRPMDSATPLTTTTSALGLGTYQSPGTDVKVSNANTLSLTFTHFFNDNIAGTFVGGVPPKFNLYGSGNVIAPVPVVGPLTLVNLGLPQNNPVATVREWSPAIVAQYYFGTKESKLRPFVGAGVSYNFFTNLKLNQNFVNGLQNLGQVLQLGMGQVPTGPAKVTAETSSSWTPVANVGVSYEFAKNWTAIGTVSYLPLKTTSTITIRSQQGQVLAVNKTDIKVDPIVFGLAVGYKF

SEQ ID NO: 16981 - protein, 791 aa, Burkholderia sp.
MKTKLFLLCSILWGWQSFSQNYVVEGQVTENGKPLKDVSVYAKYTNYGAVTDENGNYQLNLEKGNYTIVFAHGNRQEVKLLLMSNQTLDMDMAKAEESLDEVLVKAFRVEADSPITHSNFTKKDIESRNLGQDIPVLLNVLPSVVSTTDAGNGIGYTSIRVRGSDASRVNVTLNGIPFNDQESQGAFWVNLPDFASSTENLQLQRGVGTSTNGSGAFGASVNILTEAKNDEASAEISNSIGSFNTRRHTVEFGTGLLEDKFTFSGRLSQIKSDGYVDRASSDLKSYFLQGTFQDGGTYIKALAFGGNNITYQAWYGIDKETLETDRTFNPSGMYTDEDGNRQFYDNEVDNYKQDHYQLHWNQKINKNWTSNLGLNYTYGRGYFEQYKENADLAFHEIEPLQIGGETIENSDLIRRRWLDNDYYVVNATINYTDNQLDFTSGLFYSHYTNDHFGEVIWSRFAGNSEIRDDYYFGTGTKQEFTAFTKATWRLNDQLSFFGDLQGRFVNYKTRGLTSDKVNLLVDQNFNFFNPKAGATFQVNEDQQLYASYGKAQREPRRSDFENGITNPEILDDFELGWRLDLGKSSINTNLYYMYYQDQMVLTGALDDVGAPVRETSGESYRLGLEIDADIKVSRLFSLRPNLTLSRNKNIDFRANLGGEVQNLGETNISYSPEIIGANQLIFHPNEVFQISLISKYVGEQYMGNIDSEVSLLDGFFTNDLNIVYEWKNAPLFKSVVFTGLVNNIFNVEYESNGYFFFGNFQNDAGQTESFEGAGYYPQAGINFLAGVTLKF

SEQ ID NO: 16982 - protein, 725 aa, Burkholderia sp.
MPSRRTPRRARTLRPWRASLPALITLCVASGAHADAEPAQAASAPAPASVSPPERELPTISVNASAAADPTVGYQPRTSSIAGGDERPLKEIPQSVAVVSSSVMQDQQARSLDDVLGNISGVTQTNTLGGTRDAFIKRGFGSNNDGSVLVDGVRTPVLHSYLATIDRVEVLKGPASLLYGMQDPGGVINLVTRKPEDTFGGSISASRTSHGGSSAQFDLTGPLGKPGQVAGGTLAFRLTGEYDTSRYWRSFGRERNALIAPALSWHDANTSVDVSYQYVDYTMPFDRGTVLVNGHPDDGLRYRRYEEAWAQSSGIQETLRARVEHRFSDAWRVRATYGWGRDRYDQYIARGTAFNSATGAMTRTSDANLGRNDSDQIATLGLLGNLTLAGMNHALYIGGEYERQRSFRGDTIRGKAIKGFDLYDPVYGLLAPGGTPNAKSSDSLSKVHTYSMIVQDSVKITDRLTAVGGLRWEDWQQESGMGRPFAFADRSHGNVWLPQFGLAYALTPSLTAYANVSRSFKPNVASNVTSPLAPEFGRVLEAGLKFDLKPGITGTLAAYQIDKRNVAVTVDDITSTIGTARSRGIELDVAGQITRHLSLIGSYAYTNANDRDSNTSLVNVARHTGSLFAVYDTALANLPGRWRFGGGARLVGARPGDTANSFTLPGYVTVDAFAAYETTIGKFPTRIQLNVKNLLDKTYYPSSNSNLIVAVGEPRLVTLTTTVSF

SEQ ID NO: 16983 - protein, 397 aa, Burkholderia sp.
MNKQLIAAPLLLSLAGIAAAQSSVTLYGIVDAGVTYRSNERVGSAGAYTGHSSVGLTTGNLSGSRWGIKGSEDLGGGMRALFVLENGFDISNGTSGQGGRQFGRQAFVGLGSNRYGTITLGRQYTSLDDFVSPVGPSSFIGGFGAHPGDIDDLDQTARVDSSIKYTSANYSGFTFGALYGFGGQPGSMKQRNTWSVGAAYAAGPLRVGVGYERSDNSKTGATDPTAGKWQSTDDGLFNSSINEGYASAQSQQVIATGATYDFGPAVVGVNYSNVQYRSGAQSLFSGHATFNVAGVFTRWNVQPQTQLFAGYSYTRGSDVDGIDNRAQYHNVTLGAVYDLSKRTSVYLLGAYQHASGTTLDALGRPVAATASVSDKANGHSSDSRSQAIVSLGLRQKF

SEQ ID NO: 16984 - protein, 370 aa, Burkholderia sp.
MKTLYKLAPLAMLGAFATHAAAQSSITLYGLISAGVGYATNQGGKNAWQALSGTNQNPRWGLKGKEDLGQGLSAIFQLENGFNVMTGTAAQNGREFGRMAYVGLADRTYGSLTFGRQYDAIHDYIGPVIIASNGVNIGDNDNGYNDIRVQNSVKYVSPVYYGLKFTALYGFSNATGFANNSAYSFGLGYERGPLRWSVVYAQYNHPYSSTNPDGAIANDYGSPLLIFAKSAMSPAVFASRQRIAGTGGFYTIGRAQFAALFTDVRYDYLDNSHLHLQNIGVNVVYTMTPQLFLGAAYAFTNGKYDVIDKRPKWHQVNLQADYFLSKRTDVALTVIAQQAAGDADHAQIFAYARSTGTRQMMATLGVRHVF

SEQ ID NO: 16985 - protein, 382 aa, Burkholderia sp.
MKRKFLTLAALAPAAVTAHAQTSVTLYGVIDGSVEYVNRVAAGAATPTQGGSRFGMPSVGGLSASRWGLRGVEDLGAGNSAMFVLESGFQWDSGALQSAPLFNRQSYIGLQNKEYGKLSFGRQYTSFFDGMANFAPLRFAATYEPGIWWMGLNYREDNMVKYTGQFGPLQAVGHFSFGTGTAVQNANIVLANGGVGETPGNFTDNTAYGGSLMYLDSSGLGFSVAADIWRPAAVTGQPGRVNKYGAAALYNTGPFKFTAGYRYNKGEFSNGATVLRDDYWWAGINYQATPALGLSLAYYYADIKSARTAATSPETNPANMQQVSFIADYNFSKRTDVYLSVGYAHNGGLSFDSTATAFAFKYPTMTGQQNMVGVTVGVRQVF

SEQ ID NO: 16986 - protein, 892 aa, Burkholderia sp.
MQTRYIYACLFLLAHNSYGATEQKQTPPPPEDCSTLTDEKKSLCEAIEHIEVKGQFIGIEVPEVIGRSYLDRSFIDATAKGNGDINELIALLPGVQLSNEAFSIESLAEISAPEISISGAQPWQTGFSLDGMNYNNRIDPASSSRLTSSSNDVSGGVQSMNVNSDVVESITVYDHNIPAEFGGFSGGVVDTKTKETFGKDSFSFTVRGNHSDWADYHYIQADDQTEQSSTDEAELEAPVYEKISYSLSGKKQLNKRHGVMLSLNYLNSDISDLSLGQTKTQSRRNINAIFKYGYKNGWVDNFTISMIYSPYEVNGFITDALDSDYQLEGGAYGSAIQLKQDFKYVTWASNLSFNISDSSRDGPAHFYNWLQTKGKDWGQYANQGDADERFSRQGGYGVLDNRQFTTNWKNTFNLETFKFLGLTHSVVAGAEIKYQQIERERFQDGYNYSSPVIWSSATTPLNCSGYSLDCQALETLIPIEELAEQLGGEIDFNNAEHVAAYSNNITTTAQFFNGRTVSPAEYIDVNLNRNALYVTDHINYGKLDVNIGMRYSYDDFLQNHDVAPRISLGYDVFDNKKTIISAGINRYYDSAIISYKIKEQQQFSYLQYRPIESGYLQNWLDSNYTGSFKYRFNDVDTPYDDELALGIAHAFETMGNVSLKYIKRKKHQQFSRTTSDETDLDGYTYINISNEGTGSSERISLAWSAQFGAHSVWANTSYAENEISNDNYNATVDNTPLDELVYYVNAKDEGSLVTLSQLSQIRTNFGAPITAALGWNVDWVDSFSTGLNISYSGSYDTAVRTGGSESIDIEDVCASCPVVSTLFDVYQEQTIRARTMLNLSLKYKHKLTRNQSLELRADISNLLNTRTYTVAEGASGIEPGRVFWLELSYKYD

SEQ ID NO: 16987 - protein, 385 aa, Burkholderia sp.
MNKKLLTIAILAATAGTAHAQSSVTLYGVIDAGISYVNHSTKSSTAAGSKLFKFDDGIAQGSRWGLRGTEDLGGGLKAIFVLENGFSVGTGAAGQGGAMFGRQAYVGLSQTQYGTLTFGRQYSFSTDILGSSYSTGGNTVAGNYAYHVNDVDQLTSSRINNAVKFQSANYSGFTFGALYGFSNSTDFAGAPGTGTTNTGGSSRAYSFGMNYANGPFAIGAAYTDIRYPSQSAPAFSTTIANLALSNIRDLRTYGVGGRYVWGPATAWLLWTRTQFSTISGAGGTFFNAYEGGLKYAFTPALSAAAGYTYTNATRNGGSAHWNQGNLALDYALSKRTDVYGLVIYQDASGDGAQAAIGSSTSSYFGTSGTNSQNQLAVRVGIRHKF

SEQ ID NO: 16988 - protein, 757 aa, Burkholderia sp.
MHCYTLARRPICAALFGAFGLSAAPAHADSSPQGATPPSAVLTTAAASTRGDAALLDPVTVTATRTATAASRTAASVSVITDEDLEAQQATNIKDALRYEPGITVRRTAYRPGSAALGGGRDGDSSINIRGLEGNRVLLMEDGIRLPNAFSFGPLEAGRGDYADLDTLKRIEILRGPASALYGSDGLTGAVNFITKDPRDLLSVYNKPYYFSFRPSYDSTDRSIGATVSAAGGNDRVQGMIIADGRRGHEVDTRGGNNTASTLRTTSNPQDVYSESLLGKLVLTPTTRDTIKFTAETVQRRVSTDVLSAINAPTTLGLTTHDRLERNRFSVDYDFRDDALRWFQTAHVQFYYQDAKQDQYAFETRGKLPSRSRDNQYKERTFGGAAFAESGFATGPLAHKLLVGLDGSLSRVTNLRDGTVPGVGEAFPNKAFPDTDYTLFGAFVQDQIGYGRLLVTPGLRFDTYRLSPTENDPLFTGKAVSTSANELSPRVAVLYEITPAVIPYVQYAHGFRAPTPDQVNSSFSNPVYGYTSIGNPNLKPETSDTFEAGLRGKAGTGYGIVRYSAAAFTGRYRNFISRTTIAGSGRPVDPFVFQYVNFADARIHGLEGRAEWVMPNGITLKTAMAFTKGSTQNDGAASQPLNTVNPFSAVFGVRYEPTERWFVQTDLLFQAAKRDKDVDKSDCSNKACFTPPSSFVVDLRGGYRFNKHVSATIGIRNLFDRKYWNWSDVRGIAADSQVLDAYSSPGRTVAVSMKVDF

SEQ ID NO: 16989 - protein, 350 aa, Burkholderia sp.
MQRKAFLVGACVLCTTSAHASSVTLYGIVDSYVEFDRIGSLSSMRQSGGGASTSRFGLTGVEDLGGGTSTKFVLESGFSPADGSFQGGTLFYRQAYVSLRNTRYGDLRLGRQYTPAFYVVYDGDPFGLNERLSPLALLATSTDTITSNTTPPIPRFNQAASYLSPDWNGLRVMATYGFPTPNALSTQAGRNYGAGLQYRIGGLYVGAGFQGDTSAGNLAPVISPSTTRHYVFAANYAFARVKLYAAFLYGVGTAARLPAFSTASVGASINVGALDRVLVSVVRRDVKGSANDATALGVGYDHPLSKRTSLYARYLYMKNGGDARNTVVAGLQPQPGGTEQVFALGIVHRF

SEQ ID NO: 16990 - protein, 478 aa, Burkholderia sp.
MLLAWGLPALAGVSLTGVAHADDAAPAPLTVAQAAPAAGSGASVAQATTPNAIVNAEATQAVTPPDEPSAQSKSNGFIADSHLDFLFRNYADVLDNKGGPHRHAWVQGAMANFESGYTTGLIGIGFDASLYAALKLDGGQGAGSMVHIAKGGGGGNQLAWAYPGIYDVKARISNTVVKYGLQAVDNPFMEQHDNRALPPTFLGATLVSNEFKNVMLEAGSFTKTDARGHTTLTNLTTQYGGTRINRLTYVGGTWDYSPNGEVALYANQADDVWHQYYASVKHSIGSPQTIKWTGFGNVYSTHDTGDALQGKINNNAYSLSLAAQHGPHELLLGFQQVLGDQFFDYLNETNGIFLANSMDVDYNAPHEKSLQLRYTFYGKDAGLPGFKAMVWGVTGWGADGSAGAANDPSKSSIYWSNGAPVQGRHHEFGFIPSYTFQSGKLKNTKVTFIAMWHAGSAHYSDATNTEYRLVVNLPLHAF

SEQ ID NO: 16991 - protein, 1064 aa, Burkholderia sp.
MKTKTRDLSTCLKRRLWIVGVCLTTFSFLSVSVAYAVSDNQTVQQQKKGMVIKGKVLGTDGEPIIGASVLVKGSTTGVVTDLDGNYTLSNVSKGAILEFSYVGYVKLTKTVGNETTINAILYEDSQMLEGVEVVAFGTQKKESVIGAISTVKVAELKTPSSNLTNALAGRIAGVISYQRTGEPGVDDASFFVRGVTTFGYKKDPLILIDGIELTSTDLARLQPDDIASFSIMKDATATALYGARGANGVILVKTKEGQKGKARLSLRVENSISTPTQEIELADPVTYMRLHNEAYLTRNPLAPLMYSEEKIDNTVPGAGSVIYPATDWRKELLKDFTMNQRVNLNITGGGDVARYYVAASYSQDNGILEVDKNSNFNNNIKQRVYTLRSNVNINATKTTELIVRLSGVFDDYNGPLYGGSAMYNLIMKSNPVLFPAKYPKDEAHTYTKHTLFGNAENGQYLNPYAEMVRGYKESGRSNLSAQFEVKQDLKFLTEGLSARLLFNTSRISSYDVSRKLNPYYYKMTNYDYLTGDYAIDIINPDDGSEYLIYDPGGKSITANMYIEAALNYNRDFGKHGVGGLLVYQLRNNLQPNAGSLQASLPYRNVGLSGRFTYAYNNRYFAEFNFGYNGSERFHKSKRFGFFPSAGLAWVVSNESFWDPFKDVVSKLKLRASYGIVGNDAIGSGRFLYLSDINMNDSKYGANFGYNYDYHRDGISVKRYSDPEITWEKSAKTNFALEFTLFNDLNVTAEYYTERRKSILQQRTSIPASMGLWVQPYANLGEAKGHGVDLSLDYNKYFANKSWLQLRGNFTYATSEYMVYEDYEYPGAWWKQKVGYPTNQTWGYIAEGLFVDDNEVANSPVQFGEYGAGDIKYRDVNKDGKITDLDQVPIGYPKEPEIVYGFGASYGYKNWDISVFFQGLARESFWIDYNNVSPFFNTVDTKVVGNRVGHNALAKFIADSHWSEDNRDAYAVWPRLSPTSIENNSKTSTWFMRDGSFLRLKQLEIGYTIPEKVTNKVGIKNLRFYVTGNNLLCFSKFKLWDPEMAGSGLGYPVQRVYNIGLNLTF

SEQ ID NO: 16992 - protein, 373 aa, Burkholderia sp.
MKQTTRLAAIAGGAALAFASQYAAAQSSVTLWGVADASIRYLTNANAKNDGLLSMSNGAITNSRFGIYGTEDLGGGLKAVFNLESGVNLQNGAFADSGRLFNRAAYVGLQSPYGTVTLGRQKTPLFDLLSDTYDPLTVGNYLENAWLPVALGGGLYADNQIKYTGKFEGLTAKAMYSTGTNYESTGAGGFSGQIPGSLGKGNAWGVSLSYVMGPLSIAAGAQQNSDNSARKQTIYHANIVYAFSKAKIYAGYLRSKDDTGFVDSLLAQQTIPVAKGTGRIDDGPFAGVSWQVSAPLTLTGAFYYDHMRNAMTTNGTLASGNRYAVVGIAEYALSKRTEIYGTVDFNKTTGAANVELPGRSNQTGIAIGLRNIF

SEQ ID NO: 16993 - protein, 358 aa, Burkholderia sp.
MKAFARRASRTSVKLIAAAACVAAAAPVHAQSSVSLYGQVDEWVGATKFPGGNRAWNVSGGGMSTSYWGLHGAEDLGGGYKAIFTMESFFRAQNGQYGRFQGDTFFARNAYVGISSPYGTVTAGRLTTHLFLSTILFNPFYDSYTFSPMVYHVFLGLGTFPTYPSDQGAVGDSGWNNALSYTSPSFGGLNFGAMYALGNQAGDNRSKKWSAQFNYANGPFAATAVYQYVNFNNGPQDLSALVTGMKSQGIALVGATYDLKLVKLFGQYMYTKNDQVAGSWHVNTAQGGVSVPLGVGNAMASYAYSRDAGGLDQTRQTWAVGYDYPLSKRTDVYAAYMNDHISGLSTGNTFGAGIRAKF

SEQ ID NO: 16994 - protein, 145 aa, Burkholderia sp.
DRHGIDKADLAVVWDPGWNWWEIGGWHFTFVMEGHAGYWHTGGNVHANIGEFGATPMFRFIKSAGQVRPFIEAGAGIRFLTHPTISNDLSLSTSFQFADVVGVGAQFGERQQYQLGYRFQHVSNAGIKEPNPGINFHQFYVQYNF

SEQ ID NO: 16995 - protein, 359 aa, Burkholderia sp.
MMKKALVAAALMAAGVVTAHAQSSVTLYGRLDAGIEYMNGLQNGHQVRAESGDWGTSLWGLKGSEDIGGGNKILFHLEGAFNTMTGGFSGSIWDRFATVGISNDRYGTLLLGRELAIANGVWDFDPFGQSSWSTASLVRGRNWNKTSNNVSYQSPSLYGLDFYGQFSFSNSTSFNGNTTAGQPGRAMGGQVTYTNSLFQLRGIYDETRDSNGRFSDVFNYSREYFAGVNVFLGQFKVQAAYQASRADGSGGPAVNAGVTGTQQVWGGVTWQATPAAALIAAVYHVNANHGGGNANIYTVGGSYNISKRTLFDLQVATVRNSSSANFGLNANGAGTAVSTGNPHQGGSQTGVYAGIQHLF

SEQ ID NO: 16996 - protein, 812 aa, Burkholderia sp.
MSTLSDFTPLAKALLLRHSLRRTLPVALMGITLGLPMAGLAQAQEYDVDIAAQSLPSALKQLADQTNLQVLYSPDDVQGVRSSAVRGHLSAQAAAAGLLRGTGVRYSLDGNTLTLQSNDSSAAVTLDPSVINAKGQENPYGPVEGYIATRSTTATKTDTSLMETPQSISVITRDRMTAQGAQTVSDSLAYTAGVYSNVAGNNPTDNTIMVRGFQQINANAYTDGLRNNQVGYYSPETYGMERIEVLKGPASVMYGQGSPGGTLNFVSKRPTFSPHHEVGISGGSNDRAQAYMDIGDVLDEQKTLSYRLVALGRDANSSIDYIKDDRVYIAPSLTWAPNEDTSLTLLTSYQRNKNLFTSNLPYSLFDGSNPNGKLPRHRSLNEPGFDAEKAEQTSVGYELTHNLTDSWTFKQNFRYTHFTGYEHQLYRNSGVINGNTINRYYQLRDYENDNYAIDNQLVGKFATGELEHTLLMGTDYQHGKRSAFTQTGNAPSINIYNPNRDVVIDTSRYTSLLSTSEKNRQLGVYLQDQIKFGNWIASLGGRYDWASLDTRNRLLDTKQSTDAEDFTGRVGLGYLFDFGLFPYISYTESFLPTSGTTASGSQFEPETAKQYEIGVKYQPNGSQSYVTLSAFDLRRQNVLTTDVSNPSFSVQEGEVTSRGVELEGVFKPVEGLNVISSYSVTDVEVTKDNPNVAGISNKGKTPVRIPKHLASLWVDYTLQGGPLAGLGFGVGARYTGSTYGDAQNTFKVPDYTLVDAMISYDFGKADRSLEGLKASVNVKNLTDKYYVAGCFATVGCLLGAERTVTADLTYKW

SEQ ID NO: 16997 - protein, 191 aa, Burkholderia sp.
MAFRMSEQPRTIKIYNLLAGTNEFIGEGDAYIPPHTGLPANSTDIAPPDIPAGFVAVFNSDESSWHLVEDHRGKTVYDVASGNALFISELGPLPENVTWLSPEGEFQKWNGTAWVKDTEAEKLFRIREAEETKNNLMQVASEHIAPLQDAADLEIATEEEISLLEAWKKYRVLLNRVDTSTAQDIEWPALP

SEQ ID NO: 16998 - protein, 683 aa, Burkholderia sp.
MTKPIVLCFSLATLLFAEALQVQTVTVESSIETEKLSSDQVQFTRQQDLSEILSSTNPEINMVRASAIGNDIVLRGFKRDDINVLIDGAKIYGACPNRMDPPAMHISISQIEKVIVKEGPFDVENFGSMGGMINVVTKDPKPGFSGSIQATIGSFDYKKGAVNFNGGDEKFKFSLGFVRESSGQYEDGSGRTLVEQNWAVLGKTNPNAYKEQYKNMDAYKRGVVRGKFIYDIDENQQLKVRLYSDKANDVLYPAFQMDAQLDETIMLNADYTIKHLSTYSDKLVLSAYYDRVKHDMGTEFRNAPGMLYRTHRAKSETKGVKLKNIFLIGAWNMETGIDVSKRGWNGVCLNEPSKTPRQVRIPDVDTINRGVFIKGTRKYGSWDLKAGIRYDWTNIDTNVQWNNNPLIPAPVVNYYSNKTSRDFNDISANVVAKYHFNDTDALFFAIGQGIRVPDANELYFIAYNKNLTNPWVRRGNPDLKEVKNREVDFGYEGSLGEVGNYRVTLFYSDLKDYIYAYKDSAGTLTYTNIDAHIYGAAFDSAYSVGEYGLLEAKMAYQRGEKDDQIAGQSDDDMAMVPPFHASVSYSYDTGDYFASAEIRYSAKWNNYDSDNGEQAIKSWTVVNLKASKKISSQFSIDVGVDNLFDQDYAVNNTYVGRALVSGAVPLLIHEPGRYLYTNLRYTF

SEQ ID NO: 16999 - protein, 213 aa, Burkholderia sp.
MHKTIRTCVTAAAIAASLAALPSLSHAASPGDGINQGDVLVRLRAISIQPNERASDTLGAINTGVNNAIVPELDFTYMIRDYLGVELILGTSRHQMTSSLGNLGGVGVLPPTLLLQYHFNHAGKVRPYVGAGLNYTYFYNNGLNVGGEGVSINKSSFGPALQFGVDVQLTKKVFMNVDVKKIWMSTDATLGDKGIGTLHIDPLIVGVGVGMKF

SEQ ID NO: 17000 - protein, 828 aa, Burkholderia sp.
MKQRSICPGRLSTAIAVALCCFPPFSSGQESPGTIYQFNDGFIVGSREKVDPSRFSTSAISEGVYSLDVYTNGEWKGRYDLKITAGKDGKMGVCYTKAMLMQYGISPEKLNPQLSEKEGFCGRLQEWRHEDNVKDTLIQSSLRLDIAVPQIYEDQRLKNFVSPQFWDKGVAALNLGWMANAWNSHISSANGSDNSSAYLGVNAGLSWDGWLLKHIGNLNWQQQQGKAHWNSNQTYLQRPIPQINSIVSGGQIFTNGEFFDTIGLRGVNLATDDNMFPDGMRSYAPEIRDVAQSNALATVRQGSNIIYQTTVPPGPFTLQDVYPSGYGSDLEVSVKEGDGSVEVFSVPYASVAQLLRPGMTRYALSAGKVDDSSLRNKPMLYQGTWQHGLNNLFTGYTGVTGFDDYQAFLLGTGMNTGIGALSFDVTHTRLKSDTLDEHGQSYRATFNRMFTETQTSIVLAAYRYSTKGYYNLNDALYAVDQEKNYNSNYTVWRQKNGMTFTVNQNLPDGWGGFYLCGRVADYWNRSGTEKQYQFSYNNMYGRLSWSVDAQRVYTPDSSGHRRDDRVSLNFSYPLWFGENRTANLTSNTAFNNSRFASSQIGVNGSLDSENNLNYGVSTTTATGRQHDVALNGSYRTPWTTLNGSYSQGEGYRQSGVGASGTLIAHQHGVVFSPETGPTMALIEAKDAAGVMLPGSPGTRIDSNGYAILPYLRPYRINSVEIDPKGSNDDVAFGSTVAQVVPWEGSVVKVSFDTTLQNNITLRARQANGLPLPFAATIFGPSGKEIGVVGQGSMMFISDASAPKATVKWSGGQCSVELSQEKTKETLCR

SEQ ID NO: 17001 - protein, 200 aa, Burkholderia sp.
MTIKTLLAASVATSTLFVFTPNAMAAPNPEGLYFGVGTGFSSLENDDDDIDDFIESGSEDFDVDDDDNTFKGFVGYNFNRYFATEAFYSDLGRVKLKGNGTANTDLESEAYGVSLVGKLPITQWFELFAKAGMAKWETDIDGNLGGASTDLEDNDGVDPVYGAGAQFNFKPFLVRAEYERYDFDSDYQIDSFTASVGWQF

SEQ ID NO: 17002 - protein, 374 aa, Burkholderia sp.
MKTKLAALAALAGCSAFAHAQSSFTLYGVVDTGLLYQSTSAASFRPNAPNTGKVFRMKDGGIYSSFWGIKGSEDLGGGYKVNFKLQGSFDSGTGRLQLSDTPGAVAIFNQIASLGVSGPFGTVTAGRQIVPMIYAMADTDVRNAQFFGSVLTAWLGLNTAAGWPATSTNGAIGALYDSNALVYQSPTFGGVSLALEYAPGGVAGQFQGGTRESVVLRYSNYGLNASAVYYNGHDTNPAPGVAPTGVDNNRFVYVGAKYTVRDFSVSASYGNGRNPAHADRVNLDMLSAGVGYRFTPALQVASAVYYLKDRNRATNRSTAVVLTADYSLSKRTMVYAQAGHVNNRGTMDQMLVYGQPVAPGVGTTAAMVGLRHNF

SEQ ID NO: 17003 - protein, 754 aa, Burkholderia sp.
MKKVEQKKMEWATGTRLRAIAAAASVAFGTAAAGHAYAQTAPAVNAGATASASSAQTGATATTSTSAQNGTLPAITVNAASAGDGTVGLVAKRSTTGTKTDTPLNEIPQTINVVTAQQIEMTGATDVNAALRYVPGFSSYGSDNRSDWYAALRGFTPTAYVNGLQVPNTINLASWRVDPYMIDSISVLRGPTSVLYGAGDPGAIIDVHTKLADGERVREAGVQIGNYARKQFMIDVGDKLDPDGKYAYRFVGVARDGNALTGPNNDQRVALAPSFRWRPDADTSLTLSATYLQDWGDISSNFLPAQGTVLPNPNGQINKDVYEGDGNFNYYRKKQWSVGYQFERNLTPAWTFRQNTRLMHLSLDNGSVFGNGFVEGSTTDVSRWAGVFQMNYSRFDIDNNLEGRFATGPLQHTLLLGFQYNRQTATDSEWLAAAPPLNIYNPVYQPVTTAVFTPDATIRTNTYTTMNTFGLYAQDQIKWNRWTLTLGGREDWVNMRMDDRAAGTSTKADVTAFTGRVGLTYQGDYGLSPYVSYATSFNPLIGVNLVGGGLPQPTRGKQIEAGLRWQPPGKNLMLNAAIYQINQTNVLTSALPSQDTTGTKSVQTGEVRSRGIELSATGKVTRNLSVIASYVYQDVKNVQANDVSLNNWPVDIPRPRQMASLWTDWTWYTGPLAGFGLGGGIRYQSASAGAADNSLTVSSVTLFDAGLHYDVRNWRFAVNGTNLFNRHYISGCQSNNVCIFGTDRTVIATAKYNW

SEQ ID NO: 17004 - protein, 381 aa, Burkholderia sp.
MGSENPKTACSLHKDPSLETGRSPPIDTSVAGLFSIFSKSRRKTTVGSPQARRQLAHFHSDGRRNRHSFRSRATYFILTQAGEIITIRRPFGEETNSMRRSSQFVVLTLAIATFFVITAISCAQEAVSAAAPVPTSAPKLEPAGHDFSQFGSFQAPSGEAEVAAPAWIHDGEVPRQAIYERFGFYHANPDDPARHQGVGQPLYGTSWRNRPYHFDYFFGVVETNDLERNEILLRSTMIQGIRLGYDFDHYWGTEIRFAFGDAKLSYASDPLLDGSAQLMMFDTNLLYYPWGDSTWRPYAALGLGATYYGYDDVNGVNRDQTNFSLPIGIGLKHYFRPWLAFRCELMDNIAFGSADVSTTHNFSFTTGIEYRFGGSRWSYTR

SEQ ID NO: 17005 - protein, 376 aa, Burkholderia sp.
MKRTTLALSIAATGLCAGTHAHAQSSVQLYGLMDLSFPTYRTHADANGNHVIGMGNEGEPWFSGSRWGLRGAEDIGGGTRIIFRLESEYVVANGQMEDDGQLFDRDAWVGVEDPRLGKLTAGFQNTIARDASAIYGDAYGAAKLTTEEGGWTNSNNFKQMIFYAAGPTGTRYNNGVAWKKVFGNGIFASAGYQFSNSTAFATGSAYQVALGYNGGPFAVSGFYNHVNHGGFTNQTFSVGGNYAFSIVRLNAGYFRYNGDQGSLGQRHDDSWTVSMKIAPRGPLDYELGYQQMRVKNAAYNADGFVPDANLGAFSLTSGVGNGFKETLYGSMFYHLSKRTEVYLAGDYMKLHGGYTVASTFGAKNQLELTSGIRTRF

SEQ ID NO: 17006 - protein, 712 aa, Burkholderia sp.
MATQHAYPKLNKTILALSPLALIINGLFSATAVADDKIEVIEIHADHLKDASLLGSSEQLLTELGVDFSAAGGVSSLPILNGMMGDRVKVLVDGADITAACANQMNPPLSYLSANQIKSLTVIAGISPVSAGGDNIAGVIHVNAIAPTFSDSTSLTWQAGSLAAQYRSVDEGVSLGASAQLASKTFSLSYQGAYSDAKSYQDGNGETVLDTLYRSQNHVLIAALKSDKQQLAIKLNHQHIPFQGFANQYMDMVDNTSVGLTTQYQRQTELGDFSAHLNWHKVSHEMGFFTDEKTGKMPMKTDAEDASYQLKFAHEFNNTSAITLGQEYYHYEIEDWWPPVAGSMMMGPNEYHNIHDGKRQRLAAFAQLDQQLNTAWSMSGGIRIEQVRTQAGLVQNYNSMPMTMPGMAMPMKSIDAKAAEQFNQQDRKQSDTLVDATIVTRYAFDNFKELQFGLARKNRAPNLYERYSWGQSAMATSMIGWYGDGNGYIGDIHLAPESAHTASITYAMAGDTSPWQWSTNLWYSAVNDYIDADVVGRFNRSNIADNKRHILKFTNVDAHLYGVRFDGSVQLHDSKNQGQITLKAKVNATRGERDDSNDPLYQIQPLQSELKLIQQQDNWQHAISWQWVDSKHRIDARRLENQTDSYHLVNIQSSVTWQQLSMTFAITNFLDTQYELPLGGVNIAEFKADTSQGYQQLRGQGRSLNVSMNYTF

SEQ ID NO: 17007 - protein, 1077 aa, Burkholderia sp.
MENKIFRVMKLALTTLFIFTTGLLASVRSQNMRIDFILNNAKTYNILEEIEKQTDYLFIYNVEEVDLERRISITASNQTVTEILSNIFKNTDTIYKIEGKNIFLMRKEVNRDSSPQQSKKGITGTVIDKNGEPIIGANVLIKGTSIGTITDFNGKYTLEVPENAIIQISYIGYLSQDINVNGKKEITVRLAEDTQSLDEVVVVGYGTQKKGEVASAISSIKSENFIKTPSTDPAQLIKGQVPGLSIITPDANPTSTSEISLRGITTLKASASPLVLIDGIPGDLNSVSPDDIQQIDVLKDGSAAAIYGTRGTNGVILITTKNTLGEMPTEVDVNAYISTQQIIKRLPFMNADEYRQRVKEGVAGAQDDGATTDWLDQVTRTPFTQIYNISLRGGSRTTNYVASFEYRGLNGLIKRTNNQMYYPRIEITHRMFNNKLKLNASLSGYKQSYFSGSDGGSYNSEVYRNALIYNPTTPVYNAEGKYSESTKNEYYNPVAMLNEVEGENQATNLRMFGNITYTPIEGLDIKYLVSSNTYNQTRGYYETQNHKSTWRDGKNGYASRGTTRKAQDLSELTVQWRKTLLEDHSFTLLAGYSWQKDTYQNYYMQNYDFPSDDYTYNNMETGQALKDGKATEFSEANESRLIGYFGRLNYSYKGKYMLAASIRHEGSTKFGADHKWGNFPSVSGAWNIKGENFLKDIEELSTLKLRAGFGITGTVPDDPYMSLNTLDFGTYVYYNGLYIKTIRPDSNANPDLRWEKKKEVNIGIDFGFLDDRISGNIDYYNRKTEDLLWDYTVPSPPYLYSSMVANAGSMRNSGIEVGITAIPIQTKDFQWTTSTNYSTNKNKLLSLSNDQFISSGYSDKGSTGEPLQTTTHRIQEGEPIGNFWGYKTIDIDDNGHWIIEGADGNPKPISEQQPTDKQVIGNGLPKHYLNWNNSISWKGFDFSVTMRGAFGFDILNMPRLQYGAPVMLARGNVLNEAFDTKFGNSPLAIDQELQYVSYYIEKGNYWKIDNITLGYTFNFNTWIKRLRIYGTVSNLATITGYSGIDPEVSLSGLTPGVDNKNRYPSTRTYTFGVSIKF

SEQ ID NO: 17008 - protein, 236 aa, Burkholderia sp.
MTKQLKLSALFVALLASGTAVAGEASVQGYTVSGQSNEIVRNNYGECWKNAYFDKASQGRVECGDAVAVPEPEPAPVAVVEQAPQYVDETISLSAKTLFGFDKDSLRAEAQDNLKVLAQRLSRTNVQSVRVEGHTDFMGSEKYNQALSERRAYVVANNLVSNGVPASRISAVGLGESQAQMTQVCQAEVAKLGAKASKAKKREALIACIEPDRRVDVKIRSIVTRQVVPARNHHQH

SEQ ID NO: 17009 - protein, 941 aa, Burkholderia sp.
MAVALAATPLAFAQDDEVLEEVLITGSLIKGTQTDSVQNVSAYDRSALDMQNTPTITDFIKNLSFSSGVDGDSNQFESNATEGLSNVNLRGLGPARTLVLINGQRQVAVPVRLGAGRFVDTNSIPSAAVERVEILKEGAAATYGSDAIGGVVNFRTRKDFEGFEVQGGFTDIEDSDGDMNLSAIFGTVIGDFNWVTSIGLSSRSQLRQRDRDWSSNLDGSAYPFGGYSSIGNPGTLYPFLDTNPAGDGLGLDTIIGPGLPDPGCADVGSLVAGGACRFQYTQFDNLVEDEEHWQVFSELNGELSGGQVVHLEFMYAETEVPNWATSPSYPPQRLIDPVQSVTADNPGWASFTEAFPGYLAALPAVPDYIIMRGRVNGAGANGPREAKREYETLRFAGSIEGQFDNDIGYTVNAAYSHSEGGYNSVDASIEKTALAFRGYGGEGCGATLNNDESVSPNGAIAGAGDCVYYNPFSTAIQFGYNGQFENPNYDASVANSQALQDWIDDEWEVRGENDLFTADVIFNQSVENIDLAYGLQYRYNEVSQDVDSIANLADNPCRVTGYKGCPESSQSGLHSFLAAGSDFDLDSTVYAAFGEANIELSDKLNMNVGVRYENYGDGLDTFDPKVAMQYHFNDNLSLRTSFQTTYRAPDPNQLDDSTSTGLSFVLATLAFKAIDATGNPDLEPESAFTYNMGLVWSSDNFQASLDYWAFDFKNPIITESFNQIVGAYAAGGDSKAAVQSQITCQGGVTDGSCAASGIERIQVNIVNGPRTQTNGFDFYSDYSTMIAEMPVNIGLEGTYTLKYSVDSYSIGDTKVADGFEAAGFYNSGNNVRPIQDLKMRVHLNVAINEYLNALMYVNYTSEYDDRRDAVKSAFGVDSVDDHTTIDFHLSTTLMDDSLSLTASVLNATDEDPPVAYGDLMYDAYSHNPLGRMLKVGFKYSM

SEQ ID NO: 17010 - protein, 687 aa, Burkholderia sp.
MMKVKLALLLTLIGTLPLAAQNVRQEQDTVSYMNDDPFNLEQIVVTATRTEKKIKNTPVITQIITSKQIEERGTGNIQDLLTQEVPGLNFQEVGYGTSIDIQGLGSKHILFLIDGERIAGENGGNIDYSRINLYNIDHIEIVKGASSALYGSQAMGGVINIITRKAKKKFEASAGIRYAGRNQQNYKDTPKDHSQYKYRIHLDKPNLNTNLSLGLNLGKFTMNTDVLYKSFDGYQLFDKKPLVKYFPAYNTTITEELSKTPTSISGYEDVQVAHKMDYRFSKRLKVQLKGSYYMLNKYDFQADNIFEKSEDYTYGGSIDYTISDKSSLVASVHTDHYNRYDKYELKSGRRLEYKNNIIQPRIVYSTTALDKQTITGGLEYYRESLFSDKFETGVKENKSQWYATAFLQDDWSINKQFSVIAGLRCDYHEKYGTNLTPKASVMYKIFPFTVRFNYARGYRSPSIKELYMNWDHLGMFWIYGNSKLKPETNNYISLSGEYVNSWININANVYSNWFRNKIEGMWSNDQTELHYINIGKSRLAGVETMCKIQINRHINVHGAYNYLYTSKDADGVRLSSSSPHSGNIRAEYNTRIPRYATVVNLSGNIMGKKKFDVLDELEIDGKKVEAYYQAKVNPYCLWDLTVSQYIMQNLRITAGITNLFDYTSDRVTFNTSTSPGRNYFIACNYTL

SEQ ID NO: 17011 - protein, 718 aa, Burkholderia sp.
MSSPARPHPWKLWSTSLGLMALSEASLGATEQSTERPSDPASVTLGTTHVKGEHKPGYKRETSDSVKFTAPLRETPKSVTIITESLMQERAVSTLADALRTTPGITFGAGEGGTPLGDRPFIRGFEASTDIMIDGIRDVGRMTHEAFNVEQIEIVKGPGSAYAGRGSTGGTINLVSKVPQQETFAAGSLTLGTDQLRRTTVDLNQYLPEQNMALRLNAMKHEADTPGRDDVEVTRWGLAPSFSFGLNTDTRGTLSYYHMQSDDIPDQGVPVSAISGKPVKVDRDNFYGFSKRDFRKTSADLFTLQLEHDFNDHLTLRNTTRQGRSMQDYIMSRPIATPAQERNNLAQRTARPRNVVNTSLINQTDIFGKFDTGSIGHSYSAGLEFSRERIDEKNRYGSAGSADLGDLNHPNPKDPFTPVPRGDGQHRVTKHNNRALYVMDTLALHEQWDLNLGARFDNYHVRDGVQSNRSNLWTYQSGIVFKPLPYGSIYLSYGTSFNPSGETAGQSGGADGAAGGRLSNLDPEKSRSIELGTKWDLLNERLSLTAALFKTEKTNARTYDPISNEVTLDGDVEVKGFEVGATGHLTEQWEVMAGYTYLDAKTVKYASGKNTNFDGNQAKFIAPNSGSVWTTYALTDRWKVGGGANYVDKRYTNDENTRSLDSYWRYDAMLAYRVNKNLDLQLNVLNLTDETYYDASHVGMFATVAPGRSAELAANVRF

SEQ ID NO: 17012 - protein, 379 aa, Burkholderia sp.
MKKTLIVAALSGVFATAAHAQSSVTLYGLIDAGITYTNNQGGHSAWSQSTGSVNGSRWGLRGAEDLGGGLKAIFVLENGFGINNGTLKQNGREFGRQAFVGLSHEQYGALTLGRQYDSVVDYLGPLSLTGTQFGGTQFAHPFDNDNLNNSFRVNNAVKYTSVNWAGLKFGALYGFSNNNQFANNRAYSAGVSYSYAGFNIGAGYLQLNNNFGPTVSNASGAVALDNTFVGKRQRVFGGGLNYTFGPATAGFVFTQSRVNRATAIGAGASGVSSGIALDGTFMRFNNYEVNARYAITPAWTVAGSYTYTAGFIENHHPGWNQFNLQTAYALSKRTDVYLQGVYQKVNNDGTGLGAYINGIGGMSSTEKQIAVTAGLRHRF

SEQ ID NO: 17013 - protein, 507 aa, Burkholderia sp.
MKFAQLNGPRAQARSFCDSSVHTGATHRTRLPSMRRVAVFTAFAWASLTAYSALAEANPDATPEAPEADLNIQATQTNQWTGLWNRQQLLGDMGGLRPWLGKYGMTFTLTETSEVLANLRGGLELGAAYDGLTTATLQMDTQKAFGLPGGLFNVSALQIHGSNLSANKLGTLNTASGIEADDATRLWELWYQQSFLNKRVDVKIGQQSLDQEFITSTYAALFLNTMFGWPALPSYDMPSGGPAYPLAGLGVRVRGQITPSLTALAGVYSGDPLGNDPTNKSGTNFNLHNGALWIGELQYSINQPSEGQMVGVGSGGLPGTYKLGVWYNTNRFADQRYDNMGLSLANPASTGIPANHSGNYSFYAVADQMVWRPDPDEPRSLGVFARVMGAPGDRNLVSVAANLGVVLKAPFKGRDNDSAGLALTYIKIGSHVNGLDQDFLAFNGSPYGVRTSETTLEATYQYQINPWWQLQADAQYTFNAGAGQNPNDPTQPLRNTFVVGARTVINF

SEQ ID NO: 17014 - protein, 1763 aa, Burkholderia sp.
MNHSFRSIWSEATGCWVAVAETTRARGKRSGAASGPSQRTARKATHHATRPSPLRVMALGAALAALSAGTVHASTCGNGTAVANGATCALGSFSPTVNNDLVGATTVSDGDRVGLTGAWTGATGDMGYTLTPLGSASVVSGNPNQPLLSIGGKTQSVSTPDSITGSHASVATYDSGAFAASSAGSTNVPVYHDVNGNQYVNTRIGTVERSGGTLDVSIGDPAGAPTAAGNAITMAPKQTDLFVADGTGTAQSVINWNSRNQIWLGTGDYLASGGPVSHVLLDVPAYTGTFTAFDGSTWTVTDAASLAAYNTFLVRSVQSGALGSQAAYDHAFSQAVTFSTQSFEYANNVSPGDKNTLQMDYLTVMHGTGANATLHIGKDGQIDFRGTNTIDSSSAVLAENGAHFVNDGRLSGDFTLVRLLTGASGVNNGVISSGYAAGDNFNTGGAALPYNFSLNAYTEGSGIYANGAGTTFVNNGVMNVGAWNLTRNRLDLQNYAVAATDGARASNAGTINVGVNATTLDSQVIGGLVAGGSFTNEAGGTIYLGRTAQYDPSSPEAANDVALSAHGYGILLGASGTASNLGTIVIGTQTQNGAALASIGSTSGTLTNAGAIVVNGAAPGTPLANVGMLAADTAATVTNTGTITLNGVNGIGIMVVGTGTNATAATSTGTINVAGGLDPASGTRNYGVWAEGPLAKATLDGALNLAGTGAIGVHARSGATIDVGANAVPAFMSGTHQIGFYAYGAGSQINVAAQHLSVDTDDSTLFRVAGGAAYTGASAAGALITDVNGQRARGVLATDAGTTLSTGNAIYDVNGANGIAIAVEGGAKGTIDPGTTINLNAAGATAGIVDGQAHDLAGAAAGAPVATTLTNHAAVTSSTAGVTGFIAQNLGTLENRSTVLLTGAGSTGVVAGTLGTVNNASTIRVSDGTGALVQGASATLANAGSIEADDGIAGVRLTGAGASVALSGAGTVVANGSADGVLIDSTVSGGGIAAGPTSIAVGGSGSGIRNLGANATIALSGTQVATTGNGAAGLASTGAGARIATDAATVVRTAGTDALGLSVSGADSTLTANGTTVATTGANAHAIVMDGGATALLSGAKISASGAAADGIVAQNGGRIADTGSSLASVAGNGATANSGGVLALTGTALTGATAGVLTSDTLANGATSSVLVDGGSVTSATGPAFAARGGTADVAVRNGTVVTAGNGTLLNLANGSNVTFSASAVNLAGDIVSDASSTGNVLLANGTTLTGKIDPVALSVDGTSTWRMTGSSVLSSLNNAGLVAFAAPTGSPTLTGSYKTLTTGGYVGNGGTLALNTYLGADTSPTDRLIVNGGTASGTTGLKIANTAGTGAQTTGDGIPVVVTANGGTTAASAFHLAGPVQAGAYEYRLYRGGQGDANGWYLRSQLDQTDPGDPIHPSGGGDGGNNGNGNANGNGGTLAYRPGVSGYAMTPLLNADYGFSTLGRLHERVGDIYNVEQQQPGNRDGVWGRIGGQSLDANAGRFSADERTFFAQFGKDWTLDQAPDGAGSTHVGVTASIGVSNASFSDMARAGSPDLSTSTGSVEMHAQSVGGYWTRYLPDGTYFDSVGQVTHYGNRYRDSYGNEASQNGFGVALSQEVGKPFAIGTLPVAVEPQAQLMYQYLKLNGFNDNVSAVSGTTTNALRGRVGVRIFRPNLQSDAGGGAATPYFTADVLHDFLSPGQTVVGGTPFATHLGRTWYELGVGVTAGFGKSGELYANAKIARNIGGDYRRGIVGQVGYRYSW

SEQ ID NO: 17015 - protein, 383 aa, Burkholderia sp.
MKKSLLALVALGAFAGAAHAQSSVTLYGIIDEGLLFNNNAGGKHLYSMASGVMQGSRFGLRGTEDLGGGLKAIFTLENGFDVNSGKLGQGGLMFGRQAYVGLSSQYGTVTLGRQYDSVVDFVGPLEAGDQWGGYIAAHPGDLDNFNNAYRVNNAVKFTSQSYGGFTFGGLYSFGGQAGQFAKNQVWSLGAGYNNGPLVLGVGYLNARTPNQFGGMFNNGSTSSSVSSPIYGAYANNANTYQVIGAGGAYTFGAATIGATYSNTKFKGFSAGPFVNQTATFNNGEINFKYQLTPALILGAAYDYTQGSKIDGNSAAKYHQGSLGVDYFLSKRTDVYAIGVYQHASGNVLDSNGNVLKATAAINGLAGSSTSNQVAARVGIRHKF

SEQ ID NO: 17016 - protein, 243 aa, Burkholderia sp.
MKRKLAITGAAALAFAFAGGTAHAQSAGDFYVSTGWFHLAPQDSSDPLYVYGVGGTPVNQSVPNTGAGISDADTLGLATGYFITDHISTELVFGVPPKFDINGKGQFARFGVLGRAYQWSPAVLLRYHFNDANAKFRPYVGIGASYVWFTGAKITNGAFENGVLGGPTSATTSNQWAPVFNAGFTYNFTKHWFAGLSISYVPVSVTATFTTARRTPVGTLTETSKAHISLNPIVTYLNVGYRF

SEQ ID NO: 17017 - protein, 277 aa, Burkholderia sp.
MKKTLLCAAAGAAAVAPLAAHAQSAGSNVVTLGWFHVMPQQSSTPMTTNVAPTPINTPLRLPPSFTSPGTGLRTSGADTVGLTVSHFLTDHIAVTSVAGVPPVFKVSGQGTIRPPGPAGALGTQNIGLGSVNPIVKSVRQWSPAVILQYYFAQANAKFRPFLGLGVSYNWFSDLQLNTNFIKQTQDNLGAILAAGAGKPGTTSVEAKASSSWQPVFNAGLQYNITEHFGLIASVTYIPLKTTSTVTIKAADGTVLSESKSDLKADPIISYVGMSYKF

SEQ ID NO: 17018 - protein, 710 aa, Burkholderia sp.
MELLMICDEIEVRKKDAPVRNYGREPRFGRRGLSARACFPVLVLVAATGAGNAHAQEIPAGADRLGTERRLDVRTKADRPPSEAEMKRVYDWTGFYVGGHFGYGGGRLGDDSHPKPEQGVFLPHSPTGLIGGFQVGYNRQLANHLVLGVEADASFTSPTDEPALAPSPFNSTVDYVGTARGRVGYAFDRWMPYVTGGFAWGHGHIEVNDGSGAQLGRYQTGWTAGLGAEFAVSGNWTAKVEYDYVNLSAATYDLGRFDLPNARLAPGLHLAKIGLNYHFNDLPWAASGSQSATPRLPDSSDWNVHAQTTVIAQGYPSFRSPQAGANSLPGGGEVRETWTTTAFIGVRLWQGGEFYFNPELAQGFGLNGTLGLAGFPNGEAQKAGAAFPKIRPQRYYFKQTFGLGGEQEDVDDGPNQLAGKRDIDRITVIVGRFAIGDFFDNNTYAHDPRADFMNWALWSSAAYDFPADLPGYTRGAIVELNKKDWAVRAAFVQVPSEPNSDVLKFNTGGAVVEFEKRYAIAGEPGKLRLGVFGTQGVMGNYRQALAIESQDSAQDINTVMASIRHVNPKYGFYANLEQQIAPGIGVFGRVSWNDGQNETLSFTDIDRSLSGGVSIKGNPWGRPNDTVGIGGAINGLSAAHRDFLAAGGNGLLIGDGALNYSTERIFESYYALAIGNGLTFTADYQLIVNPAYNADRGPVSVFSGRLHAEF

SEQ ID NO: 17019 - protein, 321 aa, Burkholderia sp.
MKRSNLSLLTLSLATTGLLLMTQPAVAFQEEEYTDEVISPREEVKHLLRVVSRNVGKAVSKRTPPAQQQAAFEGERTGLSTGDMTGQGLAAWMDAQYVHSKDDTANSKTSMYVTSLGVDKKLNNDLAIGTAVTYENVNEKFTNATTRNDIDSFTITPYVAYAYGDSWVFDAELGYSWVNEDRSTGVSFDTERWFIGGNATYYVQNTGNYDVSGRLSYFFSKEDQEAATGVAANVRSFSQISGSVEVGYFLEKWEPYAGMTIERDLSYESGGTAYDNSGLSFTVGGRFNLSDTMFAEIAASTEQGRNKFSQNSILANLRMEF

SEQ ID NO: 17020 - protein, 1002 aa, Burkholderia sp.
MKQVNLRVCRMILPLLFGLFLSLSAYAQQVSVKGHVKDSTGEPVIGANVVVKDNSSIGTITDLNGNFVLSVPQNSTLVISFIGYKPVEMKAAPSVTVTLHEDAVMLQEAVVIGYGTVKKNDVTGSVMAIDADKMVKGMATSASDLLVGKAAGVSVITDGGAPGAGATIRVRGGSSMSASNDPLIVIDGVPVDNTEIKGMGNPLSTVHPNDIETFTILKDASATAIYGSRASNGVIIITTKKGQSGRVKVDYSGTFSISTKSNTVDVMKAEDFRNFVIEKFGENSLQANALGKTSTDWQDEIFRTAFSTDHNVSVSGAVPHMPYRVSVAYTNENGILKTSNMQRLTGAINLNPNFFDKKLNIQLNVKGVYNKNRFADRAAIGLATQYDPTQPVYMEGNPYGNGYFMYMKQEGDKTSPIDIGLANPVAMLEEKDDKSTVYRSIGNAQIDYKFHFLPELRANLNLGYDVSKSKGDVIIADNSPLTYCTGNFKNGFGENSHYTQLKRNTLLDFYLNYANTFGVNYIDVMAGYSWQHFYNSTTNSYPYSAAYAEKTGEEFYKKGDDYASESYLVSFFGRLNYTLLNRYLVTFTLRNDGSSRFSPDNRWGLFPSVALAWKLNEESFLKNVNAISDLKLRLGYGVTGQQNLGNGDYPYMARYMYSKAGANYYFGDTEYSLIAPQPYDQNLKWEETTTWNVGIDYGFLNGRITGTIDYYFRKTKDLLNTVTAPAGTNFSNQLLTNVGTLENKGFEFSINAHAVSTQDWNWNIGYNISYNKNKITKMTFNDDPNYAGVIHGGIDGGTGYNALIHRVGEAFNSFYVFEQIYGPDGKPIEGAYVDQNGDNQINDADLICFKKAAPDVFMGLTSQLSYKNWDFSFALRGSFGNYVYNNVQSNREAYEGANMYDQTGFLKNRLTSARSTDFKNAQYRSSYYVQNASFVRMDNISLGYTFNKLFNDKQSARVYATVQNPFVITKYKGLDPEISGEGIDNNIYPRPRVFMIGLNLNF

SEQ ID NO: 17021 - protein, 192 aa, Burkholderia sp.
MPVRHQVKITGEKKMNKMLLAGSAGIVLLSAAASPVWADDNASTFSLGYAQSHTNHAGTLRGVRLANNYEMSPDWGLTTSFAWLNGSQRYSDESSNGRVTTRYYSLLAGPSWKINNQLSLYSQVGPVLLHQRDHGINESDSKVGYGYSAGVAYTPVSSVAITLGYEGADFDATHNSGSLNSNGFNLGVGYRF

SEQ ID NO: 17022 - protein, 753 aa, Burkholderia sp.
MKVRPSRPLCNLEQRKMEWATSTRVRAIAAGVAFYAAAAGHAQAQAAQPGTDARQPGGEAKADTAAGGTLPAISVSGAAERDASVGLVARRSMTGTKTDTPIIEIPQTINVVTAQQIEATGATDINQAFRYIPGFSSYGSDNRSDWYAALRGFTPTVFVDGLQVPNTINLSSWRVDPYMIDSIAVLRGPTSVLYGQGDPGAIVDVQSKLANGERIRELGVQVGNYARKQLMFDIGDTIGKDGTLSYRIVGVGRDGNAQTGPLADQRVSFAPSLKWQPNADTSLTLAATYLQDWGDTSSNFLPSRGTVLPNPNGTISDDLYTADANFDHYRKKQWSLGYQFEHKLNPVWTLRQNVRWMHLSLDDASVYGGGLDDADPTMATMTRYAGLFQFNYSRFDVDNQAQAKFTTGPLSHTLLFGFDYNRQTTTDSEWLAKGPSLNLYRPVYTPIPSDIFSGPNAYPRTDTKTTLNAFGLYVQDQIKWRRWVLTLGGRQDWTRTSQDDIANAASFRQNDHAFSGRVGLTYLGDYGLAPYLSYSTSFNPQIGLKLAGGGLATPTKGRQIEAGLRWQPPGKNLMLNAAVYQINQTNVAMSNPNDPTSSTFVQVGEVRSRGVELSAVGNLSRELSVIAAYVYQDVKNVRANDNTLNKWPVDVPRPRQIASLWADWTWRTGPLTGFGVGAGVRYMSAAAGAVDNSLTVPSYTLFDAALHYELRNWRFALNATNLFNRRYVAGCQSDAVCMYGNQRTVIATAKYNW

SEQ ID NO: 17023 - protein, 794 aa, Burkholderia sp.
MKQPTTNNQQPTTNNQQPTTNKNILPEIVVYGDNNKSLSSVKTLSSDEISKTPTSNGNITDYLRSNPHIRYENSDQNGFQRGEIKPENISINGADPNQTAYFVDNVNINNELTADSDVFDGSMQVVPGISHTQAYFFDASMLSKVEVQDSNISASLGGFMGGAVIAKTKQYSGTDSIKLKYRTTNSSWAKMEAGDSVQKILKQVRPDNSGTAELQPKYNKQTFNILAEKRLNDNLGMVLGYSRRTSSIEQNRLIGFDKNANNKAQLDKQNHQRLSDNLLLNFNWTPQEKERIELGLRYSNYKELKYFKENIGNNVSDYHQALGTTLAWVHSFDSGVWTNTLAYDRFKDKRKSSSNSVETTSVSNEDYDQLYNFEKGGYGNSRLTQDNLHFSTEYVMDPFYLASTEHSISIGGIYQATKYQFYRPQDVHSKIILSTLKSDGTMEDPPISTESYTSKGRVKTSYQNIAIYAEDLIKWRKFEFRPGIRIERDDYLKNNNIAPRFVARYHPWDDAGFTLGLNRYYGRSFASLKLANGILKLNNDSTRQHQNFSSLKSPYADELSLSFDQNMGNLALKLGYIHRDNKNRIILKRETVGRGIKKSSYINGRPFGVDIYTFQLNNIEPWKLGKTYWTTSLGFDWLNTKRADGEEFDLNKLVSLDGKLMTYREMLRQVNSNTEDWIARLGIDMTIPDYDITWSNKVYMKAPIRRYDLINSDNDNDDDTPRYRSYHYGRHTQWDSSIRWQPTIRGKHSVYLQVDILNVLNKTRKNKVTTISTSDEYGVYTPGREFWLEVGYQF

SEQ ID NO: 17024 - protein, 293 aa, Burkholderia sp.
MQKIKYLLSGSFILLPVVTFADSGDNEYLSGWWHQSINIVGSNSTRFGPQKRSDLYPEYRAWAHVDWFDFYGYADLPKFFGLGNDNDIGIWDNGSPFFMEIEPRFSIDKLTGLDLSFGPFKEWYFANNYIYDAGTNEGQRQSTWYMGLGTDIDTGLPMMLSANIYAKYQGNNYNAANENEWDGYRFKVKYIVPITTVLGGKLNYVGFTNFDFGSDLKEESGGKQQFYSRTNNSIVSTHVLSLVYSHWSYGATLRYFYHGGQFDEGSNAFNSKGEMTTIDSTGWAYYLTVGYTF

SEQ ID NO: 17025 - protein, 1049 aa, Burkholderia sp.
MKNKLWIFIFAFLVICPGKSLGDEKRSEAVAVTQQDKERVVTGEVFDDQGPIIGATVRVKGTQNGKITDLDGKFTLSVPIGATIVVSFVGYEDKEIVYKGESKLKISMAESATLLEEVQVIAYGTTKKVTVTGALSSVKSDEIMKSPVGSIANALSGKVPGLSSVQSSGQPGADDATLYVRGVGSLSTGLSAPLCLVDGVERSFTQLDPNEVEDITVLKDASATAVFGVRGANGVILVTTKRGQSGKAKITFSTSAGLQMPTNIPEFANSYDYAMTYNAAQLRDGVAEDKLMFTDAMLEGFRTHSNPILYADTDWTDLLIKNSALQTQHNMTISGGSDRVRYFASLGVFTQKGLFETFHENDRGFSYNRYNYRINMDIDVTKTTSMKINLGGRLTDKTEPNYNNGTYTDISYLYDNIYSAVPFSGAGIVDGKWISVNKSVFGNFGVINDGLNTYYGKGYTTTGGNVINFDFSLEQKLDVLTKGLKAHIKGAYNSGVTDKRRREGKADQYEAYLTESGETLIRKIQEAQTMGWTQEAGQSRDWYLEAALNFQRDFGLHHVSALAMYNQTMKYYPSKNTGIPRSYVGFVGRATYDYKTRYLLDLSIGYNGSENFAEGKRFGTFPAGSVGWIISEEKFMEPLKPYVSYLKLRASYGIVGNDIVSDGSRFLYLPDSYIISTAGGNNTTGIYSFGSTTNNFLPGAKESKVGNPDVTWETAAKQNYGVDLHFFDSHLKTSFDYFIEHRKDILISRQVNPGYLAISLPIVNMGKVDNKGFEVTARWEDAIRDFSYYIGTSWSYAKNKVIFKDEIPQPYEWMCETGRPVGQQFGYVNDGFFTEEDAANYESLKGKENGIPDHGSGFSPIAGDVKYKDLNKDGKIDANDISAIGYPTYPLLNGNMQLGFSWKGFDLSMTWAGAFQTSRLVSRIYRTPFGETGTNSLLQYMIDDAWTAEKGNSAKAPAISLSGSKTNNYKDSDLWLRDASYIRLKNIEVGYSFPKAMLQKFRISSLRLSLSGYNLLTFSDLDFCDPESNPDGRAYPLIKVVNFGLKIGF

SEQ ID NO: 17026 - protein, 533 aa, Burkholderia sp.
MKKSGSGGREAGSPFEARLFVGAGLCALAWLASQGVARAQAANQNLGEVTAEVLAFGSNSSCGQPTTHPALLDAPPRDLLAQGKIGEQLAGICLFSAVTSGPSFGVSIGLRPTRSVTQYRLASARLNKRLAPKGRRSGLDHPILLASNGPVQIGDVGDTPGGWSVFAAMDYENRDQNQSHLDPGYSADIVEATVGVDKTLSPSLAVGFMVNYVDRRGDFARANLITAGDTPYPPTDVRTDADVLSLCGLMPGGDFKQSGWGGSAFVGYESDDNWYLRAVVNYAIPDHKYSRRVCGVEVGGTAATPANLKDSKDVFAGTLRAKSNAQELGLDLRAGTTLTFDAWVLRPELVLTAQRTKLDGYQEVGLASKTSYLCQASDVVSPTECGASDAPANAGDPPLRPLVIEAGKTPTGLEIRVGGQDTDSVQASLGFDISRPFAVGSLSVSPRVGATYVHEFADDAHDVAFQFAQDLRGAQARTYTFRTGDPDRDFGWINAGLSFVAANGAELDLEARTLVADERYDAWAVRALARLRF

SEQ ID NO: 17027 - protein, 1105 aa, Burkholderia sp.
MVYMKRFFMTAALTGLFVSNNSYAGESYLVYNPQNIAVFEVRFFNVGDGPFMPNWPSAAESTWDLGQQQKEKILDAMRYWAEVITPRPGQLPAIINVGTFNDENAAGSSDSVTNGIISLTRLQGALNGIDTGELTFGSHAQFIMGKMDFDNVPYVPAQLPRTGKVDLVSVAVHELAHGLGISNMVTDLHGSGTFTPAFENRPFGSWTSHLRDDCGNHARPGQVILCNGCNNRWDPQGFDVRLDKGYFTGEHVNEVLAGAMPGVPVKMLADDGWVDDDYMSHIELKNSMMSHQNYRNYTTFMEAELALLQDMGYQIDRRNFFGFSLYGNGQTLVNRNGYFQRNQQADGYLAGQYNTANLGVGLHVYGSNNHIFQQADLLTSGAGGAGIRIDGQNNTLSIEPGIRVYADGVNGRGVMFAYGKEHNLIQRGDVQALGTSGVAISFDFGNNLLGNEVDYRGSWLHIVDGYYDALLPELQGALVDNADISGRVAGKGAAIYISPNALVGNINILSGARLEGDIYSDYAEQDAYGQQRLTQLTFGRKANAYGQATEAADSAFRFAYRGNIEGINNLALDARGGKTSLNGDFQIYSMIIAPGATLSGNGSYTLNEEGHFVNNGILAPGNSLGQITISGAYQQGDTGQLVLEVDGRGRHDTLRVDGHAQFDGQLTFAPQPDWYATNWTLNSQDLLKTDSYSGKFSAVNSVLRSPTLTLQTTPQGKNSWQLSMLRASNAYSRYALDANARQVGQALDKIVADAKSDIQPLYRTLDFSAADGRSISHALPQLSAGAYSAMFASSLQREQQIARIIGGPHPAVMSKQLAEGEWRSFAIPFGGGYWQQRQGDSVGYDASSYGMVFGAEKQNDRNHNWIYGFHGAVSGQSVTVKSPETATGKTTAFDLGIHARYGAERSEGMYLFGTGRLGIEDSWMDRNIHVETYGANHHATWTGLTGSVTAGGGYRWALNDNMSAGPVTSLNYTTLHRPGVKESGNDGSRLMLDSETFDSLRSSIGVNGNWNVPLASGASIAADLQLTWDHELLDGNVEQQASFANYRSTSFSSRNQVAGRDTLGVKTGMRYKINTDVELGIGVESEMFRSGYNAIAGNLSATWRF

SEQ ID NO: 17028 - protein, 734 aa, Burkholderia sp.
MKRSVSIITIRKPLLAASAAAIAMTTSAAHAQSEPAAEGSGDIIVTAQKRAERLQDTPVPITAINTAELADHGVSRLQDYFSQVPGLSLNAQGNGKTNIIIRGITTAVFGNPTVAVSIDDVPFGATNATADGQLVQPDLDPADLERVEVLRGPQGTLYGASSLGGLIKYVTRDPSTEAVSGRVQGDVNTVRKGEAGYALRGSVNLPLSDTVAVRASGHMRRSPGYVDNVLSGQKDVNTVDVYGGRVAMMLKPNERIKVRLAVQHQDTRGDGTARTTTNFSLEPTFGDLKQRYLPDSGMFHTRSTLATANIDLDFDDVTITSVTGYGRNRNQERSDFSRSVGEPAAELANDMRTRKFTQEIRFAGQSGKPVEWMLGGFYTKEKSSSFQKIERVTPITGAPVAPAQTNIFTADFPTSYEELAAFGFVTVNFTSKFNIQGGMRYSGNRQTIFELDSGEFAGTLPGQPPVITADTAASDESFTFLVVPQYKFSPDLMAYARVASGYRPGGPNGAIFSDPTLPKSFKADTTMNYEAGVKGNLFDRHVTFDVSAYYIDWSKVHLQLIISGLSIFTNGGKASSKGIEGSFQYHNDSGLTIAANGSYGVARLEEDPPAAIPADKGTRLPFSPKFSGSLSIDQDFDIMEDWKASVGGTVAHVGRRFGPFQPVASRLNLPSYTTVDLRIGARNDDWSITAYVRNVADKRGVLSAAAEGSQAVTGVFGVNYVQPRTIGLSVARSF

SEQ ID NO: 17029 - protein, 678 aa, Burkholderia sp.
MNVRLAFTPLALAIGGALTTVATVSNAMASEEVTVDETVQVIGHQYEGYAEHMPQSGTKTDVEWLDVPQAVSVVTKTEMEDRGAVRLVDALDGVAGVNNTLGEGSRDQFVIRGFDALNDMYRDGMRDDGTLQSYRSLSNIERVEVVKGPAGALYGRGSAGGIINLVTKRANGDNFTNVNGSVGSNNQFVGQVDSSMAFSDKVNGRINLEHRQADSYVNHVDSNDFFIAPTIRVLPAEGHTVDLDVEYAHQELVPYRGVPSKNGKPVDVSESSFYGGTNDYQESDSLRVGINYEWRLNSEWVWTNRAAYNHIELEQKGTRQGTVTGDKVSQTVNNFGYDPRTTTTMQSELVWETDSNQMMIGADYNQINIDLTLASDKTLPPKHIYNPVVGATPDPGFKPFRDNTTTTTGIYLQDVYTLGDLSVIGNVRYDSMELEQQKAGKAQEKLDDNKVSYRGGLVYRINNDMSVYASLARSWQLPYSGIYINPKLAEFFHTDLKEVGAKAYLLDNALMLNAAIFQIDQEQPQTNINGDVINKIEARHQGIELEARGQITELWDISVGYSYLDAEDKDTGKKPNDVSDHLFSLWSTYQLYENWRLGGGVKYVGDRYAGNNEAVALGDYTTVDLMAAYTTGRHKVQANAYNVLGEKYILGATSGKSGTNQIGYGAPAEFMLSYGYQF

SEQ ID NO: 17030 - protein, 443 aa, Burkholderia sp.
MRKTGIAAALLLLGLSQAALAENRAETVTFAPYVGGYTFQGNQHVETSPVFGFRLGYNLTDNWALEGVVDYLKADLEGGGNIEMLRYGGDILYNFMPKSSLVPYLAAGFGGFNIDNSKTRGIVNYGGGLKWFLSDNFALRADVRGLNYSMGKIYTNVEYTLGLHVAVGAPKPAPAPVVVAEPVVEAAAPKAAPVVVAPPPPPPPAPASSLTAEPATLEKGKTTTLTWSSTNVSGCEIQPGIGPVSATGSTVITPAANTRYTLTCSGEGGKTSSTAGVEVTEPVKEESAKKASAVAAGARLSLKVNFDTGKSIIKKQYYDELKVVGDGLNEQKNLKGVIEGHTDNVGSDKSNLALSQRRANAVRDYIVKNFKIDRKRLAAKGYGESKPIADNATAEGREQNRRIEAVFEEIPNFKPDADEQQPVKPAKKAVKKKAAKKQAPAKR

SEQ ID NO: 17031 - protein, 790 aa, Burkholderia sp.
MKRGIGILSASAATLAVFAPGAGHAQDAAGPVVASGLEEITVTARRRAENIQSAPLSVSAFSSAALEERNVQSSSDITSFVPNVQFDSAASESGGGASSQISIRGIGQTDYVLTVEPAVGVYLDGVYIGKSMGSLLDAVDIDRLEVLRGPQGTLFGKNTIGGAIQLISKRPTDTLEGYGELTSGSYSRFDAKGAISGPLSDTVRARLSGAYQSRHGFVKRVTETGQDTGDRQGNVDRLSGRLAIEADLTSSLTATLTFDGTRIREQSPGQILVKADEGAAFSGAYNAGVPGGVCLPGAGASRFANPYCYNSQWVRPLKSLETTNSGPNYADTDVYGAGLNLEWKLGGATLKSITAWRKVKVDIAQDITGSPHYLNFIEQHIKTEQFSQEFQLLGDLADDKLHYVLGLYYLHESGTQLFPVQLTLVQFLSGGKIRNDSYAGFGQVTYDLTDQFSITGGLRYSDETRRFNPGVQVLQGYAAQTDVPGFVNLFAGAVGPAGTPLFPAGWYSRGSKSTTPMVSANYKFNRDVMAYASFSKGFKGGGFTMRYFPPVIPAPGTDPNDIVSYAGPEKATSYEVGLKTELFDRRLRFNVAAFYTDYKDIQVTYNIDPDGPGPIGNFVPVLANAASAKIKGVEVEASARLADWLRLDGSLGYTDADYKGFSAQALANYPTAGSFRVPNTPKWTANIGGTATLFDSDDKGTALVRVDYAYRSSQFKEFSNDPTLFQKGFGLLNASLTYKLPGDHIELSAGATNITDKTYIVSGVSNTGIGYTQATVSRPREWFVRAKYRL

SEQ ID NO: 17032 - protein, 998 aa, Burkholderia sp.
MVRTGEIRLRSLACGASILVLAGGLAGPALAQSAAQQSAEVDEVVVTGFRAAIQSAIAVKREESGVVDAIKAEDIAKFPDNNLAESLQRIPGVAITRSAGEGRNITVRGLGPGSTRVRINGMEALTTTGGSDADGGANRNRQFDFNVFASELFNSLAVRKTASASVEEGSLGATVDLTTSRPFDFGRDQVLSLSGQMGYNDLSKSWDPRVAGLFSKTFLDDTFGVLVSVAYSERGVREEGFNTVRWGEGTSNGGWCSPLGYDTNPSAAGQQFNPTTAAAGSSATNCFAGDPRIPGTPEAIAAYERASDRGSWHPRIPRYARLDYDQERLGITGALQWKPTDRTTVSFDYLYSNYKSHRTENYLEAISFSRNASSPEFGKAYMIPRVFDTDEHGTLTYGEFDNVDIRIESREDKLETIFSQYSLSGVHELTDTIRISGMIGTSKSSFKNPIQTTITFDRANQDGWIYDARDNPLLPNITWGFDITDPNAFTFTNASANGTVRPSEVRLRPQFVQNSFDIGAGDIAWEMNDTFTLKVGATWKKYVNDGQEYRRASEFALPAMPSGVTMGSLSEQLTGFGDGLGGDGIPSGWVIPDFDAVAQAYGIYSGTGTFALLGIESSNARGSWRTVKEESAAYYAQVDFDTDILPWRLRGDFGVRYVDTDVTAQGYRTLNSAPSQITVENSYDNWLPSANVVAEVTPDFLVRAAAAKVMVRPGLGSLNPGGTFNTTGNLTISAGNPFLKPAKANTYDLSFEWYPGGDSLVALGFFIKDFKTDFSTVRLTGPFSSFGLPAELLEGTGRTPNDEAQYTTTINTKGGDPLKGFEVNVQQPFTFLVDRFGMPEWTGNFGALFNYTYVKGTSIFCAGTPVNGECPANLTLENRPTNVSKNAYNATLFYEDAKFSARVSLSHRSKYLFAVPSGNQGNLTTGRRQDFQDADWVPSTTTVDANVSYQLTEKLRLTLEALNLTDEESRQFNDTDAQRVWTNHHFGRQFYFGARYSF

SEQ ID NO: 17033 - protein, 687 aa, Burkholderia sp.
MSSSGLFPSRPLWPLTPLALACLIVSGETLGADGRPSELPSQVITANPLGNQSPATPSSVLEGDELTLRQKGSLGETLNGLPGVSSTYFGPGASRPVIRGMDGDRIRLLRNGVGALDASSLSYDHAVPEDPNSVERLEVVRGPAALLYGGNAIGGVVNSFDNRIPSEPVDGIHGSGELRYGGADTTRSRSGALEAGDGNFALHVDAASREFNDVRIPGYAHSSRQRQIDGDTGKHRVQNSDGRQDGGAVGGSYHWEHGYAGLSYSGYDSNYGSPAEDDVRLKMQQDRYAFASEIRDLEGPFTSLKLDAAYTKYEHKEIEDGETGTTFKNEGYEGRIEARHRPLGPLNGVVGAQFANSRFSALGEEAFVPHTETDSAALFALEEWKLSDRLDLSFGARLEHTRVDPDAKGNERFAENDGSQSFTTGSLSSGAVYKLTPIWSLAATLSYTERAPTFYELYANGPHAATGTYEVGDADADKEKAVSTDLALRFDNGVHKGSVGVFYSRFSNYIGLLASGRQRNEEGEVVAAGDDEALPEYLYSGVRADFYGVEAQDRIHLLESPYGNFDLELSGDYTRAKNKDTGEPLPRIAPLRLNSALIWELQQWQARVDVEHAASQHRVPEEELSTDGYTTLGASLGYNFDLGESRWLAFVKGTNLTNQTVRYASSILRDRVPAAGRGVEAGVKVAF

SEQ ID NO: 17034 - protein, 211 aa, Burkholderia sp.
MIKKTFLYMPRFTCSLSTAWAEESPWTYRIGMSNIAFDTSAKVYLGGQRVPGGSADASNNNALTFDFGYAINDQWNARLIVGIPPTTKVKGAGTLPGIQLGKITYAPTLLTLNYNLPAFGPVRPHIGAGVNYTRILESKDANLKSFDADHAWSPALHVGADIDVSRNWFVSIDIRKLYLKTDASGYLGPQEAKAKVTLDPLITSIAIGRQF

SEQ ID NO: 17035 - protein, 547 aa, Burkholderia sp.
MRQVLSSLLVIAGLVSGQAIAAPESPPHADIRDSGFVYCVSGQVNTFNPSKASSGLIVDTLAAQFYDRLLDVDPYTYRLMPELAESWEVLDNGATYRFHLRRDVPFQKTDWFTPTRKMNADDVVFTFQRIFDRNNPWHNVNGSNFPYFDSLQFADNVKSVRKLDNHTVEFRLAQPDASFLWHLATHYASVMSAEYARKLEKEDRQEQLDRQPVGTGPYQLSEYRAGQFIRLQRHDDFWRGKPLMPQVVVDLGSGGTGRLSKLLTGECDVLAWPAASQLSILRDDPRLRLTLRPGMNVAYLAFNTAKPPLNNPAVRHALALAINNQRLMQSIYYGTAETAASILPRASWAYDNEAKITEYNPAKSREQLKSLGLENLTLKLWVPTRSQAWNPSPLKTAELIQADMAQVGVKVVIVPVEGRFQEARLMDMSHDLTLSGWATDSNDPDSFFRPLLSCAAIHSQTNLAHWCDPKFDSVLRKALSSQQLAARIEAYDEAQSILAQELPILPLASSLRLQAYRYDIKGLVLSPFGNASFAGVYREKQDEVKKP

SEQ ID NO: 17036 - protein, 455 aa, Burkholderia sp.
MNRSGAIAMQGDGKKRLWTLPLLLGAGLMTSAVAEESAERSKEGFIEGSELNLLLRNYYFNRDFRKGQSSPVGGGYSEEWAQGFMANFSSGFTRGTVGVGIDAFAQLGVRLDSGGGRSGAGGSVDLLPYDSQGRAQDDYSRAGGAVKLRWYGTVLRVGDVFPETPVVQFGNSRLFPSSFRGFTLVNDGLVDGLTLQAGKLDSMTQPNSTSARDDFYGFYGGRIDSPWVAYAGGDYQATEHWNLSLYSSRQKDAWDQYFAGTSFSYPLDENLSLLGGANYYKVKDEGKQVMGELNNNIWSVRGGFSYGPHQVLLSYQRNNGDNDFDYLRQTDSIYLDNSIQYSDFNSPKERSLMLRYDLDMAAFGVPGLSFMTRYGKGWDADYSGANSVYMRRDENGNPLTNQGRWERNVEVKYVVQSGAARDLSFRVRQATVRSDSFESDLDEVRLIVEYPLQVL

SEQ ID NO: 17037 - protein, 102 aa, Burkholderia sp.
MQADWVHAREKIEIHNPNQPEILQDYSYIKTHSNHPRFSIGYDFGNWRLALDYSHYDRCLENVRFKTHEASFGVRYRFQLNKFSFLFKRSNSSHYLQNEGKI

SEQ ID NO: 17038 - protein, 686 aa, Burkholderia sp.
MITWCDTHQRRRAFLNGVVPSVLIPLFLVAQTAVASPQQPPAAPAPPLELKRLSLEELSRIEVVSPSKEPEKAMRVPMAIYVITGDEIRRSGATSIPEALRLAPGVDVARIDGNKWSIGVRGFGSRLSRSVLVLIDGRTVYTTFFAGTYWEVQDTVMDDIDRIEVIRGPGGTIWGPNAVNGVINIITKHTRDTHGTLASVSSGSEEQGAFKVRYGGGNGATLDYRIYGKGFTRGPEYHPDARNFDDWRAAQTGFRVDWSNRPRETITVQGDLYREEAGERVTATSYTPPYTRDIDGNAHLSGGNILARWKKDLDSGDLQVQAYYDRTNRFEPNFDESRDTFDIDFLHHMRLPKDQQLLWGLGARVSVGKAPPVVSGLTFDPQNRTDQLYTAFLQDEIGLVDRRLSLTLGTKLLRTNFTSIDFEPSARLAWTPTDNQTVWAAFTHSLRTPSRAEEDFNLSGYITTAAGVPYFARFNANRNFAPEQLNGYELGYRRLMRHNVFIDVATFYNHYHDLFSEDITGPTFFESTPAPPHLLLPAQFRNDLLGVTTGVEVAPEWRPTSFWRLRGSYSFLHIDLKKAPGTAEIGTAPQIEGASPQHQGLFESSWELTRKLELDLTYRYVGALPSQAVPSYSTGDARFAWRVSRQLEVSAVGRNLLQPWHFEYLGDPGSLVGIKRSGYLSLTWTR

SEQ ID NO: 17039 - protein, 412 aa, Burkholderia sp.
MKNSTFLSLLAAGALAVPAFAQTAEPSDAPTAKWGPRIALEDNGIRPWVTVTGELWNNVDGDMIGGRDNLWNTLVDFGVEIDLGKFGGPATGMIVLQGHWTESSDSSGGLGSVGSHNSASNIWASDSLRAFNLYYTQSWNNGEYAVKIGQIAADDDFMGSDYSSLFLNGSFGTMPAATGATPRFGTDTVAYNGYPVAAPGVWFKWTPNEKYSWQNAIYLGGPGDDIHSNHGFDWKSLSSTGFLWMTEGAVNFDLAGKPSTFKLGGTLHTKDFENYDTGNTESTVYSLYFVHDFAISMNADKVGLGGFWRASITPQEDVATAFIYMDAGINWFAPFASRPDDVAGAALSWTKLGGAYKDSVNAENGNEFTLELTYKAQLTSYWTLQADVQYVINPVENDDNAIVLGLRTVLNF

SEQ ID NO: 17040 - protein, 456 aa, Burkholderia sp.
MSINRPCFAISVGLLGGLAWTGSALAGGFATARFGGEHGNPITSNPTAVYYNPAGLAESEGIHLFLDGNIALRAASYTHSAAATDDVTVPGANTGAASLFNVAASPMLGASARLGDLALGAGVYVPFGGAASWDTNAAFEGNRELAGPVDGVQRWHSIESSLQAMFFTLAAAYEIPALRLSLGLSGNLIRTQVNTVRARNASGDNLLATEGRSLLEVSGFHASFGVGALVEAVPEQLWIGASYQSRPNVTGGESLEGTLTNRFSGVSSSPSDVELHQGLPDIVRLGARFVPAERFEIRLFGDWTRWSSMENQCLTQVGAACEIDRDGFAGEGARVVQNIPRRWNDTFGVRAGWSHWPRPAIEVFGGVGYDSNAVPDETLDPSGVDFHDVSFALGGRFHVAKQLHLAASYTHLFYVSRDTTGDSITAGLHPNSRAPDSGGHYAQSIGVINLNVDVAF

SEQ ID NO: 17041 - protein, 735 aa, Burkholderia sp.
MALPLSAHAAATAAPDAREFDRVQVTATRTERAVSDVAATVDVIDREQMDRHLVQDIKDLVRYEPGLSVTRSATRFGLDGFRIRGLDGNRVRIQTDGIVMPTRFDIGSFASSNRNFTDLDTLKRVEIVRGPASSLYGSDALGGVVAFVTKDPADYLKGGKNSYFGLKFGYDGEWKGLLGGATAAFGGDHWSGLVNVNHHQGQETDNKGTVRSDNDTRTAANPQDRDGRSLLSKLVYAPSEDQRFRLTVEGNEDTTDTNVLSAIASVAPRPGAMAAATGMKSHDTQKRNRVSFAHEMDALDQPFADSLHWQVYAQNSETRQQTDETRTDGTRRHRVFSFDQHAYGLQAQFNKAFTTGSVEHALTYGFEGTRTEIRQKRDGYQVSKAGVVSNTVLPDTFPVRDFPISKTTELGLYAQDEMRFADGRLSLVPGVRVDRYELKPEVDSIFAEDNPTTAVAQLKKTSVSPKLGMVWRFTDEWSLFAGYARGFRSPPYNDVNIGLTNVAFRYTAVANPDLKPETSDGYELGLRFIAPAAYVSVSGYYNDYKDFIQSNVDTGRNAQGLTVFQSQNIADARIYGAEMKAGIEFGELSPALKGWALRSALAWSRGDNRTDDEPLASVDPLRGTLGLMYDTDTWGVELAGTFVQRKKRLPPPAAQTNPNAPAPFVYQPAGYGVLDLMAHWNFAPGATFNVGVFNLADKRYIEWSSITPSLITDRALSDRFSSPGRTFSASLAVSW

SEQ ID NO: 17042 - protein, 1981 aa, Geobacter metallireducens
MKRLTYRRKFCVHHFGRRKARVTSLMRVLLSAMLLKLGLSAVTATAANVYSGQVTSGVVVTSGQTQSVYGGGLAIGTVLQGKNAQYASAGQVMLIGGQASGTIVNSGGDMYLTGGSSTDASINNQGYEWVSAGGVSLNTKVNAGGTEYVYSGGQSLNETVNSGGAFTANNGASVSGLTVNSGATVYMDTRATVSGTQTDSTGTHNISVSGGVTSGYVVDKGALYVYSGTHSENTLVHSGGSEIVYSQGTAIGTTVNSGGQQSVQLSGTVSGTHVESGAQLVVAQGGTAMGVVADSGAILMLNTSANVTGKNVSGGKSSDFYIAGNVASGVVLQGSGFASGGLSVSSGATSYDTTVNYQARETISAGGTSVDATVNSGGIQMVSSGAAASAATINTGGQQIVMQGGNVFGTDVKSGGVQTLSGGTATSTTVESGAVQTVSSGGVAKSTEVYAGGSQTVAYGGTASGTNVYSGGTQTVSSGGTVIGTSVASGGTQNVMFGGKASNTTLYDGATQVVATGGTILGNVSSGGAGPVQPGGGAAGTIISSGGTEVVASGGATSNTTVAAGGTELVSGGVASNTTVSSGGKETISDGGVASGTLVASGGQQTVASGGVSDGATIASGGSATVTNGGVASGTTVAAGGNQTVASGGNAVGTQVTGGTQAVQVGGQVSGSQVTSGGVENVAGGAATGTTVSAGGTQSVSGSGVASGTTVGSGGSQSVTSGGAASGTSVSAGGAQTVGSGGQATGTVVQAGGTQNVSGGFASGTTVNSGGVVSVVSSGETVGASVGSGGTETVAQGGTAANTTVSSGGTQAITSGGAASGTILSGGAELVGTGGTSTDAQVSSGGVQSVAGGRTSGTTVSGGGVQDVLANGTAIDTSVASGGSQVVEHGGIAAGTDIGAGGTQTVVSGGLATSTTVSSGGTQNVLAGGAAVGGVINGGGVQSVASGGVATSASVESGGVEKVQAGGVANGTDVGSGGLQIITSGGLANSASLNGGTQLVADGGNAVSSIINNGGVQDVASGGSAQGATIHSGGTQTLESGASASGTVVGAGGLEHIASGASASGTTLNGSGSLVVEDGGTATGLTQNAGGALTVSTDGNVTGVYVSGGSSSTFTISGGNASGIVLETGGGLTVHSGGAANSTVVNNGGALTVQDGGSATNVVQHAGGILHLTTNDEVSGAYVVPGAQSAFSIHNHVASSIVLEKGGTLGVLAGGTAFDTTINSAGQEDVYSGGVASRSIVNYSGLQVVHSGGTSIDTTVNSGGTQLVQSGGVASNTTVSSGGAQILQDGVVASRTMVSSGGMQNVNSGGVASSTTVVSGGVQNINSGGAALDTNLNSGAVQNIASGGITSNTTVSSGGVEAVYAGGASYNATIKAGGLQYVDGDVEGYSYNAVVESGGTQQVAFGGEADNALVHAGGLQTVDATGIAVSASIAGTQIVHLGGEARDTVVLPGGVQSIEVGGLGTSTTATSGTVIVDGVLNKLTAKASQIAGIGTIGSDLEVTQGSTLHADMPGAGLHVNGNLSFASGSTYQVAVTPQQAGVTNVNGNVTVAEGSTLRIVASPGAYSPATQYALVKYTGTETGQFNVIETNLAYLTPTVSYNVGEISLSLKENSGFTGQGFVLPGAATNANGVAVALNSIYAAGGNALTAALITASRDQAESIMTSLSGDELGVTTQVAMNRTSQMQELIAQRVTTNGIDRGNGLWAAAAGQHDSVSSDPATGASGWQDTSAIVAVGYDRSVGATTKAGVAVSFGTDDVSFNSRDADSRINGVQAVLYGAWMPSTTAAYVMGEVGFGYWNTNEHRKVAIGDSTLKANGSFTTLAETAYLEGGLDLKTSAGAVKPYAGLRIGHYGQDSVSEGGDTIALNVGSTSYNAVSSVLGVRFQSVPRNVFGKAVQFEADLSWDHRLNGGDHAVTASFIGAPGASWQAFSTSTERDSGRLSLGGTLQATKSASVFGRVVGQIGGHTADYGVQAGAEWKW

SEQ ID NO: 17043 - protein, 740 aa, Geobacter metallireducens
MPESAETVSGRVTEAEFDDYGVPGVTVQVEGSERSAVTNADGRFTLEGVADGPVVLLLDAPDYAAARVQLSPEARARPVAVALTWEGGEVTELTVPARAQPETASTTQLTPRDIDSAPRRNAEEVLRQVPGLTLVQHGSEGKGHQFFMRGFDAIHGADLELTLDGLPLNEWSNIHAQGYLDLALIIPELIQGVVVTKGPFTLEQGAFAMAGSADFQLGTPLDERGWRAAYTAGTTNRHRVFTSYSPAEGDGQQFVGIEATHDDGFGDRRRIDRGTFNGRVRLFDLGAGGAAYLTGLGSYSAFELPGTLRNDDVEAGLVDFRGAYDPLARGTSARGLASLRYAWERDDHEFALTGYGGYRRLELLENFTGFLINPEHGDRRDQVQETGSFGLIATHESRLLESLALRTGLGLRGDVFSQRERSVGQGLELLAERRELDGVQLIAHALAGLRWTPGERVRIDAGARVDMIHVGVRDGLEDDARGGDTLAVVSPRLTAEWSPRDRWGLFLAYGRGFRPPEARAFSSFDPNRVGLGDEVFTGGAPVATVSDGVELGTRWSPAAWLGFSLAGFATFIERESVFDHVSGVNLDLNGTRRLGGELVLSSSPLPWLSLSADLTMVDARFVGSGARVPFAPWLTAGARAVVTHDSGFRAGLRALTVAPRTLPHGARGATMVRTDATLGYRWRWLRVDLEVENLINQALREGEYHYASHWRPGEPAREIPVLHTTAGPPINARLTLGVQF

SEQ ID NO: 17044 - protein, 144 aa, Geobacter metallireducens
TRTQVETVDAILRYGHFLSGELGTGRWFQGRHELLVEVPLHLTLDPRVRTMTGGYLLGSWKFTSLEGLAPYVFAGGGILYNDLGLDTQGTRLNFSYQGGTGLQWFVRPDTALGIEYRYHHVSNAGTAEPNEPLNSSKFLLGVSV

SEQ ID NO: 17045 - protein, 649 aa, Geobacter metallireducens
MLLLSGSVLLMASSLAWSAEFSASFKGTDIQEFINTVSKNLNKTVIIDPSVSGTITVRSYDMMNEEQYYQFFLSVLDVYGFTVIPMDNNVLKIIRSKDAKSTSMPLATDRQPGIGDEVVTRVVPVNNVAARDFGRSSRVERQRVAWDVWRLRTCERRRDDWPRGVIHAVMTIVERVDQTGDRNVTTIPLSYASSTEVVKMVNELNKMDEKSALPGMLTANVVADERTNSAAGFGEPNSRQRVIDMVKQLDRQQAVQGNTKVIYLKYAKAADLVEVLTGVGDSIQTDQQNALPALRKDISIKAHEQTNSLIVNAAPDIMRDLEQVIAQLDIRRPQVLVEAIIAEVQDADGMNLGVQWANKNAGVTQFTNTGLPITTMMAGADQFRRDGTLGTAATTALGGFNGIAAGFYQGNWGMLMTALSSNSKNDILATPSIVTLDNMEATFNVGQEVPVLAGSQTTSGDNVFQTVERKTVGIKLKVKPQINEGDSVLLEIEQEVSSVADAASSSSTNLGATFNTRTVNNAVLVSSGDTVVVGGLLDKSTNESANKVPLLGDIPVLGYLFRSNSTETKKRNLMLFIRPSIIRDRSQFQSASASKYHSFSAEENKQRNVSNGEGGLLDNDLLRLPEGGNAYTFRQVQSSIVAFYPAGGK

SEQ ID NO: 17046 - protein, 282 aa, Geobacter metallireducens
MKYKIVKTTITGLGLLLPFYASMSFGMSNTLANQVSPISFGVLYKLSHPFFNNFSIEETQILHDVATERVVGLKHDLLESADKLVDNLYNFDLSEDYVPKYDNSLFGLSFFIGYSFQNFRIELESFYEKFDVQDTKSHIVDDNYRYFALYRHGPAKHINYVTLKNDGIELNSVMLNICYDFTLNNTYITPFSCVGIGGDIISIFNTVKVKIAAQAKVGVNYLISERISLFVDGYYHGVIDNEYSNIPVQYPRNLFYAPKVTSALANLDIGYFGAEIGMKVFI

SEQ ID NO: 17047 - protein, 1018 aa, Geobacter metallireducens
MSFQAFTFCIFFSVSAYAQSAGGLAGISGVVRDPSGSLIPKAKVVIKNEDKGVSRTLVTNEAGLFAAPALTPAPGYKVAVTAAGFAGYEARDLVLQVGQNLDLNIKLTVAQASTEVDVTAAAPLVEDTKSDVSQVIDSQQITELPINGRRVDSFVLLTPGVTTDGTFGLLTFRGVAGHNSFLVDGNDSTEQFYNENAGRTRIASGLSQDVVQEFQVVSANFSAEYGRAMGGVVNQVTRSGGNNFHGTAYWFFRNQDFNARDTFAAFNPDETRHQAGGTIGGPILKNKLFFLLNTEVTRRNFPMVDSYVRAGIIDPNTQTWIGCGAPATPAQCNAINALLPRYFGAIPRTLDQELYFGKLDYRLNDRNTLSASLNYLHANSPNGIQTGITSTSGAGVNSNGDDSVRIRNGRFSWTAIPKNSFVNEFRWGWFTDRQGDTFDNSTLGTGLGFLQASVAGVSLGQANYLPRVEPNEQRFQFVDNATWTKGKHVIKFGADIATTEDYTYFISNYYGNYTYQTVTNFALDYTNASASATNPGKHWQTYQQTFGGPVVDASINDYGFYLQDQWRATQRLTLSLGARYEYGQLPQPKQCNPDYPQTCHIGQGNKNLAPRLGLTYRIDDNTVLRAGFGMFHSRFIASLIDNLFTNNAVLQTSLSLSSTLAPQFALGPTFPNTLGSAPSAGTASAFTLQFMDPHFRTPYSEQGTIALERELVRNLALTASYVWSRGIQIIGVRDLNFPALSNTTFTYAIDDASGNQTGTYTTPLYLGSRPDPRYGGIYQAENGVNSYYNALAVQLRKRFSHGLQADLSYTWAHEIDDGQSNGSGALFFTSASNWTYNGNYKQDKGNGALDQRHRLIFSFVWLPTVTRRTDAFSRYVLNNWQLSSITTMQSGRPTNTFLRTTDTPFPGMFSASTLDGSGLSSRVPFLAPNSLFTPAQYRADVRISKLIPVSEKIKAAFNFEVFNLSNSVAYTSITNQVYQETKGVLTLTPSAYGVGSADGGFPDGTQARRMQIGLRVTF

SEQ ID NO: 17048 - protein, 417 aa, Geobacter metallireducens
MRRKYVLVAAVVTTLAGQEVGARTLEDVLKEKGVITEQDYKEVTKSKAQSYKIGKGFTLTSSEEKFQMSLGGRLQTRYTYTDGEDSSLTPNASRWEVRRMKLWINGYAYNKDLTYLLQVDFVSGGSSRLLEHAYLNYRFIDEVQLLAGQTKVPFGRQWLNSSGSQQFVDRSITSDTFRPGYDAGAKLGGDLFGGISTYEIGAYGGAGQSATRATNGDNTATAIAARVTVNPFGKMPYSESDLDDTATPLLSIGANYYGNTLRKTAATTFETNNITLAGTNGWLGRNVAAFATGELVDIDSYGADAAFKWRGVFALTEYLYGRGKGGDSGSIVRAHGWYAQAGYCIVPQTLEVALRYAFIDPNRAVSDDQRTDVSAAVSYYFNKHNLKIQGDVTNAHDQSKGSGVDDQIYRLQAQIIF

SEQ ID NO: 17049 - protein, 853 aa, Geobacter metallireducens
MKHRLLLLLLFVFTAVMTGWAQNSAMPSYTVKGVLLDSLTQDGEPYATIKITKKGAPDKAVKMAVTGANGRFQEKLNVGAGDYVITISSIGKAPVTKEFTLKPSVRVIDLGTMLSAEANNELKGVEVVAQKPLVKVDVDKIEYNIEDDPDSKSNSILEMLRKVPLVTVDGEDNIQVNGSSSFKIHVNGKPNNMMSNNPKEVLKSMPANSIKYIEVITSPGAKYDAEGVGGILNIVTVGGGFEGYTATFRANASNYGAGAGGYAMVKQGKMTVSANYNFNYNDRPRGYSDSYRENYESDTEKYLESNSSSKSKGNFQYGNLEGSYEIDTLRLLTVAFGMYGSNSKNYGDGFTTMYGANHEDIAYSYRTGNHGDGSWYSINGNIDYQRTSRKNKQRMITFSYKINTQPQTSNSNTGYEDIHAKEEVDDLVKRLLLKNSQSDGKTNTMEQTFQVDYTTPIGELHTVEAGAKYIFRRNTSDNKLYEAAGGSDDYLYNEDRSSDYRHLNHILAAYLGYTLKYKDFTFKPGVRYEQTVQRVKYIVGPGENFHTNFSDLVPSVSLGMKLGKTQNMRVGYNMRIWRPGIWNLNPYFNNLNPMFITQGNSNLKSEKSHAFDLSYSNFSAKFNINVSLRHSFNNNSIENISRLITAPEGEMFDNDPTHIAPEGALYSTYANIGKSRNTGMSLYLNWNASPKTRLYVNGRGNYSDLKSEAQGLHNYGWNGSFYGGVQHTLPLKIRLSLNGGGSTPYINLQGKGSGYYYYSLGASRSFLKDERLSLNVYCSNIFEKYRSYNNHTEGVNFLSKSSSKWPSRSFGVSISYRIGELKASVKKAARSINNDDVKGGGGEGGNTGGGGGQ

SEQ ID NO: 17050 - protein, 790 aa, Geobacter metallireducens
MKRILFIGALLSSGSYGTLAVAQDSQDSKKLPPVTVTADGQPKNVQQNGKKNTRGRTARRSRQAAPQNQQPAQQQQQQQQPVGVLAPQNQILSTAPRPAGASSVTPQGIAILGGPAQTSFYQALTMTPSVLVESPDPYGLSPTRNINIRGKGDFHLSKNIEGLPLMGIVGGTDLYDLENIRRIDIYRGAVPSDQSLGLSNASGVINQLILGPQDKAGVTGRQAFGSDSFYKTFVRVDTGLLPETGTKAFMSLSNIGADKWKGAGDNERQNVTLGINQAIGERITVDVNAVYNKFDGNAYRGLSYAQTQDIRHNYMFDYNTVLTGNPATDVNYYKYNRTTAEDFAVLAKVDYNFAPGQHLLFKPYFWNNNGYNYSAAGNQVQIWRQQNQNIGNVFEYTGKFATGTDVVAGYWWQSVQPPPPPTDQRRFTVNAGNLVFANWQSLAKIDDFSVNSPYFQVSQQFGATFVTAGVRYMILGAPHMQYFNTAGIPDGTYDQALATNPALYPDANVQARDYTAWLPNIAVRQDLNSVLSANVSYGRRFGRPDWGPQASNYISNRTTFLGKGYTLQTLVDKVRPEIADQFDASLRYSNNGLTIVPGVFYAKHQNKQVKIVDPTIGPNIAYYQGTGSSTEYGAELEASYALTGRLAVFGTGTWVSETFDSDTPTLSGGATLATKGKQIPNAPQVMVKGGVTYQWDGLSISPIVRYIGPRYGDAANTQRVPGYTVADFTASYDLGRHLGIESVKASFSVLNIFDRRYVSQISPNDTDLSAGANYYAGAPRTVVGSLSIRF

SEQ ID NO: 17051 - protein, 727 aa, Geobacter metallireducens
MKRLKSVTILLASAATVSSIGTARAGNEGAYELGMIHVTAPVGEGSEFGEFGGSTISNAQTETYNKPTLDKALELVPGVVAAPSGNQRNETNIYVHGFDRLQVPLSIDGVRIYLPADNRLDFSRFLTDDIAQIQIAKGYVSVLDGPGGLGGAINLVTKKPVKAYEGEWRSQAEFGNNGKFDGFKNYARVGSKQENFYVQASGTWRKVEGWELPSSFTPTATENGGRRDFSDSKDWSVNLKAGWTPNLTDEYSINFIKQNGSKNAPYNIEPTASQKYWSWPYWNVQILSAATKTEIGDDAYVKTRTFWETFDNAIDMWDNAAQSQRYSSSAARSIYQDWAVGNALEIGKDFGTFDTLKLATHVRRDSHSEWNELFTDQYGLNAATTPKSASCGTSIASSSTCFVEPKQTSTEDTYSVATENTVHITPSFDWVQGIGYDWRHLSRAEEFVVGQYKSGRYYQPSWINYKLTDDSAFNWQSAAIWRYSDTAKLFLNISDRTRFPTLFERYSSRFGTAASNPELRPERAVNYQLGWTNAFAPKSQVSVLVYYADVRDMIQSVATGKSYTDPISGKVSPITQNQNVGDGHRYGVDFAVDYAVGASMILGGNVSYIHNVLTNPSDPTVQQTGIPAVKGMLYASYSPIESVTLTPSLQFADDRWSAKNEVIANKSVSSYVKTGAYTLANFTAEYRMRDNFTWSAGVKNIFDQEYSLAWGYPEAGRSYYIGAKATF

SEQ ID NO: 17052 - protein, 427 aa, Geobacter metallireducens
MINLKRALLLASCASLANAAGYKIPEQSSDAVALSASNIAYSFGPDAAYYNPANMMYFEDSRHYFENSFSYIHLGSSTFNPQFPNAHNYAVSSKNADFLIPTFNFISPEYIPNWRFGLSFAVPSGLDMRWVDKYPASTARLFSLRVFEINPSVAYRVNDKISIGAGARAIYSYGKVDTNPYGMVSNSFLLEANRHIDGNDLSFGWNVAATYRPFSNLSFAATYRSKVNLDLKGDANIVSKTTPNLSALAGFNGFYNGSVDVKIPLPAALNLAMAYKVKDVTFLAALERSFWSELVSFNFNYATRVPSEEVFDHPVEKKWKDSNTYRFGIVWDVNDKLRLMSGFAYDESPSNVNYIGFELPDTRAYIYSLGINYKFRDDLEFAIGYLYQQRKDRHINKEDNVASFNNIVGEMANGDAQILNFGIKYRF

SEQ ID NO: 17053 - protein, 455 aa, Geobacter metallireducens
MKKQTQLLSALALSVGLTLSASFQAVASIPGQVADQAPLPSLAPMLEKVLPAVVSVRVEGTASQGQKIPEEFKKFFGDDLPDQPAQPFEGLGSGVIINASKGYVLTNNHVINQAQKISIQLNDGREFDAKLIGSDDQSDIALLQIQNPSKLTQIAIADSDKLRVGDFAVAVGNPFGLGQTATSGIVSALGRSGLNLEGLENFIQTDASINRGNSGGALLNLNGELIGINTAILAPGGGSVGIGFAIPSNMARTLAQQLIDFGEIKRGLLGIKGTEMSADIAKAFNLDVQRGAFVSEVLPGSGSAKAGVKAGDIITSLNGKPLNSFAELRSRIATTEPGTKVKLGLLRNGKPLEVEVTLDTSTSSSASAEMITPALEGATLSDGQLKDGGKGIKIDEVVKGSPAAQAGLQKDDVIIGVNRDRVNSIAEMRKVLAAKPAIIALQIVRGNESIYLLMR

SEQ ID NO: 17054 - protein, 632 aa, Pelobacter carbinolicus
MLGMIILMSASSQAVPLSELADPDFRLQQSRDGLLNSNRRNQGSMSQIINVSDLETQNRLFPKSDRRLPLKQSHGGSLSQVTNVSDLRDVSPTEWAYEALRGLVERYGCIVGYPDRTFRGQRSLSRHEFAAGLNACLNTLERLLQENVAVLREDIEKLKRLAREFEGELMALGARVGNLEARTAYLENHQFSTTTKLTGEIVVGLTGITQGEKNEGTEEINKVTNLGYRGRLELNTSFDGDDSLYIRLATGTVPVYSDIAGTFEGDFGFSQPDDSNLAVELIIYEFALAENLRMFVEPVGGAFDDFTPTINFLDGDGASGALSAFGTRNPLYYMADGPGIGFQGTLFEVFEWSAGYLATEGNNPGLGRGMFNGPYGAIGQIAYKPSDDFTVAFTYVHGYNNLDTGTGTRRSNFQAFIEEEFETDVRTVNNSYGMEFSWRIAPKFVLGGWAGVTKSRTQNAINIVRELVAEEMPVEEPVIAAVPPEEIATEELLTEEGLPQETSVEEPPVQEVIPEEIATEEVPTEELLTIDRGNMDIWNWAVTLAFPDAFKEGDTAAVIFGMQPWVSKSNLNLPDGLRNNDRDTSYHIEAFYQYPLNDNISITPGIIVITAPDYDNKNDALVIGTIRTTFSF

SEQ ID NO: 17055 - protein, 748 aa, Pelobacter carbinolicus
MRFMTSTFLRHAPAAREGHARRRRRAITLTVPALAAGAFHLAPAVAQTSEAVHGHGTLGASGVASRAETDAASAKSDGAVREAASRTATGAAPDATTLPTIEIVAAPESTPLVVVTDPKTPRQPLPASDGADYLKTIPGFASIRSGGTNGDPVLRGMFGSRLNILANGMPTLGACPGRMDAPTSYIASESYDKVTLVKGPQTVLYGPSASAGTVLFERVTPRFKTPGMRFDGSVVGGSFGRNDQNVDVTAGTPDFYGRVSANHAHSQDYEDGNGRTVPSQWDKWNADAALGWTPDDNTRLELTAGTGDGYARYAGRGMDGAHFRRETFGLKFDKKHIGDVLDRIEAQVFYNEADHVMDNYTLRMPDPTSSMPMRMASEVRRRTLGARVAATLRLTDAFKLVTGVDAQSNRLDSRSAMGMQNYGDKPWNPQANMWNAGAFGELTWYASDASRVIGGARIDYAAARDKRATTGGMKMSMRNPTFDDLRSRVLPSGFVRYERDLASLPVTWYAGIGHAQRFPDYWELFSAKRGPNGSINAFSAIKPEKTTQLDIGAQYKSDKLDAWVSAYAGYVQDFILFDYATGPMGQITRATNVNAQIMGGEVGASWRPLAPWRFEGSLAYAWGRNVQSGAPLPQMPPLEARFGVEYTRGPWSAGGLWRVVAPQHRYALNEGNVVGKDFGPSAGFGVLSLHAQYNVSKTVQISVGVDNVLDKTYAEHLNLAGNAGFGYPANLPVTEPGRTAWVRLSTKL

SEQ ID NO: 17056 - protein, 693 aa, Pelobacter carbinolicus
MKLLYYLPMLLCLAYTARGEEIEKDTAKIRNVELNEVVVQSFKQQRDLRLEPLSASAVTGTAIQNRNITGIKEFSSFIPNLFMPDYGSKLTSPVYIRGIGSKINAPSVGLYVDGIPYFEKSAFDFDFNEVDRIEVLRGPQGTLYGRNTMGGIINVYTKSPLKYEGTNVWLSNGSYGYRDYALSHYKKIGEKFGYAISGDYRNSDGYFTNLFTDKKADDMKSGSARIRLEWKLQKNLSFGLMSSFDRSVQGGYPYAVCDSVTHKPGEVDYNDYSFYKRTLSTTGFSADYQGTGYSINSRTAFQYLSDHQGIDQDFSPRSIYFARQDMKQKMFSEELNIKSTTPGRYKWLFGAFGFWQGIDNTVTLDYFTKDYATRKLYDTPAYGVAFYHQSTIDDLLTRGLSLTFGIRYDYEHTSNDFLFYKETDGGSEQMDAFDSRLKFSQVTPKIALQYMFPSTGMLYATVTKGYKTGGFNTSFDREEDRTFRPETSWNYELGAKHPFLDNRLNAEFCFFWIDWKNQQIYQMLATQNGQYLRNAGRSESKGVEVSLQGNPVNGLMVQVNYGFTHATFKDYKDERRGIDYSGNFLPMVPRHTFAVGADYTIPNPCRHIDRFTVSANYTGTGRILWKEDNKVSQPYYGLLNAKVSATKDFITFAIWAKNMTGADYSAFYFETGGKGLAQKGRPFTIGGNIQLSF

SEQ ID NO: 17057 - protein, 922 aa, Pelobacter carbinolicus
MKNRILGTTAFALVAASPFAALAQSADQAVVTAPSAAEATEIDEIIVTGSYRRSLEEAVDIKRKTVGFSDSIVATDVANFPEQNLAEALQRIPGVTIERNKGLGQRVNVRGLPSEFTFVSINGLATASGSGGRDVEFDIFASEIIQQVTVQKSPRAADEEGGIAGSVNISTARPFDYAGRRVVGSVEGAYNSISEKTDPKLSFLASDTWGDLGALVSFSTARRTNRTDSNSGINFRPMTRFLANSTGARGAQAMAVLARDAGVVVQNRANTAETDRIIFQDKVGDRAYLNTQDQWGGALSLQYRPSSNFSLAFDALIGRYETTEDEYDAAAYSASSRSTLETIHEYDKTTLADSGLIVLRDVSYTLTQHEMLSKERINETDYRQFGTELNWSGDSWKLHALAGYSGAEKTLDYANLKHTVYAPSRTRWTAQGGETIKSANPASIDMYNSPSSYLFEGYETSLEQISDDKYAAQIDFTKDLNLDFFPALTSVQVGARYTDKSKERQYGSLNIQGTGAGKVDYLGRPMSQSELTAISDLVPGGAYSVRDLTWSQVSNDYARRTFRYDGFYTPFNVGDYYEVSEEVVSLYAMADLNFDLGAVPVAVNGGARYVDTSITSSGYHQIQNPNGSTGYTPEPVSSDGSYDKVLPSLNITADLTDSLIFRAAASETLIRPALTDLAYKRTASWNSFRFTDGNPNLKPTYAKQWEVGLEQYLGDGGLLAVSYFWKEIEGVVRQALTGTVPNVTKYNANGSIDGVYTFDVYQPINEPGSYEVSGVELVAVVPFGQFYAPLEGFGINANYTVLDSSLTSTTKLGISMPPVGLADNTYNFTLYYDNSKFQARASYNFKDKYVEGIGYEMYPIWREGYGQIDLSASYNVTDSLQINLEGINVTDEATKGYTMDPSFPTMYELSGRRINLGLRMEF

SEQ ID NO: 17058 - protein, 962 aa, Pelobacter carbinolicus
MQSAASKHALRRHRPEPLSAPPHATPRIRAVATEGVGDLRPCPLTGFGLPFPIMRVPSMQLPRPFHRLSCAIAVVLSTPSLACAAEMTATTLDSVNVQATHAAAPGSLNEQRLSNSVNSVMSKQQIDAIPSGGIANVVAHMPGLSAYSDMHLGQATTGENAYVSIRGMDASYNAYTLNGFGMPETDSSTRAISLNMLAPFGIQSVQVSKSPTPDMPGDSIGGAINMRTPNAFDFAQDVYAKSTAQGQFNALAHHLGGKDSGGTFQQELAWKFGQGDAFGIYASAYYGKNNNMAQAPAPNSKYVPADPTLAQATDLRDVGPLISTRYKYSLYTSQIERYGGTLSLDWQGDTSALYARAIYGSYGVTGTQDQSSARLETYRKQPTAVRGGYFNTHDIDETLATLQLGGETTLDRLRFDYGSSFGRGTRSRPDYVSTSLYGFTPGSFAFDLSDPTYPSIGPSSPALKDFFYNLDSSLLWKVQGHDAGSHDNRFNAHTDIAYQVDGAVLDSVKLGLSADHSEREAYDHPFFHKDGNFVTNGPYFGGPNYAFPTAGGPPLSTIPGRITDNAFDGHYAGPFKLLDRGWMRAQALPYKYIDDPNGAGSYTANDYNANTTSSNEAIYSGYAMAALHIGAVSVLPGVRYELTRYAADSWQSSGDGRNGSFVDTGSTYGKVLPGISINYRPDDLTVYRAALRRSFSRPAFGLISGETVYSIDDTQKVVGISKPNPNLQASTADNADLSAEFYDHNGGVLSASTYYKRINGFIYTSQSATSNDSTLGGLVPTGTTFENGVPVTMPQNGGTAKLYGLELAASKRLQQLPGLWSNLGVTANLTLQHSQADSKRSDQPEKTWLPRAPERIYNLDLFYDDTHLRMDLSYNYTGLQLLGLTTDRLNYYLQPVKSLDFNATYHLPHHIDVGVAAKNLLNAATFYETQGKSKRYMAYDPGADGAYVQTGRTYMLTLGYTY

SEQ ID NO: 17059 - protein, 827 aa, Pelobacter carbinolicus
MAHRQPPALPAPASVRPYCPTIRETPASPVSRSRYRSLLPVLIGTTVCFSVARAADTPATTKPPVQQTAAQAQAVKPPRAEHIIVHRISDSAPGNQPGGGLIHLQDGVKSVSTVSQDFISKQAPMATAFQLASMLPGANVASSDPMGFSPNTNITVRGLDNSAIGYVLEGMPLNDVAYYSGTPSQFADSENYQEIALAQGSADLDSPVLNAAGGLMNLTFRDPAKKAGGDASVSYGSYNTNREFIRLDTGDIAHTGIRGFVSYSHGATDNWRGPGRDEKQHVDFKFLKEWGQGNRASLLGSFNTTITSWYPEPTMNSWKSDGIKGQNNLLAHYDSSNPENGANYWRLRRDGERTLYGGAPVHLTLTDRLSLDVTPYAQFAYGNWPGGSTMSTSGLYQGTQALSDTLNLPGAQDGVGVVRADYTQRSYRSGFTSALHYKTRWNDFVLGYWYDYGDDNEQQPFTAVQTNGYAPDIWAENGKDVIRLSNGERLLGGSFHTISQTNALFVGDHMSLLHDHLAIDLGFKAVMMSRDGTNSLPGPQYHVASNSMEPLPRLGVRWRIDGENQLFFNATTNFRAPDQTALYNTYDPSSGEMYGTGSTDVRNEYSISEELGYRRTGRWIIGSLTLFNYNFTNRQISTQAVQNGSIVSTTMNAGGQTSRGVDVEIGLRPWHHFSPYVSGEYLHATIDNDLMSGGDLLRTRGKIAVRSPTLQAAAGLSYDDGHIFGVATVHYTGHQYATFMNDERVSDHTTGDLAIGYRFSDHVHLHQPTLRMNFINITNEHYLSGVASPTLNAKDTTGVYGTTIAGSAPSYYIGGGFAALFTASTGF

SEQ ID NO: 17060 - protein, 464 aa, Pelobacter carbinolicus
MVMQHAKPGRVALAVMGALLVTALPAKMSYAEGFIDDSTLTGGIYYWQRDRDRKELTPNSPDYGKYKANLHHSTFNANLDFSSGYLGDFFGIDLAAFGAVELNNSGPAAPNEIGFSDAKSRWDEKWTGDRSGVSIYKAAAKFKLGHFWAQGGYIQPKGQTLLRPHWSFLPGTYRGAEAGAVFDFDKNGELSFSYMWTDEYKAPWYRNMYNFRKADLETNISYLHSFGAKYDFKNSLVLEAAFGQADGYIDQYFGKVSYDFPIANNTLKTSYQFYGAKDKVTGGGINDVYDGLAWLQAFTLGYTYNVFDFKVEGTWVKAEGNQGYFLQRMTPGWATSNGRLDIWWDGRSDFNANGEKALYAGVMYDLKNWDLPGWAIGTSYVYAWDAKPSSNPIYDQSKRIRESAWNADIMYTVQEGRAKGTLFKLHYTRYDNHSDIPSYEGGFGNIFQDEKDVKFNVIMPFTIF

SEQ ID NO: 17061 - protein, 1039 aa, Pelobacter carbinolicus
MLFFASLLLAGMAQAQTVSGTVSEPNGPLPGANVLVKGTTNGTTTDFDGNYTLNDVAAGSVLVFSYVGFAPQEVAVNGRSTVNVTLQEDAAALDEVVLIGYGSTTVKDATGTVASVTSEDFNQGVIASPEQLIQGKTAGVQISQSSGEPGAGINVRIRGSNSIRSGNNPLIVVDGVPLTTSGAPAAGDLGVGGGSSRNPLSFLNPTDIESISILKDASATAIYGSRGANGVIIVQTKSGRGSSGGAWEVSSNVSFSSPAREYDLLTADQYLDALPDYGGDPTLLDFGFASDFQDFYTRNAISTQNNLSYAHSYTSGNVRASFGYSDQRGVIRNTGQERITGRLNATQRLFDDKLTLSLQTTLSRVNDDNAPISGQAGSTGDLIGSSITANPTWPIDETFSPGSNLLNPVNLLRYYQSESNTNRFLANLSAEYKITDAISAKVTGGYDKSDAKTIALFSPDVAGINRVSGNGQGTYGTFDQTNKLFEATVSYNKQFENSKIDVVAGYSYQEFAREGINAGGIGFGSDMGLAAQQLEDQYGLIANTISGSFQNFAYDQNRDYVNRIDFGAPFDSAFVSEPIGTNYTQLFTAYFANTFDNTDELQSYFARVNYTLADKYLFTGTFRADGSSTFGPENQYGYFPSGAFAWQIHEEDFIGDNVSTLKLRLGAGIVGNQEGLGYANFIRRTRFSDIGITDNLTVTNSGTQFVGNNNEALQWESTLDVNVGVDFGFNNDRFNGSFNLYRKETTDLLLLSTLAAPQVPGIETIFQNLTDGKVVNQGVELALNYDFVQTEDFTFSSSFNIAYNHNEVLDTDRIIDTGPINGNGLTGAFAQRLQAGQPLFSFYMAEFTGFDENGNPTYVDVDGNGEGDPDADKKFVGEDAQPDWTAGLSLNATYKNFDFAAYFNGQFGFSVYNATDNAFFNAGGITIAKNVTTDVLTSGEAPGSSVAVSTRFLEKGDFVRLQTLSVGYNVPMSGEGLFDSLRFSVTGQNVFLITGYSGLDPEVSTNTGSLNASNIPTAGIEYAAFPRPRTFTLGVNARF

SEQ ID NO: 17062 - protein, 230 aa, Pelobacter carbinolicus
MKNVFALSALSLVFASSAFAGSSYVTGNIQFHDDGRIHGSDMTSTLEAGHTFDNQFGGFTVYTEFDGIQLGKLETENGGAGNTTPAITVGGEQAFNITDHLWVAAGYQHLFSAGESIQYRPLVKIGYNFDNGISLSNRTRAHIDATDADAKTDYRMDNRIGYAMNEDVTFSYNNVYMIEAETMDHELRATWTRQGVQPYFEFRSQAHGAENAAGDSLVNNAFVFGASYGF

SEQ ID NO: 17063 - protein, 416 aa, Pelobacter carbinolicus
MKLAPTLLGSALLLALAAPAAHAEIAIDVIGGSEVSLEGLVQADGNWFHNDVQDLNGAIGANGDNSEFSIRRAELVLKGKGPGNVEWVLGYDPSVLKQVTIKGTTVNSTGRFLDNNVKYKFGGNANNYLQIGQFKQPNSLEELSSTKNNDFVSKASVTNTYGISRRLGVAYGMGDTNWSVTASAFGRELTRNQAHGSGYGARGTWAPINETGNVLHFGLSYLAYDTDDDTLRLRARPDADLATVRLIDSGAITNVDNVGVAGAEAMWITGPFKVQSEYFQENANRIGANAHDYKSDGWYVSGVWNITGETWGYKAGVPTTPLPNEPASGMWQLAVRYDTLDLNDGHLVANGNTPFVDGVLGGKMNIWTVGANWYWRSNFKFALNYAKVDSSRYNSATRALVDDNPSIIEARAQFYW

SEQ ID NO: 17064 - protein, 810 aa, Pelobacter carbinolicus
MVKIFRAILMAGTVLGVGGAGVSHAAEAVEQSASGDDNSGVRDIIVTARRTSENLQTVPVAVTALDPTALLERQIVEVADVGRAAPGLSVQSGGTGNASLIYLAIRGNAQNSPNSFSDPAVGIYVDGVYYGRPIAGNLGLLDLASVEVLRGTQGTLFGRNTTGGALNMTTVQPDGNFGGYVTGRIGNYESWSIESALTLPISGDELSLRLAGRYGERGKGFGDNPIRGVDAARIDHDIAGRATLNWEPSAIPMTVSLSADYANIKDTYNNVALRGINPTGPALALYSGQFDIASFLQSESRFYRTYNDPDTGNANIDTPYNYNKTWGVRATIEYDLGDVKIKSITAYREADTGDGTDLDGTPAKIASYASDYSQKQRSEELQFSGNLGKLEFIFGGFYFKETGDEQSQSLVFQDTDFGFNLAPANTNLATYKSESKALFAQVNYSLTERLRVTGGFRYTWDKRSINRMGYIGGIPGFSGSFVSNGRLITLPATGLCAVGANANLVAPGPDCTDPVTAKFDYPAWLASIDYELGDGKLIYAKTGGAALAGGLNSRPTPPDASSFAPEKVKDAEIGFKGDFFDRHLRTNFAGFYIWRNGAQNVVNALVGGNLTQFVQNAGDVKAYGVEFEGTLIPWQGMELSGALSWLKAKYAAGSFTAAGLGGTVDRSGEVVPRAPRWTWNIGATQRFPVKGGEIALHADYAYTSAVYQDYATADLTTPALNDGVNDAAERAAAISFIDTQNSFSRLKAYGVLNGSLNFKLDGGMEFTLWGRNLTQAKYYNAIFNGYGTFGTAIGFTAAPRTWGATVSYRF

SEQ ID NO: 17065 - protein, 1097 aa, Pelobacter carbinolicus
MKKRVLIVLLCFVGALSSAFAAEKKVQGVVISSEDNLPLIGASVYVTAEDLKKAGSAQTTMGVITDVDGQFSIAIPAGITRFFCSYVGYDVLEVKLVPGKEHYEITLHASSQMLDAVVVTGYQTVERRKLTAAVSKLDISDETIGAVKSIDQALAGQIAGLSVSPTSGAPGAPAKIRIRGTASLNGTQDPLWVLDGIPLEGTDVPEPDELNDITNMKQSSIAGLNPADIENITILKDAAATAIYGARAANGVIVITTKKGKVGKPVINFSSRFTYTPTLSLDRLNLLNSAEKVGLEMDMIRNNYSPDNHKGGVYNILSNYNELSAFQNGGWDALSSDTQAAINRLKSVNTNWGDILFRDAFSQEYNLSLSGGTERVTYYTSFGYYKEDGNVDGVGMDRFNLVGKTSYKVNSILKVGASMFANRRKNTNYLTDAYGMSNPVFYSRKANPYFELYDKNGNYNYDYDIQNNTDKDLGFNIFEERQNTSNESVVNSFSSIFDAELRFNDKWKLTSQFGYQLEKTSREEIADWESYAMRYYYKLSEYSQGGETKHFLPEGGMQKSYENSNSQITWKAMGEYRDSFNDIHELEVMAGTELRKTWYETLFSAGYGFDRKTLTTKPVIFPNESYATSFPLHQTTYKENAYVSFYSTASYSLLNRYTVGGSIRFDGSDLFGVDKKYRYLPLYSVSALWRLSQEPFMQQAKWVDNLVFRASYGLQGNIDKNTSPFLLGTYRSESILPGVSEDVIIINSAPNKKLRWEKTQSVNAGFDFSVLNQAINLSVDYYYRKGTDLIALRMLPLETGFTSMNVNWASMENKGVEISLSTRNITTKNFSWYTNFNFAYNGNKVLQENIPEQQTTPGREGYPVGAIFALKTAGVNKETGNMMFYNPEGEKVTLKELYRLKDEWGIGIASSDVTAAEERTFYSYIGSSDAPYTGGLINTFSYKNWELNVNFSLTFGGYVRTQPSYDIINPDYGKNYNADVLNRWTPENPNAELPAFMLSASNPEEYSWYDSKTIWRDLDIWVKKLNYVRLQNLRLGYRIPELLTKRLGMNSATVSIEGRNLFVFGSGYNNYMDPESMYNPYATPVPKSVTFSLNLNF

SEQ ID NO: 17066 - protein, 898 aa, Pelobacter carbinolicus
MTKQPTRSYVSHLLIYCCALCLSAWHLCAFATTQFSLTDALFKVAKKHNWQLSMTPLNNEPMVSLLEEPANLNAQLEHLLNHTPWTYTLYPTLNTVVITARVLAKNNNNHDEAANALERILVSGQGSHNRSILSSSLSITHLNSAQLYNQVPFSTADTFNNAPGFWVENSGGETNNNVAPRGLRGGEGFRFISLLEDDLPVVYDGVWPDFFLRQDFTTAAIQIVRGGSSGIFSVNGPAANVNFIGQTGDNAQRKLKFTNAINYGYQRLDGVYSHQLSDNWYLLSGGFYRQSTGIREPGFNTDQGGQLSIRINQITPTYSQQWVVKYLEDKTSFFAPIPMQNQKKPRAINSLNAGTSTLLSNQLRYFFAPHGGKIRRYDLADGQQTRAISLTYLIDFSLTDSLLLSNKSRLSDLSTTLYTLMNQGNETLLPAKDWLSSAPVKQFLTHYLGSTAALYSPITQQYLDPTQLNNNGLVTFSYPLYAEYQQIQWINRLSLNWQMNEQTELMFGSLYANNDFSQLPHDRWLGSILTDVTHQPSPIETVALDPFGQKIATLNPLGVLSFSGPTYITGYGEAKSHSLYGNVRYSITDALTFDIGARTEWLQLTAVANTDQQNQYSQHQTITQSSPYRFKKSEQFTKTALSTGLNWQFADAAATFIRIANAFEMPKLLNFGNTLGYSSYLATIPDTVGFGRPVELSFIEWGTRIADTSGFISASLFETQFDPLPFTVYQGNQNTQLGILISTQTYGMELEFAKTLSAHWSISGVAVWQNGRFKGIPSQLAESKYNNNQITRTPNAQLRITQKYRFSQGELALTASYIGTRYSDVANQFALPAYYVVDASAQWALNEKLTLGLSINNLLDTIGLTEGNPRSGLIHQQNQYYARPIFGRALNLSLHYQF

SEQ ID NO: 17067 - protein, 527 aa, Pelobacter carbinolicus
MLGSCWSVQATELNINGLSNYAASASANSREQVTSITQFSDVVPTDWAYQALSNLIERYGCVAGYPNGTYRGNRAMPRFEAAALLNACLDRVTEVTDELKRLMKEFEKELAILKGRVDGLEARVGELEATQFTTTTKLEGLTTFVVGANVFGGDANATGDQPVANQKRANREFGATTFNYDTQLTLNTSFTGKDNLITILRVGNFDGGKNVFGGSFLPLSTLETAFQEGDEPNIIGLDRLYYSFPVGNNIVLTFGGLVGQEDMLGIWPSAYPSDAILDVTTLNGAPGAYNKNLGAGAGVTWSANGFSATANYVAASANISTPSKGGVGTAGAGSTGTLQIGYQQEQWGLAAIYTSVQNTNQNGEPNGLMAFGTQFVLDSYNNPGTTSAFGLSGYWQPETSGWIPSISAGWGYNATSYDSTVLRSVDQSTLVTASQSWTVALEWNDVVLKGNNAGMAVGQPMFATELESGDTPRDGNYIWEWWYQFQVTDNISVTPALFYLSRPFGQETPADTTFNQLGGLVKTTFSF

SEQ ID NO: 17068 - protein, 757 aa, Pelobacter carbinolicus
MINAAHRRIRPPLPALGATAALLTIQPLATTDAGEPPELPPIRVESTTIDDRFAGDETNPTATSFVRGDEVDAAAAEHIEQVLRRIPGLTADTRTGSDDAVKIKLRGVEGQRYMGEDPGVAIIIDGVPVKEDTGRVNIDMDNIESIRVIRGSASYLYGEDALAGAVVITTKRGADMAGFRTEGALGSHGTQRWLGRAGYADERFNAYLQASHRESDGWHARAGYEADYLNGKLQYYLDDYSDITFNFEHTDRFRDETGTVRGRSQAERDPRNREAQRGSYTRNFHLDLARYSVTYMRDLRAAGELTLSGYRFTDETWNWYAPMRYDGDGNAVNDADLYESRSDKEQVQRGLKAEWRNDGQRFAGLLGLDLRENTYEQENHYINDNKPSPSPFAPVREAGTRSADHETDETIRAAYGELKWRLAPRWTLTGNARFDHTRLEHSDHMEGRSLDRSFNVWSWRAGSAFQASDRLTFFANASTGFRNPTVGQLFAGGFEDDTAGNPDLDPEEVINLELGLRARTRWLGQPVRAELTLFQMDRDDFILRQAGQYATTAEEQEARYENIGGARHRGLELALSGEAGQRVSWGAAYTLLDARFTDYDNFNLALGNARGEFLGECDQVTLDDPRSQYCVERHDNSGNRIPRVPRHTLNLLVDFHLTPAFTLTTESHTVSSWFADELNEFELSGHTVFNLVGNYRQRLGRVDLRAFLRVDNVFDQWHYERASAFYDNNQDGEYDWEDVTFLVNPGRTWTAGLEARF

SEQ ID NO: 17069 - protein, 683 aa, Pelobacter carbinolicus
MLRLRPLAVAVLGLSAFPVSSLVHAETLLGAQTVTAKGYAADTLETPQAVEILQAPAAGGTVAGALLRGKPGLAAQSDGAWGQNPVLRGLKKESVVVMVDGVRMNSAQPQGAIASFLDLGLLERAEVVKGPGSVLYGSGAMGGVVNLITPDVGFSAEEAVGGRVGARFSSVDKGVAGAALLTRSSAHGALVLGVAGRDVDDYRSPDGREDRTGYQSDTLLAKYKHKLSEDLTLRVNLQRHEDEDVWYPGSARTGAGIPKPLGTATIHSPEQRRELYELGVDAKLGEGTLSAELYRQEVFRQIRAFSSAKQRDYVRNDVRFVTDGAKAKYLFPFGADHLLTVGADLWRMRGDPERYIDNNPPAFDNNLRNDPFDKGEIESAGVFVQDEFSLGDTRIVAGARFDRVTGDAERKGMTQTTGLENADNNLSWSLGAIQPLSERLSAYANLGRAYRAADMRERFEDSARGDGYFHVGNPQLDPEVSTSLELGLKRGGAGLRYQLAAFYTRIDDYIAGRVTGAVHPQNGLPFKLTENLDKVTIYGIEGSASMPVGAFVADAGFTWLRGENHQDDEPLFQMPAPELTLGLGQAAERGFWWRAQLRAVAEQDRIATRFSNGTENPTAGFVTADAEFGWRFGKLGAFESAGLAVQLSNLADKRYHEHQTEGVSGNELAAPGRGVALSLNGSF

SEQ ID NO: 17070 - protein, 1770 aa, Pelobacter carbinolicus
MRFHRTAVDTTSKKREGLVVNHSFRSIWSEAAGCWVAVAETARARGKRSGGESGASRRAGRMAGRRSPLRVAALGAALAALSAGSAYASTCGDGSAVTNGGACALGSYSPTVNDNLAGATTVSGGDTVGVTGAWTSAAGDPGYTLTPIGNTSIVSGNPNQPLLSLGGKTQSVSTPDSITGTHTSIATYDSSAFAASTAGATNVPVYQDVNGNQYVNLRLGTVDSTGGTLNVSIGNPANAPGAAGNAISIAPKQTDLTFADGTGSAKSVVSWNSRNQIWLGTGDYLASGGAVGQVQLDVPTYAGTFTAFDGSTWTVSDAASLAAYNDFLARSVRSGALGSQAAYDTAFGQAVTFTQETFQYANNVSAGDKNTLPIDHLSVMHGTGANATLQIGKDGQIDFRGTNTIESSSAILAENGAHFVNDGRLSGDFTLVRLLSGASGVNNGVISAGYASGDNVDTSSSTPPDNFGFHAYTEGNGVYASGPGTTFVNNGVMNVGAWTLDGNRPDLQNYAVAVTGGANASNAGTINVGVNATTLDSQVIGGFAAGGTFTNEAGGTIQLGREAQYAPGAAANDVALSARAYGILLGASGTASNLGSIVIGSQTQNGAGMASLGSSSGTLRNAGSIVVNGAAPGTPLANVGMLAANTAATVTNTGTITLNGVNGIGIMVVGTSTSTAATSTGTINVAGGLDPASDTRNYGVWAEGSRAQATVDGALNLTGNGAIGVHARAGATIDVGANAVPRFMSGTNQIGFYAYGAGSRINVAAQHLSVDTDDSTLFRIAGGAAYTGASAAGTLTTDLTGQRARGVLATGAGTTLATGNATYNVNGANGIAVAVEGGAQGSIDAGATINLNAAGAMAGVVDGQAHDLAGANAGAPVATTLANAAAVTSSSAGVTGFVARNLGTLENRGSVLLTGAGSTGVVIGTLGTVNNASAIRVSNGTGTLVQGASATLANAGTIEADDGVAGVHLTGAGASVALSGAGTVIANGSADGVLVDSSVADGWIAAGATSIVVGGAGKGIDNLGANTTIVLSGTQIGTTGNGADGLSSTGAGARIATDAATVVRTAGDNARGLVVAGADSTLAANGTTVATTGAGAHAIVAGSGASAWLSDAKVSTAGAAADGLVAQNGGRIGDTGSSIASAAGSGANVDGGGVLALTGTTLKGATAGVLSTDTLATGATSAVRVDGGSVASVAGPAFAARSGTVDIAVRNGTVVTAGNGTLLDLANGSTATFNASAVDLSGDIISDASSTGNVLLANGTTLTGKIDPVALTVDGTSTWRMTGNSVLSSLNNAGLVAFAAPSGAPTAAGSYRTLTTGSYVGYGGTISLNTYLGADASPTDRLIVNGGTASGTTGLKIANTAGTGAQTTGDGIPVVVTANGGTTAASAFHLAGPVQAGAYEYRLYRGGQSDANGWYLRSQLDSTDPDDSIHPSGNGNTNGNGNGNGGNLAYRPGVTGYAMTPLLNADYGFSTLGKLHERVGDIDNLEKQAPGNRDGVWGRIGGQSLDANAGRFAADERTFFAQFGKDWTLEQAAAGGSTHAGVTASIGVANASFDDMARADTPGLSTSTGSVEMHAQSVGGYWTRYLADGTYFDSVGQVTHYGNRYRDSYGNDASQNGFGIALSQEVGKPFVIGGTPIAVEPQAQLMYQYLKLNGFNDNVSAVSGTTTNALRGRVGVRIFRPNLDANAGGGAATPYFTADVLHDFLSPGQTVVGGTPFATHLGRTWYELGLGVTAGFGKSGELYANVKYARNLGGEYRRGVTGQVGYRYSW

SEQ ID NO: 17071 - protein, 501 aa, Synechococcus sp.
MKLFQQLLVAPAALGLLASGANAADLNINGVSDYAASEEQVTSITQFSDVYPTDWAYQALANLIERYGCVAGYPNGTFAGNRAMTRYEAAALLNACLDRITEVTDELRRLIKEFETELAVIRGRVDGLEARVGELAATQFSTTTKLKGKATFVTGAINSEDDADKSVYDALSFSYDLRLGLKTSFTGKDLLFTRLRGGNMKDGSAFSGGLRKLDVSGMSGNTMEIDRLYYRFPVAKGLTAIAGPLARNTESLGMKPTAYKVKTLNMFGGHWGTPGVYNKETGGLVGLIWKQKVAKGKPKFTAAVNYVADAGEAENSDPTAGGMFGSNSRANTTAQIGYGSKKWGLAFGYRYGQCKAGFGTGFYKAQDCVKGTDVYSNNFAFNGFWKPAETGLIPSISAGYGFSSLEGSDVETLASWMVGFQWDKIADTSHKLAVGFGAPQYVVSQKGDDPDAPELAFEASLKLKVAKKVSVIPAVFYLPEQSQGVDDASQWGGVVQTVFKF

SEQ ID NO: 17072 - protein, 475 aa, Synechococcus sp.
MKLFQQLLVAPAALGLLAPLAVVNSPAANAAELNINDVSDYAATASGNSLDQVTSVTQFSDVYPTDWAYQALANLVETYGCVAGYPNGTFRGNRAMTRYEAAALLNACLDRITEVTDELRRLLKEFETELAILKGRVDGLEARVGELEATQFSTTTKLSGTSNWVAGATRAKGDNYNTGGEKGARDDWNAKYGGFSFSYDVRLALKTSFSGKDLLYTRLRAGNMGDSSVWDGNGVPMNKLDTAAPGGNIVEIDRLYYRFPLGDSFTVQAGPLTRNTEMMGYKASAYGKGGSKILDFFGGSLGTPGVWNKETGGGFGAIYSNKKQVEKGNPYFTVAANYVADSGEANDSNPNTGGFMTDNSEGNITTQIAYGNKQWGLAAGYRYGQCGAKFRTATEYAAGDKFGTPCTVGDADKRSNADSHSWSAHAFWRPEDSSWMPSISAGVGASYLNGNGNWDDNTNKRARATASWAPRNTPS

SEQ ID NO: 17073 - protein, 257 aa, Synechococcus sp.
MTLTSRIVLALAGLGLLPLTPAVAADYDPPIYADQAPDYVPVEVGSGWYLRGDVSYLAQKSFKNDDFAFTPASFDEKEDPIFASIGFGYHFNDYLRADLNLGYLPGNKIGIGYDDSLSVVPPATSTVASADLKNYAYSLMLNAYVDLGTYVGITPYLGGGVGIVQSTRRLSANYFTNNGDPTDDFVQTDDKTKYSLAYTLNAGLAYQVSKNVSVDLGYQYFSAPDAEYVTAASLTSFPVHKGISNHQIKLGLRYDLW

SEQ ID NO: 17074 - protein, 500 aa, Synechococcus sp.
MKLFQQLLVAPAALGLLATGANAAELNINGVSDYAASADQVTSVTQFSDVYPTDWAYQALANLVETYGCVAGYPNGTFRGNRAMTRYEAAALLNACLDRITEVTDELRRLLKEFETELAILKGRVDGLEARVGELEATQFSTTTKLKAKADWAFGAATAWDKGSKAFKAESGGTSFSYNLALNLETSFTGEDLLYTRLRSGNMDNVYGGLFSQEYGFDSGNTVKIARLYYSFPLGDEFTVVGGPRVRQDDMLPVWPSAYPAAMTYDFFTYAGVPGAYNLALGAGAGIYWSSNDFSISTSYLSTDGNSSDPNTGGMFTDGAGANATTQIAYAPENWGIAAAYTYASGAEGGGSLYIGNATAGAAAASAADNSNSFGISAWWMPEESGIIPSVSTGYGGTFVEYLSDDVYTNSWYVGLEWSDAFIEGNSLGFAVGQPTWIAQSDDGDLNEAAGFAYELFYKFQVTDNISVTPALTYLSKPFPEQGSNGMSAFSGLIKTQFKF

SEQ ID NO: 17075 - protein, 594 aa, Synechococcus sp.
MKLFQQLLVAPAALGLLAPLAVDATKPANAAELNINGVSDYASSSEQVTSITQFSDVYPTDWAYQALSNLIERYGCVAGYPNGTYRGNRAMTRFEAAALLNACLDRVTEVTDELKRLIKEFEKELAILKGRVDGLEAKVGELEATQFSTTTKLKGKTTFVIGANTFGGDAKNVNVFNADGELVGGYPLPKSTTVRGIFDKAITAAGGTKNTEKMATLANSNLGATVFNYDQQLDLDTSFTGKDLLKVRLRTGNFQNSAFGFNASTGIGSPFGGTFATASGMEIAFEEGTIGNAISVNRLFYQFPVGSDFTVTAGGVVRQDDMLAVWPSAYPADSVLDFFTYAGAPGTYNLNLGSGAGIWWQKDAFSISANYVSANGNDGNPNVGGIATDGAAGTGTVQVAYAKDNWGLAAAYNYSSQNWGNLYQSTGTPLATQVGTLGNTNSVGVSAWWTPENAGWIPSISTGWGLNSTSGAKDTTLLGYDFDSATTQSWYVGLQWADVFLKGNSAGMAVGQQGFVTSLGLGSNKTFSGSQASDAEDVLVRDGQYAWEWWYMFQVTDNISVTPAIFYLSRPLGTATQGVSYNQFGGLVKTTFKF

SEQ ID NO: 17076 - protein, 791 aa, Synechococcus sp.
MKTFTTRRLPLAASIAAIIAAVPLAQAQGNQAQSIEEVVVTGSLGSLPGEDVQIFGFGKSLLETPRSASTISEEQLERFNITDIDELVAFAPGTFTQSFFGVAGSLDVRGTAGETYFRGMRRIDNPGNYPTPIGASDRIDIVRGPASPIYGPAKIGGYLNFNPKSARAESGDYLSETTGAVSYETGSWNRNVVTAEIGGPINDRMGYYLYGELEDSDSFYDNTETKQNIIQASFDVDINDKLVMQFGGMYHDYDGNQVAGWNRLTQDLIDNGTYITGQATPLDTDGDGKISHQEYGATSGPLSNFVFRPEFVDDSSVIPEMALVNTGTTQLDESNVLVDPNDTLDNQVLSLYLDFVYETDSGFSITNKLFYETIDNINENAYGFSQFGEVDMIEDKLVFAFTKDIGSMTADLQFSPSIRYTDFLRGQDFINEYFDRRDLSQSNAERDPSLDTRLLATQINDDYSEYQSGDYTMYGLAFLGDFSFDNGIAVTLGIRQDYVETDVSTPVELLLFPDGAIPEASDSEDLLSWSASINWTTEFGLTPYFTIAEQATLIAGQVGDLPTAQVASGSWTDTSDLWEVGLKGSFLDDSLYFAVNYYEQERVDFNAQAIVTNPTSRTEGIEAELRWVVNEDLVVTGGWTNMEVIIVEAEENGGQFGFYGADDIPQIDPTLVFGGQIIGIPTSPDGRRAGIPENIYTLTGTYSFNDNLAISGSVISVDETPSGSSGAVILPSYTLLNAGLVYETESWTFQLNAKNLTDERYFRSNFPDLFGSQIVLPELSRNFQARVAYKF

SEQ ID NO: 17077 - protein, 427 aa, Chlorobium chlorochromatii
EDDGFYMGVGYQIGGAQQNINNKGSTLRNNVIDDFRQVGVGMAGGNGLLALATNTTMDALLGIGNQIVNTNTTVGNNNAELTQFKKILPQIEQRFETNKNAYSVQALQVYLSNVLYNLVNNSNNGSNNGVVPEYVGIIKVLYGSQSEFSLLATESVALLNALTRVNLDSSSVFLKGLLAQMQLFNDTSSAKLGQIAENLKNGGAGSMLQKDVKTISDRIATYQENLKQLGGMLNNYDEPYLPQFGPGTSSQHGVINGFGIQVGYKQFFGSKRNIGLRYYAFFDYGFTQLGSLSSAVKANIFTYGAGTDFLWNIFRRVFSDQSLNVGVFGGIQIAGNTWDSSLRGQIENSFKEYPTPTNFQFLFNLGLRAHFASTMHRRFLSASQSIQHGMEFGVKIPAINQRYLKANGADVDYRRLYAFYINYTIGF

SEQ ID NO: 17078 - protein, 399 aa, Chlorobium chlorochromatii
MKKRVAFAMTAVGLAAATAAHAQSSVTLYGIVDNGLAYQNNAAPTTGATTGGHSKVSMSSGVWAGSRFGLKGSEDLGGGTKAIFQLEAGVNSATGASQWTGGIFTRQAWVGMTNQAYGTLTAGRQYTAYYTLLSPYSPTTWLTGAYGAHPGDIDSLDTSYRANNSLVYMSPKFYGFTVGGSYSFGGVPGSVNRGSTWSAAVQYLNGPAGIAVGYQKVNNSTLGGGAWGDNSTVTSGGQPAVSAINNGYQTAQSQQRIGVTAGYQFTPAWDVSASYTNVKYTPGIGSVFHNSAIFNTAGAVLHWKAAAQWDFAVGYSYTAATQSNGITSAAKYHQVTLSQYYSLSKRTGLYALEAYQHASGNTLSKAGTIQAATTQIGDGVAAGSKQNQIAVGVGMIHRF

SEQ ID NO: 17079 - protein, 182 aa, Chlorobium chlorochromatii
MKKTTLLLSTLITCAMGISVAQATQTVSLGYAQAKVEDFKDLKGVTAKYHYQGDSALGIIGSFTYLGGKKDYNQSSIGFSSHESDDVKYYSLMVGPSYQINDVVSIYGLAGLGHAKVKNSYNYTLPNQSGSESYSESKTKFAYGAGIQITPVANWAIDIGYEGTKIYEARVDGFNIGVGYRF

SEQ ID NO: 17080 - protein, 181 aa, Chlorobium chlorochromatii
MVSGWRRHPRATKEWENAAQNTVKFGGDVAPTLSVTYYINDNVGFELWGITKKLSYTAKTDASGKIGNVTQKTPLALSAQYHFGQAQNVFRPFFGVGYSQAKSKFTALGSTDRVNLGNFRGAIGTIGLDMNVDSNWFARLDARYTRFSNSNSKAALSSSLGLDQNRRLDPWSVGFGIGARF

SEQ ID NO: 17081 - protein, 193 aa, Chlorobium chlorochromatii
MKSITVLGALTAIALSVNVQANQDVSGFYLGAGVGTTNVDTDTNGYSSNSDTDGSTVKLLGGYQFNRIVAIEAQYTKYGDITPLSNFSKTYQWSPTTVSLAANLGYTFENGLRPFATIGLSSLDLDESIKTIDDSSATALRFGAGLEYTPAALSGVSFRAGYEGDAFTIDNGIGYSDTTVILGSVYVAASYKF

SEQ ID NO: 17082 - protein, 651 aa, Chlorobium chlorochromatii
MNKKVFLVVVAGLLCSRGLLAEEQPKSFTGEEMVVTSSRVEEPKKNVTSNITIIGREEIERSSAQDLGALLAEKNLGQIQKYPGTLTSVGIRGFRSESHGNDLMGKVLVLVDGRRAGTGNLAKIMTDNVERIEIIRGPAAVQYGSAAIGGVVNVITIRGEAAPSLFIEQNVGSNDYSKTAVGAQGRVGNLDFSGSFSISDSGDYLTGSNERYLNTGYSDQTLASFNIGYEFLPGQRVGINYHSFDVEKAGSPSYLSQNDLSSYTVNNNHSLDFIYEGSLSDKRFSWMARYFTGMDEYQYVDPVYSYKSSSDVDQRGAQAQLTFSKESLRLTAGVDWLQYDLQSTLVPLWSKYENPAAFLLGKYGLFDDRLIVTAGIRYDDYRVDMAEGEGSSRSSDNFSQQAGLAWHLTDVLKLRGSYAEGFRMPSARELAGQINSFGKIYIGNPDLNPETSDTWEAGFDVVSKGLNSSFTWFTTDYTGMIETVATAPNSFTYRNIGSARVSGIESELSWKLNALSPSWVFEPYVNYTHLLEYKDNATGKHLLYTPQWNASTGLRLRDMNGFSAAFSVACTGKSMIQDYESSWSGLVVTKGSFAVANVSASKRFSLGTEGKKGLGITLKAEVDNLFDRQYQYVKGYTMPGRTVVFGLKADI

SEQ ID NO: 17083 - protein, 510 aa, Synechococcus sp.
MKLFQQMLVAPAALGLLASGANAAELNINGVSDYAASADQVTSVTQFSDVYPTDWAYQALSNLVEQYGCVAGYPNGTFRGNRAMTRYEAAALLNACLDRVTEVTDELRRLLKEFETELAILRGRVDGLEARVGELEATQFSTTTKLKGVTNWVLGAAKYHGNGSDAAATTAGGTSFSYNLQLNLETSFTGKDLLYTRLRAGNMDNVYGGNGLFAQEYGFDSDNAIVVDRLYYSFPVGDEFTVVAGPRVRMDDMLPVWPSAYPSDMTYDFFTYAGAPGAYNLALGAGAGVYWQTEGGFSVSTSYLSVNGNNSCPNNDFCGDSAGGIGTDAAAFSATTQIAYAPESWGVAAAYTKASGVNGVGLYQGNATIPAAALSYLDDQSNSFGLSAWWTPEESGWIPSISVGYGGSWLSFGGDDAYTNSWYVGMEWDDALIEGNSFGIATGQPTYIVSVDDDDYNAGAGYAWEFFYKFQVTDNITVTPAIHYLSKPFAEQDSNGLNAMSGLVKTTFKF

SEQ ID NO: 17084 - protein, 380 aa, Synechococcus sp.
MEFVMSKKIIAPLAVAIAAITSAADAADVREGIELGAGISRFSFADEEVMEGDFGGKVFAGYRFANPWSIELNYARATPQLDSGDGIKIAQTYASALYHFKTDESYEPYISVGAGQLTFDGMGVSDDSSLVGVGAGIKGYISDRITFRPDFFIASAQELEKPHLLSSITFSYFFGNVSSSAAPSSAKTVAAAKMVDSDKDGVQDGNDACPNTPAGVKVNAKGCALDSDQDGVADHKDSCPNTAMHLKVDAKGCPVQLSESVSIDLKVNFDSNSSVVKPEYFAEIRKVADFMAQYENSVVVIEGHTDTRGAAAYNKSLSQKRADAVAAVLVSEMNVAKRRVTSVGYGEEQPIADESTREGLVANRRVVAKVSASVTKLEQK

SEQ ID NO: 17085 - protein, 1034 aa, Synechococcus sp.
MTRHPAVHRSLQPSRARYRRISVLALALSGAVGILASGTAAAQSTTAGIYGTVAAGAGASVTVQSNTGFTRTATVDANGRYTIGNLPVGTYTVTLQRDGAAVETRKDIALRVGAGTDVSFGGNPASSDAATLGTITVTGKNISPVDVSATASRTVITAEQLQRLPLARSGEAIALLSPGAVQGSGYFGNAISFGGAGVTENAYYLNGYLTSNPLTNIGGVTLPFGAIDQQETYTGGYSARYGRSAGGVLSQVGKRGTNEWHFGAQVLWRPKSLSSDNKNVFYPSTTPPDGYEYSDPTLPGSLYRSRKDDQFWNTVYSVYAGGPLIEDRLFVFVAAEQERSEGVTTARRDDPVIGRNNYRIDEPKVYAKVDWNINDNNILELTGIKNNYREGGAYSDFLGYEGLGGDAAGAFADTVKVNDRYYIGKYTSYITDDLTLSATYGKSRQTDFRNNPSTAARLSGTNLQDPAITGGQEIRNNQTSSQARDGENTTRGLRIDLEYVLGAHTLTAGVDNMHFDASNEGVITTGPGYTWTYGRSSRPTSPIRAGLGVGPAGGNGYFVNQTVFNTATSMSVEQKAYFLEDKWQITDTLLLTLGIRNDKFTNFNDAGVAYVSSGDQWAPRLGVSWDVFGDSSLKVYGNAGRYYLALPNSVAIRGASPSTFTNEYFTYSGIDAQGNPTGLTPVAVDPSAGFTCSGNIVSAGLECGQAPDAAGIAATDLKSMYQDEFMLGFDKTLGENWVTGAKATYRTLGATIDDVCDADRMRTKLTASGIDPDSVNVPGCIIFNPGETNSFSLANLDGSGRTSVSMSPSDWGFDKKAKRTYLAVDLFLQHPFDGKWEGRIDYTWSRNFGNTEGQIKSDIGQTDVSKTQDWDAAALMWYSGGYLANDRRHQIKLYGSYQIAPEWLIAGNIRILSGTPKSCLGYVSINGISEDSDAGDPIGYGSAHHICNGQPSRPGDAGRLPWTKIVDLGLTYRPAFADNKLAMTLQAFNIFNERKPLQVDSTWEDGAFTLSNTYGMGAFFTQPRYAMFSVSYDY

SEQ ID NO: 17086 - protein, 552 aa, Synechococcus sp.
MLEIFGKIILTVSSLLMSVLTLASAVCSENSTQAETFLNFSSELEAAQTPAIPISQNDNSILKGLGSQVPRVNQLKDVSSRDWAYESLRSLAERYKCIVGYPNLTDRGNQTLTRWEFAVGLNICINNMESLIQENVAILREDIETLKRLAQEFDSELTGLKVRSDDLEARVAFFEDHQFSTTTKLQGEVVVALTDTFGNNDTTQTIFGDRIRLTFKTSFDGKDLLVTRLAAGNLRAFDTERNDAFIESPTTTQGFNVGYTGNNDIVIDWLAHFDSFKLNDKFKFNTYIPALGGIWPDNVPSSNPFFFNYDGGNGSLSTFANLSPIYRIGGGSGFVLNFNFNIVQLSGGYLAGQAGRAGNPVQGSGLFNGDYAALVQLNFQPIKTIELGITYVHGFHKRGNPIFGYGSRQPFVGTNAVNFAGAESDRVTNTYGFQAFWRIVDALSFTAFFAYGDLKQIGGFNSEYWTYAGGFALPDLGKEGNILGIFAGVQPYLGNKTLNTNNKNPVHVEVFYKYQLTDNINITPGAIWISNPEQVPSSNDEIIGTVRTTFAF

SEQ ID NO: 17087 - protein, 513 aa, Synechococcus sp.
MKLFQQMLVAPAALGLLASGANAAELNINGVSDYAASADQVTSVTQFSDVYPTDWAYQALSNLVEQYGCVAGYPNGTFRGNRAMTRYEAAALLNACLDRVTEVTDELRRLLKEFETELAILRGRVDGLEARVGELEATQFSTTTKLKGSTHWVLGAAKYHGEGSKAEATANGGTSFSYDLRLALETSFTGKDSLVTRLRSGNMNNIYGGNGVGLFGQEYGVNTDNAVVIDRLFYSFPLGDEFTIVGGPRVRMDNMLPVWPSAYPSDMTMDFFTYAGAPGAYNLALGGGAGIYWQTEGGFSVSTSYLSTDAELSDPNAGGLLTDAAGTSATTQIAYAPENWGIAGAFTYASGGEGGGALYGGNGTPGAVALSGSGNTYSYGLSAWWMPEDSGLIPSISAGWGLTDIPDPSISGVKEATTQSWYVGLEWSDVFVEGNSLGMAVGQPTFISDVDTKKGVDDFVAGSGYAWEFFYKFQVTDNITVTPAIHYLSKPYASQDSDGLNAMSGLIKTTFKF

SEQ ID NO: 17088 - protein, 524 aa, Synechococcus sp.
MKLFQQMLVAPAALGLLASGANAAELNINGVSDYAASADQVTSVTQFSDVYPTDWAYQALSNLVEQYGCVAGYPNGTFRGNRAMTRYEAAALLNACLDRITEVTDELRRLLEEFETELAILRGRVDGLEARVGELEATQFSTTTKLQGQADFFLGAVTYEDRNKCNNKGGDCNSDGTNMSYRYTLNLNTSFTGKDRLYTRLRAGNMANVWTQTDSYLADAKKGDNTLKIDKLWYTFPIGSEFTATIGALVENYYMIETPTRYKPILKAFKLGGYGSVLGASTGQGFGLQWRQDVDPGEAALNIAANYVADGGDGAKSDPKEGMFGENTDAYFLSQVGYGNRQWHVSALYSLKNAGQHCAVENARGRCIETSSGAKAAMGYSTPLAKDLGHPMHAFGLRGYWQPEDSGFIPTISAGVDFGYAEGEYRGNAEALKGWMVGLNWNDAFIEGNKLGLGFGSYSSYATDAKDVSTGDEANFAIEGYYDFQVTDNIKITPAIFWVDNAYGEAQTSGQNKFGGLVKTTFKF

SEQ ID NO: 17089 - protein, 418 aa, Pelodictyon luteolum
MITACPRPCAWRSYALGLGLLPLAAQAEFLADSSAHLDLRNFYQLRDYRQHDAPQSQAGNWSQGFVLRLQSGFTGGPLGFGLDATGLLGVKLDSGRGRSNDGTLPFGANSKEPVDDYSHLGLTAKLRYSQTQLQVGILMPQLPVAFRDDVRLLPQTFDGALLTSSEIEGLTLTAGQLWKSRTRESAGSDDMYIMGRDKAHASDEFNLAGATYAFTPRLSASYYYGQLKDIYRQHYLGLLHTLPLGEGLSLRSDLRYFDSGEDGAAISGPVDNRNLNAMLTLRAGAHAFGIGVQKMIGNDAFPVLNGYTTPYVANLMAYQTFTRPQEKSWQLRYDYDFAGLGLPGLNLMTRYVQGRDIDRGAGRADDSEWERNTDLSYVIQSGPLKSVALKWRNITYRSRYGADLDENRFIVNYTLKLW

SEQ ID NO: 17090 - protein, 1057 aa, Pelodictyon luteolum
MAFLKRHGTGGAGRCNTEFYQRGFSSMQLRKVVVKQVRKDDSAFAQGWALAPLGRALVGWAALMGTAQAAPYVESGRLGDIGSWRSDEFKADWGLGAIHADSAYAAGFSGKGVKLGIFDQPVYAPHPEFAGKDKIVTLVTSGIRQYTDPYIPVKAGDAFRYDGSPSVGSDGKLGSHGTHVGGIAAGNRDGESMHGVAYAAQIISADNGDPGPEDGIVLGNDGAVYKAGWDSLVTSGARIINNSWGIGITDRFAKGGRNPDFPHFTVDDARAQFAQIQPLLGTLPGGAYDGAIAAARSGVLTIFAAGNDYNLNNPDAIAGLGYFVPDIAPNWMTVAALQQNPDTSSANPYLASTFSSRCGYTASFCVSAPGTRIYSAVIGGTSLADLTQGYANKNGTSMAAPHAAGAAAVLMERFPYMNGAQIASVLRTTATDMGAPGIDALYGWGMINLDKGIRGPGMLVTEQDIPEEFRIAGGYGPSQFVVDLPGIGAVVDAGKPTQRLCNSLGCGLDLWSNDISGHGGLTKQGIGTLVLSGNNTYSGPTLVNQGRLAVNGSLQSTVAVNAGGVLGGNGRIGALVVNPGGVVAPGNSIGTLQVSSDVTFQPGSTYAVEVDTTGSDRLVSGGQVSLGGANLALDLQNPGVSLQAQQAPSLVGRQFDILDAAGGVQGSFANVQSNLLFLGGGLAYSGNGVQLAVQRSASFASVGLTANQRAVATAADGLGAGNPVYESLLLSTDAASARQAFDQLSGEIHPAVGNLLLNDSRQLRDAMGERTRLAAPTVDGQGNGLWVKALGAWGKADGDSGRARYSTSIGGLLLGADGQVSEDTRIGVFTGYSDSSLSMGDGRHSSASVDSYHLGAYAGKELEQVRLSLGGSHSWHRIDTKRELQYNEVSDRLKSKRDAQSTQVFGEAAWKVAVPGMALEPFANLAYVHIDSDSFKEHGGAAALKGGQDNRDAWLSTLGMRAGKQLQLSGGQAVELSATLGWQHNLSSTGADQHLAFAGQGDTYKVQALSLDRDAAVVGLRAGVALGQQARVNLDYNGLLGSRDNSHGVGLTLDWAF

SEQ ID NO: 17091 - protein, 945 aa, Pelodictyon luteolum
MKYCLFNIAFWGLLFFNLFEAAANSNIYTISGRVTEAKTNSPLPGTSILIKGTYLWAVSNQKGEFTIQGVQEGKYNLEVSFLGYVPATIPVNVRSNINNLPIILKENTLALDDVVVTAQAPKNELNTTLTIGNHALEHLQVSNVSDISALLPGGKTKVPDLTANNIFSLRDGGSTAGNAAFGTAVEVDGVRIGNNGSFGNMSGVDTRNITVADIESVEVITGVPSAEYGDLNSGMVKIHTRKGKTPWNILLSINPRTEQVSFAKGLDLGNDKGVININGEWTKATQKLVSPYSSYTRRGFSAGYSNTFRNVLRFDIGVTGNIGGMNTKDDPDAYSGEYNKVRDNVFRTNTSLAWLLNKSWITNLKFDASIYYNDNNSHAHTFYSYASEQPAVHATEEGYFMANKLPYTYFADQIIDSKELDYAASLKYEWNRRFKTVNSNLKAGVQWKATGNVGEGEYYKDPSLAPNGYRPRPYTTYPYMHNVSLYAEESLSFPVGNTMLRLMAGVRWEHLFIKGTKYKNLNTLSPRFNARWQLNEYIAIRGGWGITEKLPSFYTLYPKQEYRDIQTFGFSYNKIESSYIYYSQPYTLLHNENLRWQRNQNAEIGLDVNIARTRISLVGYFNRTKLPYKYASTYTPFSYDVLQLPDGFTMPTNPQINVDNQTGMVYIRDNASSYWTPMDVKVTDQTFVKSTSPDNGMDVIRRGAEMIVDFPEITPIRTQFRVDAAYTYTKYIDNSLSYYYQNGWSHTSLANRSYQYVGIYANGDNLSTTANGKRTHSLDANITAITRIPKARLIISCRLEASLVKRSQNISEYQGKEYAFNVSESSNTQTGGSIYDGNSYTAIWPVAYLDLNNEMHPFTSAEAANPEFSYLIRKSGNAYTFAADGYDPYFSANINITKEIGDYVSLSLNAINFTNSRPYVKSHATGVSALFTPDFYYGLTCRIKF

SEQ ID NO: 17092 - protein, 661 aa, Pelodictyon luteolum
MNKKVCLLVLAGLLCSRGLLAEETTKSFTGSELVVTSSRVEEEKKNVTTNITVISKEEIKQSSAKDLGDLLAEKNLGTVHKYPGTLTSIGIRGFRTESHGNDLQGKVLVLLNGRRAGTGNLAKIAVGEIDRIEIIHGPAAVQYGTAAIGGVINVITARGSGEPGLFFAQELGSSDYTRTTLGTSGKIGNLDFSGSVSLSEMGDYKTGSGKTYYNTAYDDQTSGSLNIGYEFTPGHRVGVNYTYFNVGDGGSPYYLSQNDLDDWFEKENYSTDIVYEGRTADSRLSWMARYFTGRDYDVQYDPTGSNQGWDDDIPYTSKVDHKGAQAQLTYNYDYFRATAGIDWLNYEETTTPYAPYKSEYDNMAEFLLLNGFLFDKRLVLSAGFRYDTYDLTSQGYEDSSESDRDDDNFVMNYGVAWHVTDGIKLRASYAEGFKMPASKELAADYYISTTHYVGNADLKPEESTTCEIGVDVADNRFASSLTWFTTDFKNKIQSVSLGSGVSSWENLYGAKISGFEGEVSYAFEPFGNNWQFSPYASFVYLTEFEDDGTGDRLLYTPEWNATVGLRVNDQRGFSGMFNLAYTGESDIQDWETSWAGTVITKGGFAVANLTASKKFMLSEKKSGRALTIKGEVNNLFDRDYEFVKGYPMPGRSFAVGVRVDI

SEQ ID NO: 17093 - protein, 258 aa, Pelodictyon luteolum
TGTKDFDEVTWSLGTEWDVTSDWTLFANARSLFKGPELLETFVRYQDQARLADNIKPETGLNTQGGVRFDKTYGDHFVGANFTLFKTQIDDHIRTSNSYLISNVGDMEIKGFELSTTYAYQAASAKLSYAHSDANDVTNGGPMLNSVGNSADMGDSIALSLGYQADSIDTLFGWTSIVVLDEDNVVAGAAKKEGYDVHNLYAQWTPYSVPNLVLTFGVDNVFDELYVSHASRVGLAKSFVADDYEPGRSYKLSAAYQF

SEQ ID NO: 17094 - protein, 110 aa, Pelodictyon luteolum
AVGYTHTMPTKGDGGDANQGSAFVSGALIDNKLLGSVVVEGYQRDRWKSEQSNNPDADALEKREVVNVLSSLKWLVADNQDIDFDLGYNQNDMHSTTNNVPRAPTAQNYQ

SEQ ID NO: 17095 - protein, 399 aa, Pelodictyon luteolum
MKKGAAAWLVAGSMCAGAHAQGTVTLYGIVDAGLGYTSEQRVAQTKGALGSPVGYRNESSYGFASGIWSGSRWGLKGKEELGGGLAAVFQLENGFNIGTGQAGQGGRMFGRQAWMGLSSERYGTLTMGRQYDPIVDFVGTIGAGAFLTGMGAHPGDLDNIDNQARENNSIKYVSPKFGGLALGALYGFGNQAGSVKNQNTWSVGGQYVNGPFSLGAAYLYATNAYGANGGAWTGSYDGTFASSINEGFASAKSMQIVAAASTYQIGAVTLGLSYSNTRYKSGAFSTFNGTATYNSIGGTVSWQATPELRVAAGYDFTRGSSIDGQSAPKYHQVNFASYYYLSKRTALYGLVGYQKASGKTLDAYGNVVAATASVGDVGNGISSAGDTQTLVRIGVRHTF

SEQ ID NO: 17096 - protein, 375 aa, Pelodictyon luteolum
MKRQYLALSIATAACAAPQAHAQSSVQLYGLIDLSVPTYRSHANAKGDHVIGMGLGGEPWFSGSRWGLKGAEDIGGGTKVIFRLESEYTVADGNMEDPGQIFDRDAWVGVENDTFGKLTAGFQNTIARDAAAIYGDPYGSAKLTTEEGGWTNANNFKQMIFYAAGATGTRYNNGLAWKKLFGNGIFASAGYAFSNSTSFGQNSTYQVALGYNGGPFNVSGFFSHVNHAGYANKSFSVGGNYTFDIFRVNAGYFRYLGDQGALGQRQDNAWTVSFKVAPKGALDYELGYQQMRVHNAAYNSDGNVPNANIGDFSLTSGVGNGFKETLYGSVFYHLSKRTELYLAGDYMRLHGGYTVASTHGATNQLELTTGIRTRF

SEQ ID NO: 17097 - protein, 724 aa, Pelodictyon luteolum
MKSTKGKLLPSTPLSLSAAAIAVASVIFTTPVVAEEQTLFDEMVVVSSRTPKAISDIPGTVWYIDSEQIEQEYRGGKTLGEILASAIPSLDVSSGARTNYGQNLRGRKMLVMIDGVSLESSRQISRHMDSIDPFNIERIEVLSGATSIYGAGASGGVINIITKKATSQELEFESYVGAKSGFNSGEDFDYKVGQSISGGNDKVQARASVVYTETQGFFDANGDIVTPDISQGSLQFNQTVDLMTTVGVNISETQKLNLLAQYYDSQQDSPYGLYIVNNKFVDVRNGFDSDREHGTERMMLSASYVNDEFLNHQLIAEASYRKEDQTYTPYYQSSGQQITDVISLKAALAKNFDKLNLVYGIDAYQDQLDSNQALYDKTIANNSGNLINRTYAQVGRYPEIKVGSVAGFVQAGYDITDDWSVEGGFRYQHMVNKIDDFVGYQQQKNIAEGKGTSADAVPGGETDYNVGLFNLGTLYHLNNDSQVWANFSQGFDLADPAKYYGQGNYKLVGSHWTLQDSINVDSSKMSGIKTNSFELGYRLEKDSFNLQTAAYYSTSDKSVSYNKQTLLIEEVEDKKRVYGLEAMASYWVHTNVQLGASGHYVVSKVKGDNGWEDMTAGEASTSKASAWAGWYDADLAVKLQSQTMFDYKDDAQNKLDGYTIFDLVGSYQLPVGSLGFGVLNLFDHDYTTIWGQRAQIVYSAHYDAAAYDYKGRGRTYTLNYQVKF

SEQ ID NO: 17098 - protein, 771 aa, Pelodictyon luteolum
MFRKKLIVTALGGLLTGGVVSSPAWAEDGAATAGAPDAKPAQQASDDAAAAAPKAVRADRGTAVRETNLGTVTVTARRRKERIQDVPVAVSALSGDAIKNNELRVINDVTKYVPNFTGQSTEGRERPRWFLRGVGSNDPSDLSLSPIGVYFDDVYINSVFGQGFPLFDLDHIEVLRGPQGTLWGKNTVGGALNITSQKPTFDVSGYGKLGFGQYNSRLAEAAIGGPIGKNDVLAARVSVYHENADSFYTNTVQQGRFGGFHDNAVRFQVLAVPTSDTDFLFNIHGRNYTGGGNAWHAEGAGRGGTNQFGFVGSSDPYTVSLNAPSSDHISTWGTSLTAHWRINPAVSLTSITAFEGLHRWYQDDEDYSPFDAARSHDRLSSRQFSQEFRLESPQSDRLSWIVGTHLFTEQLAEQGAGGGLPGSPSPAYYHLTDLTQHTQSAAIFGSVKYRFTDRFNVTGGLRYTIERKTINLTGLQDTGNVTFSDPNSWWSPSSVSSPLAVSARQNQTNTWRAPTWDLTPEYALSSNVRAYFRYARGFRSGGYNGNAYTQSTVSTVSPEYLTDYEVGIKSEWFDKRLIVNASVFHYDYRDIQVFALAPNPFGGPPVSTLSNAGQGRADGFELELKAQPVNSLYLFANLGMLNTRYTEFRNVPTAVGNSFARSPHTTLNAGFDYRVPVSFGTLTAGGDVNYRSREYFSATRQTMPQLWQGGYTVLNAHVSYTTPNQKYIVTGYVTNLTNKVYKKLELLPSYGAYPTLYGDPRTVGITLTAKI

SEQ ID NO: 17099 - protein, 493 aa, Xanthomonas campestris
MRDCLKTSPMPNVLSPPARLLLFGAGLACALPLLDTPALAQSPSAVESFTGEAGPRTNPEAIGVAPDGKVKWHGPLAPYAASLALAGLSFDVNVYDFFFSNPSAGLRPGQLSNSAYYLLSLDADLDKLAGIPGGWFHITQTFFGLRWNNRNMGADIGDTTIGYQPTFNRDVARLSILTYEQRLLDDRLAIEVGRTHPNRYYALPPCQSSVSCFQDILQINAGLSSPLYGVWGANVAYKTSPDDYIQAGAFAVTGRANFTSGWDFGYEPLNGVVTLAEIGHATTFVTDPYPSRVALTGFYNTADHEDNLRTVFGTSKGLNPGDPVRLRSGTSGVILTGSQVFWRADGGAEAGNLNPTSLQAYTSLAYAPDPTVPIRWNAFAGLTLQAPDQSRPHDRYGVKVNWQRISADYAQFLGDANFISGGSSEIYSRDKLIFEANAHLALGKNIFFEPVVQYLVNGNSFWNPFTPNRTKDGFYVGATLIVPLGQLLGLAPG

SEQ ID NO: 17100 - protein, 883 aa, Xanthomonas campestris
MTAFRAAFKAYRMHQVLLLPRFARLTIALSLATAVFPVDAEYYFNPRFLSNDLAESVDLSAFTKGREAPPGTYRVDIYLNDEFMTSRDITFITDDNNADLIPCLSTDLLVSLGIKKSALLDNKEHSAEKHVPDNSACTPLQDRLVDASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPRFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDSNEQTQFIDYFNLFYSKRGQEQISISQQLGNYGATFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSTLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPGTLLNQQTAICR

SEQ ID NO: 17101 - protein, 1132 aa, Xanthomonas campestris
MSTLTVGRSSPLLLGSAATLSLLAALAPHVAAQEVISDTRTEGVLTSVTGDLTIDEDGAFELDDGTAITVDSDATVVNNGTILYPAETAADGSRGVFVTPGAGTFSYTQGSSGRITLNDDDPNDDDLPPPYADDRFGFLLSAGAYTGDVTFEDGSQVTVIGDASGGIILNGNLDGNFSSGAGVVMTGANSTGVQVSGVTGDVTFSSEAAVVANGESSTGIAVTGPVGGAVTFGGSVQSSGYQRASTAAAPTVDSPEDNDNFDQAGFQAGDALFIGGDVAGGVLLDGPLPSEFSAVEGQATSSATVSMLGNGNGVRIDGEGSPITLGPVDATGIEDAEANPYGAYGFINRGQIVARGIFGETVDYATDTEGNVQFDADGEPVVIATRPGVPAQAVFVDDATIEGGIRNDGVIDSLALDAAATGLRLGGGATVPVLYNRGTVTVVGRGDGASSEAIVVEAGGSLSELTNTGLIEAATLSDDGSGTAILDAGGSLTRITNSGTIAATAVPENVAETTGVATAIDLSANTTGVTIENTTGPLFDEETDSRANFGVVIGRIVTGSGGDSYLASAGRTIGDVDLGDGDNTLALSGGATLTGDVRFGTGTDSASLDDATLTGNVDFGSGGGSLSLVNGAALIGGIIGGSGVDASLAEATLTIPTAQTATLGSLTTTADSSLIFTVNEDGTAISSITAGAATLADGTGISTLFTGAFAGDVSATIIATDGLTADLSALVVDNEGTTPFLFSPSLALSDGGTDLDLTLRRKTADELGLSDGFAPAYEPIIAAVVTASDSGDPDAGLLLFNARSQRVFDQSFRQFLPVPLDGALTYARAQNNSITSIINQRTDRYVSYGDGKPHFWLQEGTYFVNRESTADSNGFDGGGFVIAGGADMPFGGFDIFGIAAHFASARFDEQEGQDFPVDRLSYGFDVYGSKRVGNLQMDYRSGFALSNSDSERNILIDTNLRQFEGEWDGTQLSSNARVRYDIDTERARVTPFLAMDYLRLKEDSYLEKGDDVLRLAVDDREAESLRANVGVELSRSFVLDQGRYEFNRPGTFRPRLLAAWSQELITDDLESRYQFPTGDPFTLSTETESSAAIVGADISYENDYATVHFGGSGTFGEVSETYQLRAAIGLKW

SEQ ID NO: 17102 - protein, 869 aa, Xanthomonas campestris
MRWLSFLCCLSAAALAAPPALGQPEARPEAPVAPQILEHVDPEYPPERLAEGIDTTVTLFVTVEKDGTVSDAVVAESGGAAFDDAAMKAVRRWRFSPAMRGGAPLRARIRVPFHFAPGPHEQEPAPAPAEPAPPASAPAPPPKAPPAPVEEFAGGVAGPHAVAEPGKPIEIHVQGRPNPPRRASSDFRIGRATLSAAPHATAADLLRTAPGVHIAHPEGDAVAQRIFLRGFEAEHGQDVELRVGPIPLNQRSHVHGQGYADLGVIIPEVVRSLRVVEGVYDPQQGDFAIAGSAYFDLGVEERGLLLKGTLGSFGTRRLLALWAPEAQSEDTFGAAAVRATDGFGDGTRGAVSGGAIGQYRVPLPDEFSALLHVAAHGARANLAGVVRRDDIEAGRVDFHGAYPDVSARSQSAASTRLQLALLVERADDDGSRKSAWLWTMASGYRSRMNFTGYTQRSRERPAWTGRGDLFEQSNHDAALGGGFTYSTPEAPVTSWLTGQVALGAEVQTDWIDQAQNLLQQPQNETWDRRIDASIQLTGIGVHGDVLLEPARWARLRGGLRADLLVFDVDDRLGNFIPAAQKETHIVGFRRTAAGVAFGPRATLEVDPLPRLRLSASYGHGYRSPQALWLEDGENAPFTAVRSYEVGATFRPGGGLSATAAAYETRLSEDVEADPTEGGRMRLIGPTTRRGVVLYVQAAPSPMLVSTVSATFTHATKDAPPAPTPEDPSPSYVPGEPLPFVPPVVVRADLSLRRELVAIAGAPVEGRLGYGATFLSPQPLPRAQRAAPVFVMDASLAFRRRLGAGGGDAPSRPWIEVGVEAQNLLDAEYADAEYSFVSSWPTTPVPSRLPARHISAGPPLTILGNVTLSL

SEQ ID NO: 17103 - protein, 1128 aa, Xanthomonas campestris
MKTYQQKQAPVKGQIAPPPLFKITSLAVAAAFCVPQQAHAACSGSSTVSCTGSLSGSLSYGSGTSEIDLVNANLSGTVTWNNPTGPSVITISGSTLSTNTGQAFSVNNANGALSMSLDAASQITSPNSGSGAVSLTTSTSNTGDILLNSAASVSGKGGLLTWNNGSGSITMSNSGSVVSNNQSGLGATTAAGGSISITNASGGQTQASNGNAIDTHSNGASGDTVIVNNGSAISTGNASGINSTSNGGNIAIQNNGQVVAGGTAITASNTGAGNITINSSGTINQAGTAAAAIGVNSNGGQVGIDTRAGSVNGSIFVTANNGGVQATVGNIASNSNAVVVTYTGSNANAGGVSLNTAAGTDISTSFAGIAVTSQGNNGGISVTTNGTIGGAQAVRNGVIGSITASGNNANVQMQLNNTVNAVRTAIAGSTAGNGNVAIVSQAALSSQQGHGISASSAGGNVSVTANGAVTGVTAIRGSSASGNVALTANANTTGTGAVALSGNQLSGAALQVANAVQATVDNYASATTQSVSVAAVDVNAGSAIVNNHAGALLAGAGDFAVNGRNGNVTVNNDGTITGYVTLQGSGNTFNNNSSHSLDLRNYVAGVQNVAVAQINGVFNNNADGVLRVLAVNAPQSVNNAGAWQTGGSQLPGNGVVQGQLTGVSNFNNSGTITLQSADIGAAQAVAGKLLVITGGQTAGASGGGTYTSNGGQLRLDAVLNQGGAASLNDMLVVDRTAVGSGGATRVSVNNVGGLGGYTGNGPSDGIELIKVLDAGYSAANAFSLAAPLGAGAFQYSLRQADGQNWYLQTTDLVPLAKIQAMLPVALSQYGLDTLGTLWQRVGSRRYQPQQQEEAGRPAAWVRAGGHRGYTEGSIAGNGFSYASSYQLNDDFIEIGADHRLWQSGKGSWIGSLFGSHGNGSMKLQNGADGRADLSSNSLGLAATWYGNNGYYLDMLGKWSRIGTRLAATGVNGSPDGHSALFSLETGYQRAISRDWSVVPQLQLVWQDNRLDGYTDSNGVKQQADNDRNLMGRLGVAMRYAKPEAEGRGFNGYVKADLLHSFQNSGLVTFSGTPLAFQSSRNSMELGVGGNWSNAKRTVDTYVELNYRHALGGNAGYTAGGMLGARYHW

SEQ ID NO: 17104 - protein, 977 aa, Xanthomonas campestris
MKNSYARTALSCALGSILLGMASTAAWAQSTDAASTAQTPPTSAGDNGAVKQLDTVTVSGYRRSIQFSTDAKHDSLGFADTVFAEDIGKFPDMNIAESLNRIPGVQLARDVNGEGLNIAIRGLGTSFTKTTLNGASIATASIGLNAQNQNREVDLNLFPTEFFTQLTVSKTPTASMLEGGVSGVVDMRSARPFDRPGVHFTYQAQADWNSTSEKTTPRGAFMGSWTNEAGTFGALFGVASVRSKLGVRGFESVGWTNPGLTYTQCGLTPPAGTPATNQPAACNVNGGGNWRIPDTVPATAGSGLTTGETIDAAWLLARNPGLSIDQISDALIPRLGRQVYMNGDRDRDASVMSLEWRPSDSMHFYLDTLYSEAKRSTERVSMNLIGRNGNMIPLGMQLDQNNVVTSATFANAQYFLEARPYHENVKFWSVNPGAQLLLGADQDIKLNVQANATRSWLARESPSILVTSPFTTVDYRNQGGDRPSITSPLDLNDPNLGWGWTGGRVNIQNEKRQTETRGARADLQFGEDQRNVKIGASYDMAERTIRGFDNSIAWEQVVCRGNGGNVCNGGAGSAIPNSALASYLKPGPGDFITADFSRFLADTNYYALRDAAPESNSANTGASTGGIREKNLGFYIETNADADVWNRTMRFNAGVRYVTTDQTITGPVTINGVRSVQVLDSDYKATLPSFNVAWDVADKVVMRLSSSRTLTRPDPSAMLPNTNFSDPSAQTATQGNPNLKPYLSTNVDFGGEWYTGDEGYVGLTLFNKRITGFTVNGIRRIPFNDLGVNYDTLLPIQQAGLAQRGGPDAATVDVQTQVNADGVLNIRGTEAIWVQPLDKLFDGLGFSLNYTHVSQQSEGEGVPAVAVGVAPNLWNGTVYWEKDAASIRLSYTWNDDMVISGANQNGIPYARLNADARGQLDMSASYALDWLPSKPQITLNVTNITNEPLRTTFAWPNATYDLYEPGRTVMLGIRGTF

SEQ ID NO: 17105 - protein, 897 aa, Xanthomonas campestris
MGLPDSADRAMRLFHRSPSGFLCLPGPACIAQRRTLSLALGMAVAGWMQAPAQAAEAPADASPQTLDAVQVRTSFQSQNTRAIATKQAAPTVVDSVAADSIGQLADFNVGDALRRVTGVSTVEYQGEPRYVTVRGLNGNYNSMLIDGFAFASNDIGSRQAMMDVLPANFVDRIDVVKSFLPENDGGAIGGVTNLVTATGFGRPDGLLTFSAKGGANLMGSRYGGRSPVGEGDLKWGKRFGRDGQFAFLGAASQWRREISVPQQENGGGLNWYAADGTRDPVPYGGTGAAVPGERRWYNYANTRERRGLTARVDWQPEGPLSGHVSGYSFRQREASDRNTQNAQVQNSARLTRTGAQSGTLDNLNQYVELGQLRWKRALTGINGELLAELPAQWRAALRASTSRATVDNPQTWDRFQQNRLGYGFDWSGTLPAFTPLDPALADDPARYPNAYHQQERTGYAERVGDLQLELRRNTDEDSRGLGLAVGARQVRTHMRTTVQRTTWNGLPDTLADVLGRPTCALGCNREMMTIEPALADARWDALAGQARGVVDTTAQNSGSYGVDEQVRAGFAQAQWRGERWLLAGGIRLEQTRFASAGQQLSGTTWTPVSAVRTYRNWLPSLSGQLQTSANGTLRVGVSRSIGRPRLDQMALNGGVLTLGSTPPTLNQGNPDLQPRRSQNLDLGHDWSFDDGGSLLSIALFHKTIDDEIFRYGQMDSIDGEQVLVTQPRNVDRPVRLRGAELGAIKELGPWLPVLAGLSVTANVTFLDVDYPVVLGDGTRTTLDVLPQQPKQLWNLTLNYARGPLRATLAWSRTGELWDDRFPNYSSLQEFYRNRYQQPLDRIDLKLGWDVSPAVSLSLDVLNLAGQGYQYRIGRDQEYVQSAWKMAPTVMVGVNVKL

SEQ ID NO: 17106 - protein, 773 aa, Xanthomonas campestris
MMRALGALLAGSAAIWTAPGSAAEREADGGVDRSAIIVTAPGGAVDVDDALILTRDDIGLAGTPDLLGALTRTIAGITLQDAQNNPWQPNLVYRGFSASPLQGVAQGLAVYLDGARFNQPFGDTVAFDLLPEAAIRSVSLLDASPVYGLNALGGAMLVETRTGLSDPGLEASYSAGRFDYREASIAGGIARGDLSAYGAFQYSHEDGWRDFSPSTLYNGYLDLGFDTASGGLHVKLVGADTDLTGNGVAPVELLAADRRAVFTWPDNSQSTYGRISLHPWVALSGTTRIEGTLYAQRLTLRTINGDAADIEACEEEDEAGLLCLESVGDDPDEEEEAVLTDAAGAPIADMLDGDGYGVLNRGRTRTRAMGALFQIIDDRPMLGGRNHFALGLSYDTSRTRFDTSVELGALTDARSVDGLGTMIVQGDGAIAPVSLITHSDYWGVFVQDKLPITPRLSAEIGLRYNHARIVLQDQIGTALNGRHRFQRVNPGVELDYRMSDALSLRAGYAETNRAPTPAELSCADENAPCSLTNFFIADPPLKQVVAKSWEAGASGSGQAGGVKVDWLLSAYRTRNRNDIQYIASAIRGRAYFQNIGATRRQGIEASVKASRGGLTGAISYAFTDATYRAPLTLASPANPQADDDGRIAVARGDRLPGIPRHSATLSLDYATARWSVGGDVLARSGQYLVGDEGNDTRQAPGYAIVNLRGSVTIVPGVSLFGEVRNAFNRRYATFGTFSEVDEINLEEAPGASDPRAYGPGAPRRWYLGMKASF

SEQ ID NO: 17107 - protein, 1004 aa, Xanthomonas campestris
MRETRTLPRTRRLTSALLFALSTPLAAQTAPAPQSASTVPGSSQADPATLDTVQVSGIRGSLTSSMNVKRDAQGIVDGIVAEDIGKFPDTNLAESLQRISGVSIDRSLGEGSRVTVRGVGPDFNLVLLNGRQMPGASIEESNASNSRAFDFANLASESISGIEVFKTSRASTPTGGIGATINIKTARPLDNPGMHANVGLKGVHDASNENLPGRLQGDSLTPEISGIFSNTSADGRFGVSLSGSYQERDFGYSQVGVPNGWRAFRGDSTAYGTIPQPGAPGSENIVNRPGPNDIYSVPQNLNYRVVGVERQRTNGQLTLQYKPLDNITTTLDYTYSENKIQQQRNEMSVWFNYGPSASAWTKGPVAGPITYSEIVNPPTSDLATAGSQAATRNQNKSLGFNVDWAVNDQFKLNFDIHRSTAEAGADSPYGSSNSLGVSGFYRGTSVVNFSKDFPVLQQQLGFGLNGLDPSRTLVTGSAFRNSYMKSEIDQAQVNGDFTFENYSQLKFGIGSTEVKNRSAFSNVQRDTWGGNGTAADYADDLWIPSSFAQYFDAIDGSGNPAQFNQLFLFDFERVRQAAAQAAGDESLYRISPVFTTDRRVTEKSKNAYLQWGNSWDDLRVPISLAAGVRYEETKVQAQALVPVAVGIDWVANNELPIRLADSAFSGGSGKYEYWLPSLDLSFKLREDLVLRGSYGETIGRPGWGDIQGGQTLNQIGRIEGGSGQEGNPGLKPLLSHNIDLSLEWYYGEASYASVGFFRKNIDNYVGVTTRNDTSLGLHTPVGGAYWNQALANGCATADLTCIRNYIFRNFAGQPGVVRGTDDTNGNATGTISGQPGDPVANFSITAPANQRSASLDGWEFNVQHMFGQSGFGVSANYTKVDSGLTYNNYVIGEQFALEGLSDSANLVGFYDKGQWQVRAAYNWRDEFLAARFDGSGLPNPVYTEAYGQLDLNIGYKWTDNLSLSLEAINLTNEIQRQHGRQKNEIIYATQTGPRYMLGLRYKFW

SEQ ID NO: 17108 - protein, 714 aa, Xanthomonas campestris
MPVFPRRRMLHALPLLSLLACACGIACAQAAQSQARDLDAVQVRSQYTPYRALSITGATKTDASLRDLPISARVLDRTLLEDAGVTDLAGALELASGITKANNLGGLWDSYSMRGFTGDPNFSSDYMVNGFNASRGYNGLRDAANTQSIEVIKGPASALYGRGEPGGAVNIVTKKPLFQPQHSVDVSAGSFDSYRAAIDSTGPLSENVAYRLNVMHKDQHSFRDTVDSDRTLLAPSLLWMPAPDTTVSYELEAVRLHTPFDRGVTAIGGDANRLPASRFLGEPRDGDIDLHSTGHQVFVVHGLDQTWSLQGGATYRDSGMRGFSTEPWTLQADQRSLRRERRYRDYQGRDIAARAEVLGGFQAGRVTHNVLFGIDGNRSDDSRFQQRARSAATPYSIDVLAPRYGVAQPGRLSTITDTDERQQVWGVYAQDQIDLGARWKALLGLRYDHYQQQDLDNHLRGTTQRASDGVVSPRAGMTLHVDDALSLYASAAAGFRPNSGVGANGQSFAPEKSRSLEAGLKYVQPGDGLEATVAAFRIDKKNVLSLDPADTSFSLPVGQMRSQGLELDLLGRLSPRLAASVGLAYTDSQVTRSSAAAASTGLAEGRRFPNVPRLSGNAFLNYEQPLTGKRSAALGVGVSHTGERLGSVDSNTDFVLPAYTVWRAVGHYDLSERLRLYAKVENLTDRRYAAFSYSEQWVYPGAPRSWTVGAQFRF

SEQ ID NO: 17109 - protein, 228 aa, Xanthomonas campestris
MRSISILSLAAVSALAIAPSAFAQDTTYTGDTSSTSSSTLSTSGDTASGKHWAVVGGVALLNPKNNPAPGLDVDGGPAPTLSASYYINDNWAVELWGAADKFNHRVNADGVGKVGTVEQQPIAISGQYHFGEADNVFRPFVGVGYYESNFSNEKIDAASTTGDHVGLSTAKGVIGTVGVDMNINSTWFARADARYMRSRPELRVGGQGTGSELELDPWTVGFGIGARF

SEQ ID NO: 17110 - protein, 959 aa, Xanthomonas campestris
MKRLIGPHRSCLAVQLSLCLIPTLAWAQQPEAAPSTRTLDSVQVTGTRIKTAELQGQVPIQTLNRADIERTGLTSIGEVLQELTASGSALNAKFNSSGNFGFPPDGSGVGAGSAQVDLRHLGSKRVLVLVDGIRWVNESSASGVGSSTDLNTIPLAIVERIEVLEDGASSLYGSDAIAGVVNIITRRSFDGAQVTLNYGQYGKGDGTNQGMDLAWGTSGENFSLFLGASYVKQDPIYARDRAQARFPIPGTGLTFASSATPDGRFQFVDPNTGVRQNLTPNAGVGTPQYDGSGGCTRSDDYHCFGTADRYNFAEQNLLLTPSERKGVFAQFRYYFNDDVQWYVKALGNRRESTNQAAPEPIFLGPDAGTGNPLADNIVISALNPFNPFGFDLDSATNLIQIGRRPVEGGPRRYEQQVDTQYFGTGLVGTFEGAGRTWFWDVNGIYSKNKAEQTNYGSYNLYNINLALGDPAGCAAVAGCVPLDIFSGAGSITPEMLRWIQPVVRDRSQNELSLFTANLSSELFQLPGGAVSFASGYEYRKYEGSYQPDPLTVAGRYNGVPSLPTAGSYDVNEAYLELNIPIFANSALGDKLDLNIAGRYSDYSTFGGEFTPKYGLRWQVTDEFVLRTSYAEGFRAPTIGELFGSAARADLQLSDPCSIGLGGTAPRGSAANCAALGVPTGYQQANQQISVTTGGNEQLDPEHSRSFSAGFVFSPGFASDASWSDRLDLEVTFYRHHVDGAIQAINAQTQLDLCVDTLDALYCDGIARASTGGINAFNNRLTNLGSIKTDGWDVDLFWTLPEAAFGRFKLSWQNTLVGRYEALGAAGQRQPQGPGIEVVDSAIPEWTSNAVLDWSLGNWTASWTARHISKLTEQCGDAVEFAVCSDPTVGTNRLDAITYHDAQVGYRVDWLKGLQLTAGLNNVFDKDPPICLSCSLNGYDASTYDIPGGRFWYARVDLKF

SEQ ID NO: 17111 - protein, 800 aa, Xanthomonas campestris
MSVADVLRRSNLNSFGSTSERSGSSAQSQATINLRGAGSDRTLVLLNGKRMPGSPTLGGTAVNLNTIPTAAIERIEVLTDGASAVYGSDAVAGVVNIILKKGFEGLEVSATSSQPVQDGGEEWKTQIVGGAVGEKGSVTFSFEHLNREIIYQRDRWFSSSSNVLAPKFDDTTGVSTYARNFLDGKTGQFKPMTACDNPKMVGGGHIYDAGDGDYVCGYDFTAEAADHAARSYTAGYVNAEYELSDEIVFQGLGLFSRNETFGRYAPAAGWFNVAPGQVEVKNYDANGKYTGNSLNENAGRAYYRFTDVGTRDAKTVDYSTDIQLGLVGTHDSFGWDFTYHYNLAENSNYGTGYVHRPTVERYVKDGIFNFGPEGNSASVIADMAHKTLKQDIMEFQSVNAGVNFEAIELPAGNIGWYIGTEALQYKYEANVDAQTAAGDVIGSSGNGASGDRDVYALFAESIIPVTEDLELNLAYRYDNYSDFGSATTPKVALRYQLLDDVVFRASWGQGFRAPSLSDLIASDSFSADTATDYHYCDVLGTNVADCKAKQYDVTRTANKELQPETSNFYNLGLVWDITDKLSTKIEYYNLDIKDVITFVSLDSLLKEEQKVGYGNLSRGEIKRVGDNPNGKLLSATTPKANGNGFDTSGIDFNLTYSGFETTIGDFSSSYDLSYILSYNEEEYFDGPVNDKIGRNGMPEFRFTWVIDWSYGDHSASILTQYIDGQSEKTDPNTYAQVGSLSSQTTFDISYGYATPWEGKISLGIRNLTNEDPVLDSDLKYDASLYNLYGRTFTATYTQKF

SEQ ID NO: 17112 - protein, 814 aa, Xanthomonas campestris
MSTLHTLRLHALACAVVSCLCAPAALAQDTAAAARAADSAAVNLDSVFVTGTSTATTKLKSSVSVSTVGAEAIEQSAPRSTAEIFRNIPGIRSESSGGEGNANIAVRGLPVASGGAKFLQLQEDGLPVMEFGDIAFGNSDIFLRSDFTLDRIEAIRGGSASTFTSNAPGGIINFISKTGDTAGGSVGVSRGLDYDNTRIDFDYGAPFAEQWQFNIGGFFRQGDGIRDAGYGTDKGGQLKANLTRLFDNGYVRLYGKYLNDRAAGYLPVPASVRGSDGSPNPGRLPGFDPGRDTLYSPNFRSDIGLDGNNGPRSTNLSDGMHPISRTLGAEAWFDLGNGWNLSEKFRIADNSGRFVSPFPVEVSDAATLAAAIGGGGAQLIQATGPQVGQAYSGLAVRTHLFNVAINDLGNVVNDLSVSREFGGDGRTLNLRMGYYTSRQTIDMDWTWDSYVQSLGRESRLLNVVDANGTSLSRGGLYAYGTPFWGDCCVTRSYDVRYDVNAPYVALTFDSGKFSVDGSLRYDMGDARGSYNGTAIAQNLDVNGDGVIQPVEQRVATVDTANSRPVNYDWNYLSYSLGGNYLLTDDLGAFARISRGARANADRLLFGVVRDDGSVSTNEGVNVVRQAEAGLKWRRDGLSLFATAFSARTQEQNFEITSQRFFNRSYEAHGVELEASYRYQGFTVNGGLTWTDAEISRDQITPENTGNVPRRQADVVWQLTPSYRGDHYQFGVNLIGTTDAYTQDSNQLKMPGYTQVNLFGDYRVTDALTVALNVNNLFNTFGLTEAEEATIPANGIIRARSIAGRTTSISLRYDF

SEQ ID NO: 17113 - protein, 397 aa, Xanthomonas campestris
MSNDTLRLRALGACAAICLAPAAHAADEAGPVTAELGGRVHWDFTVFDNDDRGAREHNDTQFRRVWLDVSGKFYGFNYKAEADFAGLQYEAGSRGILARDVYVAKKFSAGTLTVGQFKQYFSLDDRTGSNYGPFLERGYASTTLAPIYRKAISWQTNRPDATWSTSAYSLESIDNSSTKGGALGTRLTYAPEMGEARLRHLGISLAHERYSHPGSGGASSLLIRPRPENDLANNSRITLARFADGRDTDFDKWSLEYAEVLGPWSWQSEFSGGLLDDGAQHAEVLASYGLVSWFVTGESRGYDRKTGRFSRIATPNRPSGAFELALRYDYMRGDQHLDGQPDFINASTQSWTLGGNWYFKPNLRVMLNVIDSRNRNRIANAVVDHTLAVTGRFQYDF

SEQ ID NO: 17114 - protein, 390 aa, Xanthomonas campestris
MRLNLLVLALAAAIVPAAANAATSIENWPTKYTFGDGTELGLTGNYAYDDNNFSGDDRLEDRNDFRRKEFGATIKKKGVYDAMVYYDFESKLWLDVFYRFETKALFGQDYGRVRLGYMKVPVGLEAVQSSRAGSFMELGLPIQAVFQGRRTGAEWTLERQQYLLQAGAYGGKDLQGDNPGTTQAVHAAWTPLKAEGDVLHLGIAGSIENPRGYSDGRGVSFSPRVRLRARPEAGLTDVRLIDTGTILDVDHVIRTGLEAVWIHGPFSLQSEALRAEVARNANQPHFIAQGQYVYGTWTLTGESRSYAGGVPGNIKPSHDYGAVELTARYSRLNLEDNNVHGGRQHDTTIGANWYLTSHFKFQANYSWVDSSRNGVHETPHVMELRAQVQF

SEQ ID NO: 17115 - protein, 640 aa, Xanthomonas campestris
MTKTSRRWPFAACLLSLACGTAAAAPYSTMVVFGDSLADAGQFPDTAGPRGSTLRFTNRVGPTYQDGSGEVFNLNSSTLIGRMLGVPAGDLAASTSPVNAALGASDGNNWAVSGYRTDQILESINSQSTFVDPNTGTLLRSRTGYLPANGFRADPNALYYLTGGGNDFLQGRVVSASSAAQAANQLADSAQALQQAGARYIMVWLLPDIGKTPALSGSPLASATSALSAGFNQQLVSRLAQINAQIIPLNVPLLINEVLAEPARFGFDPNENLVSTCFSGDSCTESAANGRSSATPNPSRVFFNDRVHPTEAGQRLLADYAYSLLSAPWEITLLPEMANGTLRMHQDEIRAQWLSDWGNWQGVGQWQSVLAAGGQKMDFDAQDSSADADGRGYNLTIGGSYRFAENWRTGVVAGAYRQNLEAGPKDSDYKLNSYIATAFLQYQANHWWGDLAVSGGKLDYENAERKFALGVSEGQEKGDTDGEMWAASGRVGFDIAGASSRWHLSPFVSADYAHIDVDGYSEKGDRSTALTFSDQTRKSRRAGVGVQGKFQVTPSTQVWGEVAHEREFETDQQDVTMALNSVQSVGFTLEGYTPQRDLNRATLGVSQKLTQDLTLRGNYNWRKNDDVTQQGVNVALSMSF

SEQ ID NO: 17116 - protein, 947 aa, Xanthomonas campestris
MNLRTSAVRLGLLPAGIAIALTPAFAAAQESTTTLDRIEITGSRIRSADVETQQPILTLDRQALEKQGLTSVADVLQNLTSAGSPAISRADALSSGEDVGGYYVDLRNLGAQRTLVLVNGKRLGASTSGLQDLSQIPMAAIERIEVLKDGASSIYGSDAIAGVVNVITRKRFDGAEASVQFGQFGQGDGDTTQYSFTVGTQGERGGVTLSAEYSKQDPVFAKNRWFSRDGSRGPNSTPNSWSPISQNGSWCNPLQVDCADPDAAVWQTLNAGGNPNNPADYHPLTPAEYANSNQQMMVQTGIERKSVFANVNYDVADAITFNADIAYNERTTDGQIAGYPYQSGAFGTPLEAGSAFNPIGQDVDFRRRLWEMPRASENQLKTLRFAPTLSGYFDLGGKTWDWDVGALWNRNENTKRSRGDMSLIASRQALGPSFINGQGVAQCGTAADPVSLSACRPWNPLLPYNVAGQGSLADPALQEFLFPTFTDTGLTKTTSFTANLSGSIVEMPAGDLGIAVGYEHRKEEGRFSPDAFAQSGESTGLGAKTTQGQYSLDEVYLELNVPLLSDVAFAKELTFNAATRYSDYSNFGNTLNSKFGLTWRPLEDLLVRATYAEGFRAPTISDLYGGLSSSFEDYIDPCGVGAPNSVNGNAACNAAGVPLGYTQLGQGFVPCTTYPCQTPDEFISGANPNLKPETSTSKTAGLVWSPRWVQGLDISLDWYRYEINDMIIADSVDRILRDCYVLGDTSRCSSLTRAADGHISSMTYGVANLGQMETEGYDLGVKYRLPETAIGSFTFDWQTSYVSKYDEAGQDSAGNPIMIGRVGEPGIFRVRSNVGVNWTLGDFGVNYTLRYYSGMKEGCITLAEGYCDAPDHFANGESDPLRHTGSNTFHDLQVNWKAPWDATIALGANNVFDHRGPLQYSAPNSSFAYYGGFEIGRFMYMKYTQRF

SEQ ID NO: 17117 - protein, 764 aa, Xanthomonas campestris
MPKCLNTDQLATSVAYILATTRPRHALASMTLLLAGAQSLPALAQDARTLDAVSVVGTGSTRTTASISVDEIQAQVPGVAPQQLLASLPGVNVQTTDPFGLYEFGDSMTIRGFSANQIGVTLDGIPIETFDTREGGPITRYVSSENLLDVTVSAGSGDVTQPSYHALGGAIRYTSLPPKGGDSWSGNLTQTIGSDDLVRSFVRLDTPDWWEGGPSAYLSASRTQGGVWDMEPATQKSDHFEAKIRQAWDAGSLTLGWIYNNRKDYDVQSYNSDGSVSWDLHERITGNPEVDAEHYSEWQNGRRDSLLSLHGDFLFNDAIGFTFTGYYENKHGYGVGGTPPSTATGLYNDAIAGTPGRTDIAINDPQIVDANGNVTHVGAMTRREEIMGGDRYGLTTSVSWETEHNKLEVGAWYENYDFDQVRPLYNLDPATGALLKSALPIVIYYDNHFSTEVKQLYIKDTLRLLDDRLTMEFGAKGLDVKRDYNGIANLDDFNVGIRRDVTIKNSDWFQPQVGASFQLAEGVQVFANYAENFSSAPRLALTSGAFNPDIAPEESTNIDIGIRAESTQWSGYLAAYKIDYENRIIALTDPDPLVVAPTVYANVGDVQTYGTEVSGMWKPAPGWRLGASLTWNKSEFQDNYFGPVSGNLVQVEGNEVPDAPKVMFSVNGGWEGAHFFANLDTKYTGKRYGDTLNTDRVDATFIVNGSVGYQGGDSGFLAGGRLQLSVYNLFDKDDAIGAVFPNESSGSYQLIAPRQLFASLAYTF

SEQ ID NO: 17118 - protein, 1302 aa, Xanthomonas campestris
MNRSIERALGLAAASAFCLFASPFLAAQTAAPTGAEIDPADEQPIVLSPFVVDASEDQGSYQANSTLAGSRVRTDLKDLPSAISVVTKEFLRDTGAKNSADLLVYTPSTEVGGIRGNYSGVAGSAVYQENTVTSATRVRGLDSADNTRDYFLTDIPWDGFNIGRVDLQRGPNSILFGVGSPAGIINGSVNDATFKTAHQLENRLDEWGSVRTSIDLNQVLISKVLAVRFAGLQDNAKFQQEPAYNDATRLFGALRFEPKLMEVLDGHTSIRAKYEYGKVRANNPRSTPPVDEISYWFNSGPQARLGNNLGYNKLVIDQFSLINPNPSGVPLPGGTGSYLAARTYELGGWAEGRQYWANITNYYEATPASINSVANPPQPSATPFYTITAQAQTGSGIADANGNRVRGAQGYRPVGIPPMSQYAANVGLNVGTTGTGTGTYPWLTVPGGIFWADEVITDPSIFDFYTHLLDGPNKREWQDWNAMNVAIDQSFFNDRLAFQAAFDHQDYEEGAHRWMTGSNYAITVDVNVRYANGALNPNAGRPMVTNGSGAPSLNYQQNTVRDAVRLTTTGDLRAEDFLDKGSRLERILGKHVFTGLYERNTVVQRNMNWSDFAVTPEWSIYNNSSLLNAANGLGSGRQFEWAAYVGPSLASASSASGANLTNLNYVIRPPKNQNVINFDSHWNRPTDPAATGYVDPSAPFPTRPAADYTGTTPTVSDGFYIENNGTQNNAGAYNQSQNPANYIGWQSQPATWMFSDDPQDFPNLVQSASRTRYRNLSRGITWQGRMFDGTLVPTFGWRKDVITNYQTNAVTDQNTGFTSLEFPDNFASRTDVKGESKSWGAVYHLPKFITNRLPGDTQISLFYNRSRNFRADATRLSLSGIPVPNASGDTKEFGVSITTLNDKLTLRVNRFRTKVANATLGTTSGNSIGGLGNNAYFIADGSIWGYGWATQMQDFLAGHPASSGYGDYAGNDGLPRNTPEEIAAYDAYNRNGGTAPNGTRYVGGLAIADAWVHAPFPASFFRSYALTPDIDPTIGAQSGRLGDSFTAGYSLASGAPVGGGSTFGNHHTTVDTKSTGTEIELYAQPTKNWNVSLNYSKVDATYESIDTVSKDFIGAMTRFMNGPGGQVRMWYNGGQPLQAQWNTSIVAPYTVFLNGLGRAAPEVSPWRLNAISTYTFDHGRLKGLFVGGAARLEAGRIIGYRFNPDFENANTNDPDYAGVEFLTQGGLDVNQPFKGDNETHVDVWFGYSFKVTRDVNWRIQVNVRNVGEDNSLVPSRLQPNGDLALARIQEGMSWQLTNTFEF

SEQ ID NO: 17119 - protein, 840 aa, Xanthomonas campestris
MIRSSSAVVMTDRSMGNARVPGYRRALALSALAIALLGAGVHAQAASVQAPQAYSIASGSLAQVLARFASEGGFTLQYTSELTRGLSSPGLQGQYGIEEGFQHLLAGTGLQAVRRGNNVYGLQPLPLSAASGGEALNLEPLNINGIQDNATTEGSGSYTANAVTIGKGTHRLKDIPQSVSVVTRKAMDDQRLDTLDEVLEKTTGITTLQSPSGGKYIYSRGFEVETIQYDGVPLDRRYYAIGSSFTSDTLLYDRVEILRGANGLLQGSGNPGAAINLVRKRPKAEPSLSVTASAGSWDTYRQTIDGSAPLNADGSLRGRLVAGHEDQNYFYDTAESRKNVLYGILEYDLSDRTTVAAGASVEDLHSTPFFSGLPRNKDGSAVNVSRSTYTGADWNKWDNKQTTYFADVTHDFNEDWRLKASGSYMRETNYILYSFGRGAVDPATGNGMRSRAYLYDFENINKGGDINLTGKWRAFGREHEVVVGANASDLQTDDLQGGFINLGPMNIYDPVSPQRPTMDQLLGAEGTNTYPGTSKAKIRQSGIYAVTRYKLSDPLTLVLGGRSSNYSYDYELNRFNGVSPTPAHSRESGEFTPYGGLIYALNEQWSAYLSYADIFKPQTELSVDNAPLKPIVGSNYEMGLKGELFDGRVNTSFALFQVDQENRAQATLCGDNGGENCYVAGGKVRTQGFDAEISGEVLDRMQLFAGYTYTHTEYRNDPADGESEAGGTFNTYTPKHLFRFWADYNLPGELDPWTVGAGANIQSRNYHGNFGGTDGVGKIEQAGYAIWNARVAYQINKNLSVSLNGNNLFDKKYFSSVGWLYAANYYGDPRNYTLTLRADF

SEQ ID NO: 17120 - protein, 1153 aa, Xanthomonas campestris
MPACLFGLAITGWAQQAASTPAQPEDDEVIVLSPFDVVSDTKGYYSANTMSGTRFNTKLADLASSVTVMTKAQMNDFAMIDANDIFLYAANTEGTGTYTDYTLDRNGSIGDNVQANPTGANRVRGIAPANVSLSNFETMNRVPVDSVEVESVEISRGPNANVFGLGNPSGTINLVPTAAILTRDRVSAEARADSYGGWRTSLDVNQVLIKNKLAVRFSGVFQQDEFEREPSGVKTERYKGMIKYRPFKNTTITGSIGYYHAYGNRPNAIPPRDNLSYWIASGKPTWDPVTMTVYLNDAPVGTYTANNYNGPYFTSAYLGNNRNQMFIDRDGLVYWSAPQIVTNATNPTANAVGQRYLQPAAAAGPTFSGTAPRPFDQPLFNTTPTVSDKSIYDWSSINLSSPNSFWDKTTTSLFQIDQIILDTPMQTLAAQAAFFREESERWTNNVLGTINDNGQSGQLTVDINRRLLDGSPNPFYLRPYVASDRPRMQYNPQKWDTTRGQLAYRLNLTDQDNLLKWLGWFQITGYGEYKYRMNRQYSWRDAMISPVSWIPAGTYVGSQSSPSGSPPNLAITTGLQRYYVGDTNGNNVDYAPATTFENNQTYPFVWVSRTGSGTAAAPYVFTSHTDNILIGPAAADKSGRFSGDFNSKTTLKTAGVVGQSHLFNDRLITTVGWRNDSLWTKLGNPGNPRNAVFQADGITFNHDVIDHWDANYFKNGGHTTNVQFVVRPFTGMSWVNQLQQNGRGGQFLSELLNGLSVNSNKSNSFLPTNPAQDLNKNLLPNTTGTDKSWGLGLSLFGDKLQIRATRYDNKQTNAQTNDMSTMAGRVLRMDFPVVGAGSPTGSHNLYYNAQRWVTWQNPGWSTAQVEAEVERQTGLSAENRDYYSNASPGIGATTDIRSTGTEIEINYNPTNFWTVAASITKTKSVNTNVSRALVDWIETRRDIWTSIVDPSITDANAADEGNPGKLWWKHRYTQLAVGNSALTYGTPASYTASAATPEQNFIAFVDAPFAVMRELEGKSNPQIRPWAFRASTSVQLGGLFDNKHLKRMSVGGALRWEDKGAIGYYGVQQLPAIITQLDVNRPIYDETHTYVDLFASYKVKLWNDKVVMTLKANVRNLGETGRLQPVGAFPDGTIHTYRIIDPQLFILTASFDL

SEQ ID NO: 17121 - protein, 829 aa, Xanthomonas campestris
MNTLTRSIKFALFGTALAALTPAYVLAQQTQVNISVQPLGQALNLLSQQTGTVIIAPSRLVSGKQAIAISGELSVLNAVEKLLDGSGLQAYEQPSGAIVIKKASQKNKYQNKRAASYQAPMDEVVVTALKRDSSLQDTPVAISVLGADELKAQGVTDFTDLIDSLSGISINSAFGGPENSFITIRGIGGADDYKPNGNPSVALHVDGIYQTSNAYLSMPLFDLERIEVLKGPQGTLYGRNTTAGAINAITRAPGEELNGYADIEYGSYDFVSGTAAVGGKVSDKLGVRVAVLMEQGGGFMDGKGAGNFAGFVPQGTQGIVPPVADPGERDGFGDADLFAFRGTAVYDFDEVTSLTLHYFTSQDRGDTRQYDRIAFEDDNPSLNAGEGNDPYDFYTSEYYSHEIDVSGFSGDLNRQLQSGLNLDILFALQSSERNVSGNGDGTSFPRYQYNFDDDLDQTSLEIRLSDATGGEFDWIAGAFFMNDSVDFTSNWTSYAVLSQYSSPYNQRRNSFATFGNIDWNISNDLVISGGLRYTKDNAKFRGENIDADPWGLSVFEETFKTDANFSWDREFDDSNVSGKLAIQYFINDNLNVFASVSTAYRGGGFDGTSIFSEEETQPFESEEVLAYEAGARYVTDNINFTFDLFSYDFEELQATARLSNDTNGRTNVGEATVRGAEASIAVTLYEANDHKITFNTAGTYLDTEITEFSSNRVNDVVSTIGDPLPGSPEWSQTAVLNYQTSLANNTQLNARLNYSYHGEESNRLNAGDGNTAPSYDLLGVRLDVTFANGLNVYAYGRNITDEVYFLELNGGARLVGAPATYGGGVSYAF

SEQ ID NO: 17122 - protein, 3954 aa, Xanthomonas campestris
MRMRMGSNKKRAEARPNMLVPTGMLVALVGAGVIPADALAACTGAPTVTCTGATTNYVSSINGLNVTVAPGATVSVVPLLGGTAMSLTGSGVTLINNGTIDPSLGGLSAVSNGAVVGNVSSASTVNVTNSSTGVMMGSTSGVLANGPALTVYNGVGGTTNITNAGTIGTTGILGFGAGPTAQVVTASGGAQVNFTNASGGKINGSVVLAPSAVAGTGNTFTNAGTITGNVSLGAAAGASNTFNALTGSSVGLGVDAGAGLGGSNTLNLQLNTASGSAANGAIAVDTFANFNHLAVQGGTWDITGASTATDASLTGGTAIVHGTGALGTGTIVAGGGTLEAGAAGVNLLNDVTLNGGLNGGLTVDGANGLALSGAIGGSGALNVNGTGTLALNGANSFTGGTNLTGGGGIVVGTGSALGTGALNVTGAGGSLGTSVGGTVLGNAINLDPNVTLGLNGSANLGLGGVIGGSGSLAQTGTGTTTLTGVNTFTGGTTLSGGGLIAGNGAALGAGALHVSGAGGSLATNASGTLLGNAVNLDAGATLGLNGAADLSLGGAIGGNGSLAQTGAGTTTLLGANTFSGGTTLSGGGLVAGSGAALGTGALNLTGTGGTLATNAAGTLLGNAVNLGAGATLGLNGSADLSLGGAIGGSGSLAQTGAGTTTLLGANTFSGGTALGAGGLVAGNAAALGTGALNVIGAGGSLATNASGTVLGNAVNLGAGATLGLNGAADLGLSGAISGAGGLALGGTGATTLSGANTFTGGASLTGGGSLIVEGGSALGVGGALNVGGLGGSLSADLAAGASLANAINLNGASLTLNGAHDLGLSGAIGGTGGLVLSGTGTTTLSGANTFGGGTTLSAGTLLAGSNTALGSGALNVAGAGGALGASVSGTTLGNAVNLGAGATLALTGANDLGLSGAIAGDGGLAQTGTGITTLLGANTYTGGTTLSGGGLLAGNGSALGTGALNVTGAGGSLGTTVGGTVLGNAIQLGAGAALTVGGANDLELGGIISGAGGLSVSGPGTTKLTAAETFTGGTTIGSGTLAIGAGGSLAASSPVNLTGAGAQFNIAGATTPQSIGTLSGVAGSTIDLGSNNLTLAGSGSGVFAGNIGGAGGLTLSGTGSQALTGNNTYAGGTALTGGSLLVGSGAALGLGALDVNGSASLGASVPGVTLGNAVNLGAGVTLGLNGANDLGLSGTIAGNGSLAQTGTGTTTLLGANTFSGGTTLSGGGLIAGNGAALGTGALNVGGAGGTLATNVAGTLLGNAVNLGAGATLGLNGAADLSLGGTIAGDGGIAQTGAGITTLLGANTYTGGTTLSGGGLIAANGSALGTGALNVTGAGGSLGTSVGGTVLGNAVNLGAGATLTVGGANNLGLGGAISGGGNLAVSGPSITTLTGAGSYTGNTTIGNGSTLAVGAGGSLSGGSLFDLAGAGATLDLSAATSPQTMGGLVGAAGSAVNLGGNTLTLGGTANGTFGGTIGGAGGLAMSGTGTETLTGANTYTGGTTINSGTLAIGGAGSLAANGTVNLAGAGATFDLSGATLPQTTGALSGVAGATVNLGGNSLTLGGTGSGTFDGTIAGAGGSLALSGPGTETLNGANTYTGGTSLTGGGTLVAGNASALGTGALNTSGAGGTLAAGSAGTTLGNAVNLGTGSALTLGGTNDLGLSGIISGGGSLAQSGTGTTALTGANTYTGGTTLNAGGLSVGNNTALGTGALSVTGTSGTLSASTANLLLANAVDLGAGSALNLGGAFDFGLNGIISGAGGLVQSGSGTTTLGGANTYGGGTTLNSGGLSVGSNTALGTGALDVTGNGTLSASVSGTTLGNAITLGGGATLGLNGANDLGLSGTISGSGSLAQTGTGTTTLTGTNTYDGGTTLSGGGLIAGNGSALGTGALNVSGNGGSLGTNVAGTTLGNAVNLGAGATLTVGGANDLGLGGAISGNGGLSVSGPSTTTLTGTNTYTGNTTIGSGSTLAVGAGGSLSAASALDLAGTGAALDISAATTPQTSGMLSGVSGTSVNLGGNTLTLAGSGNGNFAGTIGGAGGLTMSGTGTETLTGTNTYTGATTINSGTLAIGAGGSLSASSPVNLAGAGATFDVSGATTPQTTGTLSGVAGSTVNLGSNNLTLGGSGSGTYDGTIAGAGGSLTLAGPGTETLTGNNTYTGGTNLTGGGTLIAGSSSALGTGALNTSGAGGTLAASTPGTTLGNAVNLGSGSTLTVGGTNDLGLGGAISGAGNLAVSGPATTTLSGTNTYTGSTTIGGGSTLAVGAGGTLSSGSTIDLSGTGATLDLSAATSPQTTGALSGGTGTNVNLGSNTLTLAGADSGTYAGVIGGTGGLTLSGTGTETLTGNNTYTGATTINSGTLAISGNGSLSSSSPVSLTAAGATLDLSGAASPQSTGTISGVAGSTVNLGNNNLTLGGSGDGTYAGNIAGTGGVTMSGTGTETLTGANTYTGATTINSGTLAIGAGGSLSATTPVSLTGAGATFDLSGATTPQTTGTLSGVAGSTVNLGGNNLTLGGTGSGTYDGTIAGAGGSLTLAGTGTETLTGTNTYTGGTNLTGGGTLIASNGSALGTGALNTSGAGGTLGTSVAGTTLTNAINLGSGSTLTVGGANNLGLGGTISGSGNLAVNGPSTTTLTGTDTYTGNTTIGNGSTLAVGAGGALSGGSAVNLAGAGATLDLSAATTPQSTGALSGVAGSSVNLGGNALTLGGSGSGTYDGTIAGTGGSLTLAGTGTETLTGTNTYTGGTNLTGGGTLLAGNSSALGTGAVNTSGAGGTLGTSVAGTTLTNAINLGSGSTLTVGGANNLGLGGTISGSGNLAVNGPSTTTLTGANTYTGNTSIGGGSTLAVGAGGSLSGGSAIDLAGTGATLDVSAATTPQSTGALSGVSGSTVNLGGNTLTLGGSGNGTFGGTVGGTGGLTLSGTGTETLTGNNTYTGATTINSGTLAIGAGGSLSATTPVSLTGAGATFDLSGATTPQTTGTLSGVAGSTVNLGSNNLTLGGTGNGTYGGTIAGTGGSLTLSGTGTETLTGTNTYTGGTNLTGGGTLIAGSSSALGTGALNTSGAGGTLAASTPGTTLGNAVNLGSGSTLTVGGANNLGLSGPISGSGTLALTGPSTTTLSGANSYTGGTLVTGGGTLVAGTPTALGSGTLSVGGSGGTLGTSVAGTTLGNAVNLGTGSTLTVGGANNLGLSGPISGGGNLAVNGPSTTTLSGANTYTGSTTIGAGSTLAVGGNGSLSAGSALTLAGNGATLDVGAATTPQTASALSGTAGSTVNLGGNTLTVAGPAGGVFGGTIAGSGGFAVQGGGTQTLTGANTYTGGTTIGSGSTLALSGAGSLAPTSPVTLAGSGATLNLTGAAAPQSIGALSGTTGSNVNLGSTPLTVNTAGTGTFAGTLSGTAPLTLAGTGAQVLSGTNPLSGPTNVTGGTLAVTGSLANSPVTVGSGATVTGTGTIGGLVVSGGGTASVLQLGQPLKVAGNATFQPGSTLQVGATPQQSGGLDVTGSAALNGGTVQVVAATGQYQPGKLYTIVNAGAGVQGQFSAVNSTYAFLTPTLQYDASRVLLSLAPNGTPFASVASTPDGQAAAGAVGTLGAGNPLFDTVLTADAPTASRAFAQLAGDLYPSTRSVLLSDSRYVRDAVLDRARLGSQPGGALCGCEAPVSADDHAASLDRRLAAENGCTPAKSFKPAVWGRIYGSHSRFDGDDVASIDRNLYGFIVGTDAEVSSHWRVGIAGGASRSLLNTDQNESAKVNGETIALYASGRYDAWNIRGGLAQSWYRVHSERNPSFGSFSDHDTASYDANATQVFTEIGYSTAIRNVALEPFVGLAYASVHTGGFNESGGAAALQGESRTSGLGFSTLGVRASTDLAVTTKGKVSAYGTVGWRHAFGNTQPGSTLSFASGGTPFNVVGVPVARDAAVLEVGVDAAVTKNLSVGLSYSGQVGGHVSDHALYGNLLWKF

SEQ ID NO: 17123 - protein, 686 aa, Xanthomonas campestris
MRPCCHGKRLVMRLRLLKTMWYAPSLALVWGPACHVQAQDAALTLGKVQVREHAQRSPSTARVLSSVDVIGGELLHDQHVDYSWELLMRAPGVQVTQFRMGTDAGRFSFRGFNGEGRINAVKLLIDGIPSNDNAGAMPYLDAVFPQDISAIEIVRGTNDARYGLNAIAGSVDVLTRTGGNDGRLSVTAGSFDAREVQLSKGFEQGAWSQNYMLAWRDSDGYRDHADARKRSVAGKWFYTDPDGAFRAGLTTRYYDNHALEAGYLDAATARAAPRSSPDYAQNDRSQRRLRQTALHADGELGEQAQWSAKAYQNDYRNQRWVRFSAAGLQQERDTDETHRGLLLRSNWQPDWGALNANLEAGVDAQWQENQSQRYRTVARVRGAQLRDWDYDLRTRGAYVQAVLTPFARLQLVPGYRIDRVDGQLHDVLAGSVAPTYDYGTIKQPKFSASYRVGGQSSVYANWGRTFQIGSGDGAYRRQSGDLGPSINDGWETGFKFAPSTLVDGRLAYWEQRASGEVATVLGVNGVVGIGAVANVGRTLRRGWDAQLNLQPAEHWRAWVSYSRQKAMIATPDPSAPATRGKEIENVPHWLATAGLEWQLSSAVQLSAWGNAQGDYYLERTNTLGRAGGDALLNLGARWNVDARNALSLQLRNVTDRAYVYAWYDSGTSGYSPGDGRALSLSWDWSF

SEQ ID NO: 17124 - protein, 428 aa, Xanthomonas campestris
MKTRNAKLALAIAIALSSPKLYAAGFQLSEHSAAGLGRANAGEAAIADGASVVAHNPAAITMFDSYQLSVGAAYIMPEVRVTGNGPSESFNNQLTNNDVVDNVVVPSFYIAAPINDSWSWGLGIFTDFGLATEYPDDYLAGPIGGETSLETINFNPTIAYRINEEFSVGAGASIVYGKAKLTRTLGILADAINADTGANFARTDVAKSLDGDGWGYGFNLGALWEVNEKHRFGLSYRSKVDVDFEGDYYSDIPSAISMPGQTVTGDLTLNLPSITEFSGFHQITDPLAIHYSVMMTGWDVFEEIRATVDGQEVLQKDENFENAFKYAFGATYQLNPSFTLRAGIAYDETPNVNDKSISLPDSDRINYSFGATYAFNQNSRIDFGFTFIDAEEVTFTEPLEPHALPGVDIAYRSEGDAYIYGIQYNHSF

SEQ ID NO: 17125 - protein, 605 aa, Xanthomonas campestris
MAPACTTTHRQRAPLFAVLLLSLLPLFSPQADAAQVPWHSRTFKYVADNKDLKEVLRDLSASQSIATWISPEVTGTLSGKFETSPQKFLDDLAATYGFVWYYDGAMLRIWGANESKSATLSLGTASTKSLRDALARMRLDDSRFPVRYDEAAHVAVVSGPPGYVDTVSAIAKQVEQGARQRDATEVQVFQLHYAQAADHTTRIGGQDVQIPGMASLLRSIYGARGASVAPIAAFGANFGRVQPIGGGSSNTFGNAAQGQGGGASGTLGLPSAWFGGASPSDRMPVSPPLPGSGAAAGSPASVWPELSKGRRDESNPIDAGGGAELASDAPVIEADPRTNAILIRDRPERMQSYGTLIQQLDNRPKLLQIDATIIEIRDGAMQDLGVDWRFHSQHTDIQTGDGRGGQLGFNGVLSGAATDGATTPVGGTLTAVLGDAGRYLMTRVSALETTNKAKIVSSPQVATLDNVEAVMDHKQQAFVRVSGYASADLYNLSAGVSLRVLPSVVPGSPNGQMRLDVRIEDGQLGSNTVDGIPVITSSEIKTQAFVNEGQSLLIAGYAYDADETDLNAVPGLSKIPLLGNLFKHRQKSGSRMQRLFLLTPHVVSP

SEQ ID NO: 17126 - protein, 811 aa, Xanthomonas campestris
MTRPTLSMIGLAVAAALSAQAQAQQADTASNTLDTVIVTGTRASGRTVLESTVPVDVLTAEDIRKAGVVNGELGSALQALLPSFNFPHQSNSGGGDHIRAAQLRGLSPDQVLVLVNGKRRHTSSLVNIDSKIGKGTTPVDFNSIPINAIKRIEVLRDGAGAQYGSDAVAGVINVILDDNPESGELEASFGAYNTDVAPINRRITDGQTSYASAKVGTLLGDDGGFFKVGLELKNREATNRAGFDQIPPFEEQTPANLALKGQRNYVLGDGATKGLNAWLNTKIPFSASGEFYAFGTYDQRDSEGANYFRYPDSSANWREIYPNGYRPISEGENRDLQIVAGARGQWGNWDYDASLNYGRNDFTYRLRNSLNASLGPGSTTRFKTGDFAFAQTVGNFDLTRVFDAVGATHTFGTGAEFRREQYRTHAGDPASYAAGPFTDRPTGSQAGGGLTPQDEADLSRNVASAYANVSSQFGDKFSTDLAGRYEHYQDFGSQWTGKLAARYAFAPAFALRGAISNNVRAPSLSQIGYEATSTGYDADGRLTQGRLLSVNNPIARGLGATDLTPEKSVNYSLGFTSKLGDHFDLSLDFFQIDIDDRIALSENITGDALTNFVQQNFGVTGVQSASYFLNAANTRTRGAELVANWRQHTFGGDLLLTGTYSYAKTELKDIIATPSQLLALDPEYVLFGVEESNTLTGAAPRTRAALAANWSNQHWNLQTRVNRYGSATRVFDFGGGFAPHQTYGAEWQLDLEAEYHLDTQWTLAIGGQNILDNYPDRSIDDIAYFGNLPYDVLSPIGSNGAYWYGRVRYSF

SEQ ID NO: 17127 - protein, 625 aa, Xanthomonas campestris
MSLSSVLPRRAVLAVGVSLCVTNLAQAEAATDLDQIVVTASRTAQTQDQTLAPVTVIDRAQIERRQVNSLQDLLRGEAGVSLANNGGPGKATSLFLRGTEADQVVVLIDGVRIGSATAGGAALQDLPIEQIERIEIVRGPFSSLYGSEALGGVIQIFTRRPQGSFVPTLSVAAGSDNARRYGAGVAGRSAGDLSESGGWYSVNAVHDETDGINAYLDTSSSAYDPDRDGYRNDSSSAQGGWRFNRQWDADVHALRAQSRNEYDGSAFGGNLSKGVQQAIGGRLRYAPSDALKLTASVGSSADLSDAYYEGAYLSTYDTRRKQGALQADLDTGPGLLTVGFDWQRDAIASSDTYDANSRIDRAAFAQWQQTLGSQSLQASLRRNDNSQFGGKTTGSLLWGWDFAEHLRVTASYGTAFKAPTFNELYYPDYGNPLLGPETSRSAELGLRGRYDWGTWTLSAFQTRIDDLIAYDASLVDASHPFGQPNNIDRARIRGVEAGHDTALAGWTLRTAVTWLAPQADGDVNHGNWLPRRARQSGRIDADRSIGAFGVGASLFGSGARYDDLANTQRLAGEGVLDLRASYAVNADWKVQLTANNVFDRQYETARWYAQPGRNYLLTLRYEPAQ

SEQ ID NO: 17128 - protein, 715 aa, Xanthomonas campestris
MSTFPYRLTALTLACFTASFAHADEEQSHVLETVKVQSSADASKEGLSEAYAGGQVAEGGSLGILGKQDSLETPYNFTNYTELLIEDQQAESVGDVLLNDPAVRVARGFGNFQQVYLVRGLPVYSDDMSYNGLYGLLPRQYLSSEFIQRVQVFRGANAFLNGAAPGGSGLGGAINVLPKRAPNYAVNQFTLGVESGGQGYGAVDLARRSDDGRAGIRINAARRDGDTAVDGENQKISMSHIGVDFREENLRLSADLGFQKFSMDASMPSITFASGVPIQKTPDADKSIAQPWTYSNSEDLFGTLRAEYDFADNVTAWLAAGARQGDEDAIFANPTVNNTAGDYTASRFENVREDTVITGEAGVRWELATGEVGHTLSLSTASYELDSKNAFIFGGGITGNIYNPQTAPMPALGFAGGDLNDPKTTIKTQMRSVALADQLAMLDDKLLVTLGARYQEIEDTSYDYNTGDRGNKYEDNDVTPSVGVLYRLTDSVSLYTNYIEGLVAGGNAPANNNSQPVANAGETIAPFTTEQTELGMKFDAGNLGGSVSLFQSKKPITGFDGNNKFEIVDDQTNNGLELMAYGKPLDSLTVLGGVSLLDTDVDGEDAIGSPDTQANLNVDWAVPGTEGLSLDGRVIYTSSQYTNAANTQKIPDWTRLDLGARYLIPVGDAKMLTLRARVENVADADYWASAGGFPGSSYLTVGAPRTVMLSGTYEF

SEQ ID NO: 17129 - protein, 419 aa, Xanthomonas campestris
MHNQRYKTSLNGISARTSKRFFGRRRLTPVAGAIATACVAGLGTGAAHAQSSVVLYGLIDTSITYASNQRTHGAGSPGSGGLAVTSGALNASRWGLRGREELGGGRSAIFALENGFSASNGALSQKGVAMFGRQAWLGLKSKEGGALTFGRQYDLILDFVTPLGASGPGWGGNLAVHPYDNDDSNRNIRINHAVKYKSPTYRGWTFGAMYGFSNTAGQFGNNAAWSAGLSYANGPLKLGAGYLGINRNPNAANANGAVSTADGSATITGGSQQIWAIAGRYAFGPHSAGAAWSHSATDRVSGVLQGGGIVKLDGNALVFDNFSVDGHYVVTPRLSLSAAYTYTMGRFDSRSGETRPKWNHVVAQADYAFSKRTDAYLEGVYQHVSGGNGNPAFNATIWTLTPSASGNQVVVALGLRHRF

SEQ ID NO: 17130 - protein, 1004 aa, Xanthomonas campestris
MHPFPALPAHRKAILGSALLAALLGMAAAPAARASAFHVNGDTLYYTGNVLATDPGTLEAYVLAAKARGTPLRQVVFRNSPGGAASGGVGMGAIIRQHGLDTVLDGGCYSACADAFVAGVNRKVTQFGLLPAHGNYTQTVLGIHGESGPNGPTPYPGQDKYIKYYRDMFGPTDFAVIEARIIQAHYELTQQSGFLRYFDPTTVAVATRFCPTRDQSAAGNCTEYPGVTMYSDRVVTEAGYVMPGDVLSVEKEVSGDLNPHLAVRGRYTNAVANLRYFQQSASDIRLDDAFGVIRIGKGGVWSLDTPSAAQYVVVDGGTLRLQQNGWIHHAEAIGARNGGRIELQGGALRNLTLVERGGVLAGHGSLNATIDINEGGTLAPSGIVMRPYSLEALAPGGDDVFTSERFRIGKGRYINLNDGANLAFQVDSQRTAPSLTLEEARYFLVEEDRRSSDYNLIGNINRAVLGIAPTARLTLDVKQAFFPAGQENHLVGTQVDSAALQLPVAPCSPSNGEYAGLWCRTATPATLTRPAPVSDFIEGRFQYVERSGEAGSAVDLTAPGAVFRPRHNSLLSFTVNQTGSGLWLTANPSFDDTGLFANARSGDGLGVALQQAAAQRTASMSSLLGALQFADRDVIARQAGALRGDAHASLRLADNALVGSIGNVVQQHQAASRSGGDADGLAAQAAQAASVQSAMTGNRLFNQLAMHLVAPSDAGNDTDDTGRNRGLWARGFASHGRIEGDGGVAGLSHTIGGIALGADTRLADDRVTLGVSLAAADMSTKSSGGAGFTGDVRALDIGGYVDALYSRGYLSAAVRYTDLRHDTRRSIDGIDGLQAPLRAKYNNDAITARVEHAFSFTTGKGLVIQPLLPVIDYTRTSATRFNEGQDAAALVGRSGSLESIRVGAGLQLFKTFEGNSGERITPRARVVWQKELGDTQARYSTSFAAAPDLLFGSSSQVVGEQVLAWNLGVTSRASERLSIMVDYVGERRDGQSQNGVQLGLGYRF

SEQ ID NO: 17131 - protein, 720 aa, Xanthomonas campestris
MNAPLFRLSLLSLTLAAGFAHAAENNAKVVLDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTTFGDDDHRIVLSHMKDQHRGIRTVREEFTVGDKSSRINIDRQAPAYRETTQSNTNLAYTGKNLGFVEKLDANAYVLEKERYSADDSGTGYAGNIKGPNHTRITTRGMNFNFDSRLAEQTLLKYGINYRHQEIKPQAFLNSKFSIPTTEEKNGQKVDKPMEQQMKDRADEDTVHAYKLSNPTKTDTGVYVEAIHDIGDFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFQNPNLEIGWRGRYVQKATGSILAAGQKDRKGNLENVVRKGFGVNDVFANWKPLGKDTLNVNLSVNNVFNTFYYPHSQRWTNTLPGTGRDVRLGVNYKF

SEQ ID NO: 17132 - protein, 717 aa, Xanthomonas campestris
MITQNPKLNGLTLAVFAALCPPVFAQTTELPSVQVNASADASAEGLAPEYAGSQVASGGRVGLLGTQSNMDTPFNLTSYTSKLIQDQQAASVGEVLLNDPAVRVARGFGNFQQVYLVRGLPIFSDDMSYNGLYGLLPRQYIASELVERVEVLRGANAFLNGAAPGGSGLGGAINVVPKRAPNYDINQVTTGVQDGGETYVAGDFARRFNDGSTGVRATFAQRDGDTNVDGESRELTLFAIGADFRSDRMRISADLGYQDHKLQASQPNITIGAGLPIPATPRADRSIAQPWTFSNAEDTFGTVRAEYDFNEVVTGWLAGGVRESNEAGNFSNPTVTDEQGNTNSLRFANVREDSVQTAEAGLRFKFHTAGVKHTVNTTASVFELESKNAFDFSSFAGFSNNIYNPTPVAEPALGAFPSGNFNSPLLTEKTETSSLAIADTMAFLNEQLLLTLGARHQQIEATSFDGNTGAQTASYSESATTPVAGVVFKLSPQYSVYANYIEGLVKGDTAPATANGQAVTNAGTVFKPYITEQIELGVKYDGGSVGGSVSVFQSEKPNYGIDSSNTFSQVGDQTNEGLEIMAFGKASKTVTVLGGLSILNTDADGRDAIGAPSAQANIGLEWSPEQVQGLAFETRAIYTSSQYANAANTQELPSWTRLDLGVRYVMPVGNDQALTLRARLDNVTDRNYWASAGGFPGSGYLTIGNPRTLTVSASLDF

SEQ ID NO: 17133 - protein, 792 aa, Xanthomonas campestris
MKYSILYSTVIAALSLSTAQAATITGKVVDKNNHPINAASIHIHGKDKAVYSNENGEFTIVIDNDGQLHISKDDYIDERVTVTATQTAVDVTLAKSSIETVTVFASGLHKTNMDMASPVTVLAGDELKNNAQATLGETLKGLPGVNATYFGPVSSSPIIRGLDGPRVKVLQNGLDSSDASRIGADHATTNESLTAQQIEVLRGPATLLYGSGAIGGVVNVVDQRIPTDQLNQLEGAVEIKYDSVSNGKTAAFNLAGGDQGFNLNINGLKRQSDDYKIPEMHLDDHDEHADDADHTHETTKKIDNTFIDSTVIDIGASYVSEHLTLGLSYGNVNTEYGIPGHDHEHDHEHEDGHEHQVAIAETVDEHSVYALLEQDRWQALAVWTPHNNIVEKVEARIGYTQYQHAEIEDGQIGTTFKNDSQEARFSVEHTLGQWHGVVGYHYYFSDYQALGEEAFTPSTETRQHGLFLLEERNFDGITLELGARVEKYELDSSDIDTGHSHHDVDHHEASSYLESFNNISLSTGLVWNIGSGYSTSINVTHSERAPSAAELLSNGLHISTGTYDLGLGYVIEDGEVHFEPENIKQETANNLDISFRKYSDNLGFTVNFYYNRVNNFYFQQATDYVFDQHDHELIHVAMADEDSAPVYQFTSQDATLYGVEFDLHYSLTDELSVKLFGDNSRITLEDDNYLPRVPANKLGGTINWQIADFDISATATHYFAQNKIAFNETSTAGYTLLDAAVSYQFNLASVDSSVYLKANNLTNELAFVHSSFIKEIAPLPGRNIAIGIRAFF

SEQ ID NO: 17134 - protein, 887 aa, Xanthomonas campestris
MHSRTTTLALCITAALYCSGSAMAAGQEQQAPAGTQSSTTELDTITVTGYRASLEKSQAVKRSANSIVDAISAEDIGKFPDTNAAESLAHLPGISVDRQFGEGEKVSINGTDPALNRVLLNGQTIASGDWGGNPTDTSGRTFNYTLLSPEIIGLMEVYKTPEARIDEGSIGGTVIVHTRKPLDLPKNTIRGSVGYNYNDRSEEGNPRGSALWSWKNDDETFGALISATHDKQDLARAGIEFFGYNTGAGIPATANISGDGGSVATAKIPVGINSAFFQQTRERNGLQGALQWKPNEQNEFNLTGIYIKGKYNNFSESRYVCPGCGDQDKITSATVQNGYITQATVTDGAGNGNQPYAQLDTNYRESTVTTKSLNLRHDFYGENWVFTTQVGDTKATGGKNPEYLMKFLLQDGGYDFAYDGSHTDVNYQNGAASNWGLPGSPAGLPAGSTATGAMQAGGIYYAKSEDQEKYFQWDAARDLSWGPFNKLQFGYKYINHDNGVDARGNRINTTDAVSLTQFSPGTTPSGLYDGLGASGDLTNWSTANLRSVINYLRSQPQGPYSIDYGSSFDVKEITHNFYTQLNFESGKWRGNLGVRLVDTKDKSLYWQNSGGNNYSRVAQNTDYFKPLPSFNIAYDMTDDSVLRFSAAKVIARPRYGDLAGAFTFNSTNSQNLTASGGNPNLKPYESTNYDLAAEWYFAPSSMLSGEVFYRDIGSYIVTDTSEQQLTDPVSGVTGLYTVSSPINVSNAKVKGASINYQQAFGYGFGLQTNYTYAEADASEGLNLPYLSRNTYNIIPYWEQGPWTVRVNYSYRSKYFTQIGRLDSKVFTDEYKQLDLTASYQINDWMGISFSATNLLDSTYYWYNEVKYAPIGMYKNGRGYQAQLNFKF

SEQ ID NO: 17135 - protein, 275 aa, Xanthomonas campestris
MNCKRIFIKSALISLISFLPGISFSDPIQDSNVSGNFYISGKYMPSASHFGVFSAKEEKNATAKTFGLKQDWDGAAISNTSTDVFTISNYSFKYENNPFLGFAGAIGYSMGGPRIEFEVSYETFDVKNQGNNYKNDAHRYYALSQDTTIAQNKFVVLKNEGLADISFMLNACYDVTTEGIPFSPYICAGIGTDLVSMFEATSPKISYQGKLGLSYSISPETSVFVGGHFHKVVGNEFKDVPAIVPSGSTLAGNHFAIVTLNVCHFGIELGGRFAF

SEQ ID NO: 17136 - protein, 708 aa, Xanthomonas campestris
MRRTLLSICVLQTLSPLAWAEPSDSTVSALELEATDVVGTADYERADGPVQGYRATRSASATRTDTSIHETPQSISVVTKDAVEDIGATRLQDALDYAGGVGRANNFGGQGLTTFTVRGFTTGEFYRNGFPINRGYPNMPDANTIERLEVLRGPATMLYGRGDPGGTFNVVSKQPLPERTVTLGSQLNDQGMRRGTLDASGPLDEEGRLAYRLNVVGEGGDTFRDHVETERYGVTPVLTWQASDDTRVIFEGDFMRNNHPLDRGATRYPRQIGTASRDTFFGEPDAGKLHNDNNMAQLRFEHVLNEDWTLGGGFQWLDGTLQGNAIEANGIAADGRTLGRNFNYRKLEWTDKDTQLNLTGHFSTGGLQHTLLTGIEYEDYDYQSIIQRSSGAVSAYPIDIFNPVYGQPRPALTRTPTHDKENLKTYAAFVQDQVALTDRLKVLAGARFERFEHDYETYVPGGKNWQASDNAVTPRVGVTYDLTDTLAIYADTARSFKPNTGASRQGGGFEPEKGKSWEMGVKWEALDHQLSVDAAIYQIEKRNVLTTDPVDSTFSVAAGEVRSRGFDLNVAGNLTPEWRVIGGYAYVDAEVTKDNVIRSGTRLMNIPKNSFSLLNVYEFQDGALSGLGLGTGVKYVDERAGQTANTAFSMGSYTVVDLLSYYKVNDKLRLNLDLKNLFDRDYDEGAFGNVYAYPGAPRTVQVGISYTL

SEQ ID NO: 17137 - protein, 466 aa, Xanthomonas campestris
MTPSALKKTVLLLGTAFAAASVHASGYHFGTQSVNAQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAELVFEKEKTVVKGKSDRTTITPNWRNTYKVGFGGSYQISEPLQLRAGIAFDKSPVRNADYRMNSLPDGNRIWFSAGMKYHIGKNHVVDAAYTHIHINDTSYRTAKASGNDVDSKGASSARFKNHADIIGLQYTYKFK

SEQ ID NO: 17138 - protein, 793 aa, Xanthomonas campestris
MRFSSPRYTLSLAVAAALLAPDGRTQTAPPASGNQEATTLDAVIVSGTARFKGLAKRDASFSITTASPEQIQQAVPQSTADLLKIVPGVWAEPSGGGTGANIFVRGMPSEGDAPFVTMQLDGSPLFPPPTLSFLENSTLFRVDDTVERMEVLRGGSSPIFSNGQPGLTVNFIQKKGQDEPEGSVRLTGGNNALRRIDVFNSGPMGNGWYYSVGGFFRETDGVRDPQFSADKGGQFSATLSKRWDSGELSLYARHTDDNNAFYTAIPLLSRNNGNDLSSFPGLNAQTGTLLGRDFRNVDLLVGPNGQTLRRDLADGRGVNIDVFGGEWNWESGGWTVADRFNVISGSAPTYALFTGDAPQRLGDVIAGYGSGGSASYTNGGGAVDPNQQVLEAGWWSVDKRLNSFTNDLRLSRELFAGNTLTVGAYYAKYSSADTWYLGNTMLLTAQNNARRIDVALDDGRQATRQGFTSTAFLNLRAKYDGENIAAFVADEWELSERLRLDLGARYERQSVTGDVHDTTTVDLDGNPATLYDNATSLALATTRRIDQDDEAFSWTAGLNFTLDQNNSLFARVNSGVKFPGFDNLRDGQDRVQDVDQYELGLKSGTSAYDLYLTAFYNTFKNSPFQAFLANGENFTAVGDSRARGLEVEGAIRPFGGFELAGTGVWLDAKYRNYREFTGNQVMRQPKRQFRITPSYYWMLPFGDLKVFATYSYIGERFADLANSQRLPSYDMLDVGANLHVGEHWEVTASGSNVTDTLGLTEGNVRVPGAATGGVFMGRPIAGRQYQMSVAYRW

SEQ ID NO: 17139 - protein, 773 aa, Xanthomonas campestris
MPSENDFSIPSPSGASLRSSRDGSGQKWSALVMLALGAGLGVAEAGDAEAQDGTDTGTTATDSTINLSAVRVHGQVDADSSNTNNTSLDIGRMPGTVRDTPQTISVVPKELIIQQRLFTLDQALANVPGITMSTGEGNGGLNGDQFRIRGQQARGDIYEDGLRDFGTYVRDTFNTESVEVIKGPSGEYFGAGNVGGVINQTLKKAHLGNHYDLDQTFASGMQYRGTADVNYQLGKHTALRVNGMYNKQDVADRDNIRTDRYGVAADLGFGLGTKTTYHLNYQWLGSRGTPDYGVPMIQIGGIYSPITSHGLNRDTSYARSFNMDNSNIHMVTSKFSSEIARWLTFNNDTRFTHYHRDYSATTPNACTGTCVTSFLSGGNPTLPYGADGGVAYQQDGWGIQNVMMARAKFNTGFLHHDVRAGVDINYTKDDRIMGTYVNRVNDQTIRNPSYSSPGTYITWPSSGHRTADFRDLGLFLADKIHITKRLSLFGTFRWDSFESTYWSAAAASSGVQSQSSNKFSPSASLMYDLDDNKTVYFTFSRSYKPVGTDASSEITNQASVGDVPVNGKNLKPQRSDLFEVGTKMDFLNKHLGMTAALYQIEQNNSYTYDESGNIITGFQDAGTGREIRGAELSLTGKITKEWEIYAAYSYMGGKVTNSTTTDGKQAPQLPHNNFSVWTSYDLSPVLLKPGQGKLSVGGGAQYRSGYWANEANTARMPYNFSLNTMISYQYGRYHVQFNANNLSDHLNYASAFSTGRAVPQSGRTFMGNFGIGF

SEQ ID NO: 17140 - protein, 494 aa, Xanthomonas campestris
MISQGKFEVLTYRKDSYRFGININLCLLKGLLVTLFVLWTFLSAHAEAPVSDTPILLAVAPVSDQPEIDAPNADEGETEQWSIHGQSTYIVQQKNNFNSPYYGQNSLLNKSEGGGGKSYTFSATAFLGARLWEGAEVYWNPEMFEGTPFNGQLVGLGGFQNGELQKGSYAPPIYYTARAFIRQTFGLGGGKEHIEGAPNQLAGNVDKNRLVVSYGKFATLDFFDQNSYSHDPRTQFQNFAIFSMGAYSYAADSKGYTYGVVAEWYQEDWILKMARLAMPTIPNTAQLDYSLTQDYGNQIELTHEHELWGKAGAVRALYYQQHAFMGNYQSAVDIAQQTNSTPDITNTRLAAQSSWGYGLNFEQSISEDIGVFGRWSWNPGNSETQTVDISRSLSGGVSIKGASWSRPNDCVGLGFAVNGIAPIQRTYLQLGGMSPFIGDGNLSYKTEQILETFYSAKVYKELYISADYQRIANPAYNSARGPVNFFGLRAHIEM

SEQ ID NO: 17141 - protein, 996 aa, Xanthomonas campestris
MSSRTSQRIRRHRLSTALFGVLAASAGTAAAQSDNGVAPDTTDLDKVTVTGSRIARTGFVTPSPVTAISAEEIRATGATTISDLMARMPALAPSYTLGNSTRFIGTAGLGLLDLRGMGVDRTLVLVNGRRHVGSSPGSTAVDVNTIPVEWVERVEVITGGASAVYGADAVAGVVNFILKKSFTGFETRAQTGLADEGNYNRSFASFSAGTDFAGGRGNIAVSGEYSKQDRFGRGNRAIGREYLVSVPNPAFDPTLPPSERNPQNVLSGPGGNHSTSYGGTFNLGTFDFRNPASYGNRYLFNDDGSFRRNRYNGTVVSNTSCVDCDFVDLNAVADLQPGFDRKSVNTMINFEISENHRVFFEGKYSETDSEFFGQPAFDSSLRVRRQNPYVSPELGALMDSRGATQILMNRFNVDAGRRGENIERKTYRAVLGAEGNVTDNWTYDVSANYGKTTVDRLNLNNRINERWQAGIDAARDASGDIVCRTTLDPTAVNPHTGRVYSALAREGCVPFSVFGNGAVTPEAAAWFNTTARSQAKIQQTVFSASVANSNLLSLPAGDIGFAGGVEYRKEQSEEVTDPLAASGATFLNAIPNSGGDYSVKEVFVESTIPLLAGLPGVDRLALDVAGRYSDYSSIGSTKTWNIGLDWTIIPSLRLRGTLAQAVRAPSIGELYDSQSENFATINDPCNYLPTNTNRPGTAGDVGLRQANCSALGIPVGWIDTYTATRPGVSGGNPELKPERARSLSYGLVWQPEFFEGFGMSIDYWRIDLRDAIGAVTAETNATRCVDNPGGIGNSFCGFVQRAPLGGFTDPQGRIYPEHSIIGWQALNENLARSRRVGVDLEMDYRFQLGQGNTVLRFVGTRLIQSREWVFQDFPQEYDEYVTYVTDPRWRAQFQTKYNWNAWRASWDMNYVDGNLRVTPESYNSNPGSASPIKNGSYVYHNFQFGYQFPGSKIDVYLGIDNALDKDPPRNYFGSDFTSALYDNVGRFFYLGTTVRF

SEQ ID NO: 17142 - protein, 1085 aa, Xanthomonas campestris
MTHPRCLRMSKLTLGLVAALAAAPVFAQSTSAGVAGLVTSSGGQPVPNAEVTITHVESGTVSRATTDASGRYNARGLRVGGPYTITITKSGEGTKTEEGVFLNLNQVNSVDAALGGDVTTLGAVQAIGGDYGSALFSANKMGTGTNVTREQIESLPSINRNLQDYVRLDPRVAQTDKARNEISVGGQNPRFNLIRVDGISTNDAFGLESNGLPTPRQPFSMDVIDEISVDVANYDVTITGATGGVINAVTKSGTNEFHGSVYGTYRENDWSGKNQNDIRPQLFDDETTYGLTLGGPIIKDKLFFFANYEKYKGKGVFTGASGYGPIGSGESNIVGITQAQVDQVIDISRNVYGFDPGTLTLPALDSDSEEKGFKLDWNISDKHRASFRYGESEQSTANLNGFGNQALSLNSFHYVRDFSLKTYTAQLFSDWTDTFSTEAKVSYRDYSAVRTAASQLPAIGVRFGNNTVNLGTEQSTQANELRTETWNAFFAGTLFLDDHTVKFGFDYEDNDIFNLFGQRVFGSYTFDSVADYAANRASNYRYSRSNSGNIDDIAAQWGMRNVGVFIQDTWAVSNNLTLTFGLRYDEPMVKQSPAFNAAASAAFGRRNDQTIDGNGLFEPRFGFNYTFDSDRPTQLRGGVGLFQGAAATVWLSNPYSNTGLAFTDFNFPSQAAVSSGGILFNPDVNAQPTGNGSVGGSTQSVDFVDSKLGQPSIWKANLAFDTELPWYGIVASAEAVVTKVNEAIYYQQLNLGGVTRAGQDGRDLFWNAAGLDSRCWNAAGTNVNGRAAPDACVRTSVATRPSLVDARSGRNAGYNDAFIARSTDKGGSESFTVGLNKPFNGGDWSWGLWYTYTDADEVSGLTSSVSGSNYANNAVFQANENVASTAAYEIKNSILGTLNWKHAFFGDYETKLGLIYQGRNGRPYSYAFDNDANGDGRLNDLLYIPAGRGDVLFGSAGEEQAFWNYIEGNEYLAARRGQVAERNGARNSWINQFDLHIEQEIPGFFKGNKASVWLDVMNVGNLLNKKWGQVEEYGFPGMRGVVEYGGIDAASGKYVYRFNTPDQATVYDDRGISRWALQLGFRYQF

SEQ ID NO: 17143 - protein, 1268 aa, Xanthomonas campestris
MLKHFRLGLFTANVQADTGSQHSFSRVPAAAINPITLAIVVAFSTIALPPMALAACTSPGVGTYVCEGENTDGIILSGTDIAVETQPGFSIIVPENGDPALSLVGSGTISYLDTNSSALDTTGADSLYIQNDTHTTGQSSSINVQTNGSMGSGINISNHSGADSTVQVDVSGTLFGDLNGSPALLIYSSAENNSTILMNINTIFGDVGIRSDNTSFNGTAITNVDIANDINATYSGATINNSGSGGTSVVNFNSKSIITELDALNIYNTNYSGAVITNVDIDGDVISTTSQATSFYNDAYNGSANFTFRANNVTGEYSGISINNSSHNSANNNHDNAVITDILLTGDLTSTSGSGLQINSYMDDGDIKVSAQLENIYSYYEALSVRADTLTGNLQFNIDVSGNIVAENGLGFMVMGGASEGNSTMIINANNISSGSQALNIYNYSGLGSAFTAVTATGHLVSEQGIGAMFSTYVSQGDATAVINLNDITTAGSGVKIDTIANGGNSTTYLTVVGQINSSLYDGIDLRATATEGNTLVSIDVNNIASEYDAIHLDNKNYTTGADNGTSTIDLITRGALVSQQGYGINIETNTADTYVTVGGLVHGGNGTAIGIHRLDNIQTSATLELQSGYALEGVTQALVFNGSYAEINDAALDLANSHLVLGGAGDAAFDLTRIDNREEAILDGDPNRITGFGTLTKTNNSIWTLTGANMADGDANAFLSANIAGGILVLDNATLGLTPDAGALTGATVNRLSAADIAADPTLVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVGGAYAYTLQADGEAATAGRNWYLSSELMLTEGVRYQAGVPLYEQYPQVLAALNTLPTLQQRVGNRYGAPGALADLDFDNNQWAWGRIEGSHQVTDPARSTSGSQREIDVWKLQTGIDVPLYQSQDGSLLTGGVNFSYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRLGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGARVSW

SEQ ID NO: 17144 - protein, 706 aa, Xanthomonas campestris
MSSSKVLRLSKLSLITSLILSAHAFAKNDKSEQQIEKIAVYGQHHKNYITEEAQSATKLGLTIKETPQSISVVSRALMDDFSLDDINAVLESTPGVTVEQIETDRTYFKARGFDITNFQVNGLGIPQSSGSIQGSLDTSIYDRVEIVRGANGLMTGTGNPSATVNMVLKKPTYTTQANASVSYGSWNKKRLDLDVSTPINEEHAVRAVFTKQKADSYLDRYETDKTVIYLAYEGKLTDNTLLSVNYVNQQKDADSPLWGALPLYYTDGTPTDYDESTSTAADWSYWDNSAEQVYVTLEQNLSATWVAKARYAHVENEQDSELFYVYGTPDKDTELGLTGYASRYDYSDKHDLFDLYASGKFDLFGQEHDLSLGVSQAKMDYTEQSLYDYTTGNGFPAMPSLKTWDGVIPQATLTDSVNGSNITNEQKSAYITTRIKLSEPLSLLAGVRYTDWKTTGTAYGVAQTQSDSQLIPYIGTVYDFNESLSAYASYTETFVPQKELDINANQLAPITGKSSELGVKAQLLDEQVFVTLAYFDTKQDGLAIAVPNSLPDDTRYYAADGINSNGFEVELSGKFTDDLSASISFSNLSIDGDDTVKDYTPENQLKVAAIYQVPFIDGLSFGANYRWQDSTSRVQVRDANKIASVITKQNAYGLLDLMATYKLSENIGVTFNINNTTGEKYLHSLYWAQGYYGAPRNYALSVNWQL

SEQ ID NO: 17145 - protein, 964 aa, Xanthomonas campestris
MPMLPLPLSRTISATTRPLPSMLTTALLLVLSAGAVAPVSAQQAAGGDATQTLDSVVVTGSRLRRVDTETANPVVTVSQEQIAATGKATVGDLLQELPSIAGNATNPYTNNGGGTGASAISLRGLGDKRTLVLVNGIRLAYNDVNAIPSSMIERIEVLSDGASAVYGSDAIGGVVNFILRSRFDGVQFSSDFGTSSEGDGNRRNFTLTAGKTWERGSLIGGLSYHNIDAVSAAARDYSKDALALTNGQPVKQGSSATPTGSVNFNDGSDQSQLLAQSNGCGRVTLNSGVSGRAGPGDFHCYNASADSYNYQPFNLLQTPQKRTNAFLLGTYRFSDSVEGYVNTWFSKTESASIIAPIPIFSNGDNILVSAQSYYNPFGVNFGTDRSTGTSYNDLNTRATVLGNRRYQYNTYNFQISPGLRGRFGDSSWQWDATFNYGKVKQKSINNGFLDYAAFNQAIGPSFLDSDGTVKCGSAGAAIAGCTPLNFFNLNDSSNLATLQGMVVNPIVTSVYTVKQFEANANGTLFALPAGEASLAAGMSYRKERSTTASDPLWTGDENGLCGVIEFCSSSLSGSFDVKEAYAEALFPLLKDLPGINALNITIGTRFSDYSSVGSKTNSKLSLEYRPIENLLLRGTVSQVFRAPIINELYAGVAGDAATVNDPCNGYTGGNTVACANVPTDGSYQQSDGQVSGKVSGAAVAGYQLKPETGKSYDVGFVYDPQWIDGLSLSADWWRIDLEDTITTVSAQTVLNQCFANSASAFCALIHRNGNGTINYIAEPTVNLGKLWAKGMDFNLTYRLPAMAWGNVTAGLNGTYLTRYDVLPDTTDPSSVTIHNVGRYTQAYGNFPRWRALGTVNWALDDWSATWRIRYVGHTAIGNSDPDQSLSADASEPTVVRNIGAYVYNNLQLGYNVEPWHTRFEVGVDNIANKQPPLYYSNNVGNANTDVATYDLLGRFYWARATVKF

SEQ ID NO: 17146 - protein, 616 aa, Xanthomonas campestris
MLNKTALGVAISAVLSISVSAAEQTIEKITVTANKFEQPINDVLASVAVIERADIEKANYRDLPAILNTIAGIDIVRNGGLGQKADIFVRGASAKYTLVLVDGVRVSDASSGSVSLTNIPVNSIERVEIIKGARAAIYGSDAVAGVINIITRKASNNSLSATLGSHSYSNYQLAGGLVKEALSFNYNLGYEETDGFDVTGKDPAAEYTKDHDDDGYKNKNIGFNLAYELAELGQLSLQSQYSEGEAQYDNAWGNDAYDFENYTAKLGWNKASDVYSQSTSVSVSQEENTQTGTDVQQVYSTERIEFEYRGLYTLTEELELSGGFNYLSEDLSNSSATSSEEKRDNKALFIGAFYSHNKWLANAVVRTDDYDFHGRANTYSTGLGYKANNYVTLRLNHGTAFRAPSLINAFVTNSPYYLPNNNIKPEEALNNELGITLETQWGRYDIAIFDNRINNLISNNYDADSGKYIATNIDKVSMQGFELSAEFSALGFEHSVNFSFLDATDEKTNTDLPRRPSESFNYQLAKTWGDFDASLDMQYRSSRPSIAYYDSELAGYTVFNLAANYQLLDNLSLAARIENITDKEYFTAATGFAASGKLLGYNSAGRTFFVGANYQF

SEQ ID NO: 17147 - protein, 422 aa, Xanthomonas campestris
MTAIVIFIKRPVDTVRFRSPSKRLKERRGTANILTARRFVLNKKLLTTAILAATASAAHAQSSVTLYGLIDAGVSYVNHSKSASGSDKLFKYDDGIAQGSRWGLRGAEDLGGGLKAIFVLENGFNSGNGTIGQGGAIFGRQAYVGLSHKDAGTLTFGRQYSFSTDILGSNYSTGGNTVAGNYAYHVNDIDQLTSSRINNAVKFQSANYAGFTFGALYGFSNSTSFAGAPATTNGTTTTPGSSRAYSFGLNYANGPIGLGAAYTDIRYPGQAAPAFTTNIANLTISNVRDLRSFGVGGRYIWGPATLWALWTNTRLEPITGGSTTYNAYEAGGKYAFTPALSAGVGYTYSRVSGANSGHWNQVNGALDYALSKRTDVYLLAIYQEASGNNLQAQIGSSTSYFNTSGTGSKNQFAARVGIRHKF

SEQ ID NO: 17148 - protein, 992 aa, Xanthomonas campestris
MRHHHPHSARPARKLLSCALASCLLLGAAPAFAQSTAATIRGQVTVDAAPAAQAQVTATNLATGLTRTVQVSNGGYSVGGLPPGSYRIDVAANGQTSSQNVTVQVGQTATLNLGVGGEAATAAGGNATTLDAVQVKAPPVLVETRTSENATYISNVQIQNLPRATRNFLELADTVPNVQFTREANGTTKVRTGATSAEGTNVYIDGVSQKNYVLTGGVSGQDSSRGNPFPQSAIGEYKVITSNYKAEFDQVSGAAIVASSKSGTNDFHGSFFWDTSNDSWREESPLEKKAGVRDDFEETQYGATFSGPILKDKAHFFIAYEAKEYTTPNVVIPGSIYSDRVDQLPAQLQPLVVTSSTPFKEDLYFGKIDWTIGENNLFELTGKYRKEDELNDVGRTSTYEHGSINGQEEKRANLRWQYSGANFLNEANLSYESAFWNQAPINNGNGYILSYAPVRGNETDILAAGAGSSFQRKGQKGWTFQDDLTLNSLEWHGAHTVKMGVKFKSIDLDSTQFNPANPQYYYNILTDVQTPYRVRFGAPLVEGGGSVVSKNKQYGIYLQDDWEVNEHWTLNLGVRYDYEQTPAFLDFVTPSDVASALQNWPNLRNANYNINDFISTGNNRKAFNNAWQPRLGASYDLFGDQAHVIYGGAGRAYDRNIFDYLALEQLNNSFKSYSYYFTSANNPTCLGDPCTAWNPAYNSQDGLNTLTANSTGGGGREVYLIDNNLKTPYSDQFSIGMRNMVPLWGQDWFTDVTLSRIESHDGFAFVRGNRLPDGSFFQPGTTSGVPTDGPNGYSAIVLGTNGVETRNNQLALQVEKPFDEESGWGLTVAYTYSDAKENRQFGEHYALDRERIQDYGWREAGGIPKNRLVVTGIYELPYEIKLSGKLSLASQTARYGQNCLAGNDQCQIIQFKPDGTLGYKEFSIAANKEWDTGGGVKFNVRADILNVFNWVNYATFNGDTGTLQDLNTAYGTPTGVLASPMRTFRLAFGLNW

SEQ ID NO: 17149 - protein, 730 aa, Xanthomonas campestris
MPSKTKTALALSVVWAMAPSMASAQQAADTDGSVARLDEVTVSSTRIERRVDQVPNTVTVTPAATMEQAGARDIKDALRDELDVTVRAAPARFTAAGSATGRAGNEGIHIRGLGGNQVLMMVDGIRVPNSFSFGSFATGRGDFLDVNGIKTVEVLRGPASTQFGSDGLAGAVSFRTLDPDDLLKPGQSIGGFARSSYASVDRSWSNTLGVAGTHGRWQGMLLGSYRQGHAVGNQGENGAQNVNRTTPNPVDYSNPYLLGKALLTVDPTQQIGLTFETQKRTQNTEVYSARAVPPLTSTSTLDLDARDRIHRDRFSLEHQFNDPGSPWVQRAQTRVYWQDAKVNQFATEDRNTAPDRTRNNTYGTKIAGFSTLLESNLSGFLNQRLTYGVDWSQAGITGVRDGTVAPFGETFPTKPFPDTRHTLVGAFVQSDIEAGKFSVIPGLRFDHYRLSPSSAGYTGGTAVALSGQAVTPRLGAVWQLAPSFAPYGQFAKGFRAPTPDQVNNGFTNLASGYTSIGNDHLTAEHADSIELGFRGRMENVRYSVAAFDNRYKNFISQKAVGGTGTPADPTVFQYINLANAHIRGVEARTQWPMGRLWKANAGIAYSKGESEVAGVKAPLDTIEPLKAVFGVRYDDAIWGARANLVYSAGKQSRRISTTTAQFAPPSHTVLHLGFHWKPARNLSVNANLNNVFDTKYWRWSDVSGLASGSTVKDAYTAPGRNAQLSVRYDF

SEQ ID NO: 17150 - protein, 2711 aa, Xanthomonas campestris
MNRAFALVWNAAIGNWVVTHELVRRRRKPGAPRRQLPALVVLTVGAAAPMLAWGACTPAIPAAGATVTCSGLPITSNIFASGANNLTVNIASGSQMTAGLLGGTAIALSGTNSTLNNAGTIDPSVLGLLSVLSSGVTMGNASSTAVSVNNLAGGTIYGTGGVLGANLLNLDGMALGLTSASGGTVQINNAGVIDSRPLAGLSILSSDTPVIAVTGGGTVNAVNTGTINGRVGFQSSATGNTFVNAGAINGSVSMGAGSTNSFTAVTTGTVNSAGGLALELLGPGGLLSFAQTGVVDGGLGGNNTLILQNSAVGTGSGSTGAGTLSTAQYINFGNLRVNSGTWSVGGANNFGNSALNGGVLQFANPAQLGNTITANGGTLEATAAGLTLAPTNGIALGAGGLSLQGTNNLIIGSAITGTGALTKTGTGELTLNGAGTFTGGVNLIDGALTVGTNSALGTGTVTASGGSVLAGASVNLANAFSLSNTVGIGGENPLRIAGTISGTGLLNKVGTGTLTLGGNNTYSGGTTLGAGSVLLETSGALGTGTVTAAGGSLDTTAPLSLTNNFALTNTLGLGASGNALTLSGTLAGVGGVNKTGAGTLTLGGLNTYSGGTNLASGTLQLGTASALGTGALNVTGASNLSTTAPLTVANDISLAAALNLPSTQALTLTGAISGAGSLIKNGTTTLSLTATNSYSGGTSLTAGTIAVGADNALGTGTLAVLGNSVLSNAVAVALANDIALGAALTVDNAADMLASGAISGSGDLIKTGLGTLTLSGNNSYTGPLAIQAGTVVASTAASLGNASNVDVAAGALLNLTNGGLINTLTGAGDVDTDTGATLQLGGGDFAGSVGGGGNLDKVGTGTVRLLGTSAIGGSTQVSGGTLDVVGSLGTSALNVALGGTLTGTGTAGNVGAAVNISDGGRLALTSGSSLSVGALTLAPGAFVDVALGAPSTTRLLEVNGNLTLDGTLNITDIGGFGTGVYRLIDYTGALTNNGMLIGLFPGSVDISQLALQTAIGQQLNLVVTAPGSIVQFWDGVQTTANGTIDGGNGTWGAATNWTGQDGSANSAWQGDFAVFSGAAGTVGVQGTQNIGGLQFVTDGYQLTDVGAGALAVTNPLTAIRVDPGATASIGVAITGIGGVEKLDTGTLVLSGPNTYTGGTALSGGSLVLGNAQALGTGTLTAAAGTTLDTNQAWAVGNAVVLNGALTVPGSNDLALTGAISGPGSLIKNGTSTLALDGSNSYLGGSVLNAGTLAVGSNTALGAGALSVLGTSTLSNAIALALGNNVNLGANLTIASADNLALTGVLSGAGALTKTGLGTLTLSGSNLFSGPVSVQSGVLATSSTGTLGTTASVDVAAGAGLSLGSNTALNSLAGLGNVAIVGSNTLQLGVNNASSTFAGSLSDAGNLEKVGTGTLQLTGTSAIGGTTQITAGTLDVDGTLGSTGGLTVGTGGTLSGSGVVDAAVTVNDGGRLVVTSGSLLTTGSLSFAPNATLDAFLGIPSQTGVLAVNGDLTLDGTLNITDIGGFGTGVYRLIDYTGVLTNNGMGFGTLPGTVDSTQLTLQTSLAQQVNVVLLESGNTAQFWDGAQTVANGIADGGTGVWTAGATNWTSGDGLTNSDWQNSFAVFGGTAGNVGVQGTQGIVGMQFITDGYVLSDAGAGALSANAANTIIRVDPGVTGTIDVAIGGTGALQKLDTGTLVLSGSNTYTGGTALGGGSLVLGNAQALGTGTLTTAAGTTLDTNQALTVGNTVVLDGALTLPGSNDLALTGAISGAGSLIKNGTSTLTLSGNNSYAGGTVLNDGTLAVAGDTALGSGTLSVNGDSVLSNPVAAALGNAVTLGAALTVDNPADLTLAGNISGSGALIKTNTGTLTLGGSNTYSGGTTLTAGTLVGDSASLQGAIVDNATLAFNQVADGVFNGSITGTGTVVKDGVGALLLNGANGYTGGTSIVAGTLIGDTASLQGDIANDAALVFNQTTDGVYAGTVSGTGSLEKAGAGALQLLGPNTYTGGTVISAGSLVGNTASLQGDVVDNATLIFDQATDDTFAGTVSGTGSVIKQGTGALTLVAPNTYSGGTTVASGSLIGTTASLQGDIVNNAVLVFDQAGDGTYAGNVSGSGALIKQGAGALTLQGGNSYLGGTTINAGTLIGNTASLQGDITNNSTLTFLQNSAGTYSGRLFGFGRFIKLGNGTLVLTANSGSFTGPTEVNAGTLSVGNQANPGAALGGPVTVGPGGTLTGSGSIGSLVSSGTVVIGGTSGTISVGGNATFAPGSTLQVAPGAGGVVTPVTVGGAATVATGTTLELVRATDLPLFTEIPVISASGGLTGQFTNIISDYAFIDPNVSLTATALSVTFGRNTVGMVGMVTTPNQQSTAAAVDGLPNTSPIYQAVLRLPDDPEAVRTAFASLSGESHASTATALLDSRFLNSGIGNHLRGDSQDTLVGDTMVWITGRSLPNRVDGNADAVSVRRENNGVMAGAERRFGESSVVGIAVGNQDIKSWSREWGDRADVDGTHAGVYGRTDWSAFSLQGVVDYASYNIDSTRRLMLPGVLAERLSSSYDATAVTVSLEAAWNLRTKGAVYSPFVAADYTRLKTDGFTERGGISALSVDRASDTFSTATLGVRGHWDLGQKAGLYASAGWRHAFGDRSVQRSAGFVGTASEFSVQSVTLAKNAVVGELGVSLITSPGSRLALSLQGLDGDGQTAYGGQVTWAVSF

SEQ ID NO: 17151 - protein, 698 aa, Xanthomonas campestris
MLVPCRLSPLTLGLSLLFSVDLASAATTTLPESSITADSEREKDNPRVKEVSTATRTSTPVRYVPQAIDTVKTVNVLDYGSNTLGKALEGIPNVSSGADTRFDSVRIRGFEASNDFYLDGIRDDSQYIRDLHNIERVEVLKGPAAVLYGRGSQGGIVNRVSKAPEPGRRSTLEAQAGSEDLRSLYADLSADPSDTVSLRLNMGNQDNNSFRDGVHGSRQLFAPSISWQINPDLNWLVQYEYSRYNRTPDRGIPGVNGRPADVSRGNTYGDPRDYIDDHAQSLRSRLNYQLNETWQLRHTLGLFKLDSEFDNTYVVGYNAGTNTVTRQRWQQDLNTRNLFNNLEAEGDFDTLGLEHKLLVGLEFGNQRRDPLLYTALPVAKGGQAVPGLDLNNPDRSQQHNGPMTVSSDNHTVVDSRGLYLQDQIRLNDQWQILAGVRFDQFDVQTTNKDGVREPQDSNSTSPRLGVVYTPWRDHSFYASWSKTFSPVGGGLIGITPDAPGNGNDAKPEETRQKEIGVKSDWLDQRLTTTLAIYELELYNRRTRDPLIPENILLSGLQRSRGIELTATGNIVGNWYVRGGIGLQDAIIVKDNNGQEGNRINDVAKRNGSLFVTWKPELGWYAETGLTLVGERYADNQNTTVLPGYGRWDALAGYRTHDWDVRAALSNIADKTYYSSATSAAQIQVGDPRSLVVTGSYSF

SEQ ID NO: 17152 - protein, 669 aa, Xanthomonas campestris
MNCSISGLKLSILALTVASAVGVAQAQEQEKPKRKHHKHKDMEVMVVTASGVAQHLKEAPASISVIDRRDLSQRFYKDLTDAMTDAPGVIVTGGGDRQDISLRGMGADYTLILVDGQRQSSRETRPNSDGPGVEGAWTPPLAAIDRIEVIRGPMSSLYGSDAIGGVINIITRKTPEEWRSEIRVDGTLQERSESGNSYQTNLFTSGSLIKDTLGIQLSAGYTRRLEDEIVSGYRDKTAEDADLKLAYTPNRDHEILFEVGTAQQSIDASVGKTIEPLAPGEECGRRGCPESSTTEYDNTSVSIAHNGQWGMVGARSYLKRDEYENKARIMTIKNTDFQSHWNVPLLEESSMNLGVAYQKEELEDLTSNQISDRNRIEGSQWSAFAETAWPIFNDFNLTTGVRYDDDDIFGGHWSPRVYGVYTLSDATTIKGGVSTGFRAPSLRETTADWGQVSRGGNVYGNPDLEAETSTNYELGLYTDWGRRSSTSITVFYNEFDDKITRVDCPESICDAGPNQFGSMPTTRINIDEAVTRGIEMTLSTHFSREWSLKGNYTYTDSEQKSGEYKGEPLNQLPKHLVQTSLNWKPGKRWNSWLRVHYRGEESQPTTGPSQGSLVAPSYTLADFGVNYFVTRDLKLAAGVYNLFDKEIGVEEYGYVEDGRRLWLSAAYSF

SEQ ID NO: 17153 - protein, 911 aa, Xanthomonas campestris
MSVQHRHIPAGRAVGQRSIREFRRSVMAISVATLLSAQAYAQDATTTAAPASDATTQQLDTVQVTGTRSSVTKAQLVKQNAEQIVDSIVAEDIGKLPDNNVAEALQRISGIQISRNYGEGSSIAIRGLTQVRTELNGRDIFTANDGRGLSFEDVSAELLGGVNVYKNPSADMIEGGLGGTVDLRTRLPFDYEGRKIAGSVQYNYYDLADDGKPAFSGLFSDRWQTGIGEIGILVNYSQQKSPFRQDTISIEPWYTQTDLPGYEGQGVSVPHGAGINTTIGERERKTGAFAMQWRPNDSVEVYTQVLRSDYDFSWQDYSFFALTQRNPIQGLPGIQVNDRNEFVNGSFQNVPTESNTSLTERHSVTTDYSLGAKWTVNEKLTLSTDFQYVDATTTGTRYIVATGQDTSPQFNVDFRGDLPRLSVTDASGAEGYLADVNNYDGWRYHLDNKDDNKGTEFAWRADMDLAFDSDFVRSFKAGVRYTDRDAETKGNIYRFMCLNTACGAATDSPFAAFPSIGIVTNPITDFFRGESSTFGRTLTAANSAVSNYEQTLATFGASPLVFAPNNINAQTEKTYAAYGVLRFGVDSDSIPFDGNIGVRVVRTEVGSTGVRTGTDSEGGGLIPVDAQQTYTDVLPSLNLRWMLSDQLQWRFAASRGISRPTFDRLNPNLSLGTNSGAGGSTLVGNAGNPELEPVKADQFDTALEWYFGQGSMMYGTLFYKKVEGFIANAVFNEIYDGQPAQITRPVNGDAGKIRGAELGYTQFFDFLPGWLSGFGLQTNYTYVDSEAPSPTATDTNGQSLTVPLEGLSKNSYNAILSYETARFQGRVAYNWRSDWLVTTAGNGTENLPVYNKGFGQLDASLRFNINDVWSISLDGVNLLDTRRESYLGTESRYRDFVINDRRYGLTLRASL

SEQ ID NO: 17154 - protein, 417 aa, Xanthomonas campestris
MSGKTTTMNRTHFMSAACLATLALPVPAMADFIGDSHARLELRNHYINRDFRQSNAPQAKAEEWGQGFTAKLESGFTEGPVGFGVDAMGQLGIKLDSSRDRRNTGLLPFGPNSHEPVDDYSELGLTGKIRVSKSTLRLGTLQPILPVVVYNDTRLLASTFQGGLLTSQDVDGLTFNAGRLTKANLRDSSGRDDIGYGAASSDHLDFGGGSYAITPQTSVSYYYAKLEDIYRQQFVGLIDTRPLSEGVSLRSDLRYFDSRNDGAERAGNIDNRNFNAMFTLGVRAHKFTATWQQMSGDSAFPFVNGGDPFTVNLVTYNTFTRAGLDSWQVRYDYDFVAMGIPGLSFMTRYTDGRHAETATVSNGRERERDTDITYVIQSGPFKDVSLRWRNVTFRSGNGLTNAVDENRLIIGYTLALW

SEQ ID NO: 17155 - protein, 416 aa, Xanthomonas campestris
MKLAPTLLGSALLLALAAPAAHAEIAIDVIGGSEISLEGLVQADGNWFHNDVQDLNGPIGANGDNSEFSIRRAELVLKGKGPGNFEWVAGYDPSVLKEVTIRGTTIRSTGRFLDNNIKYKFGGNANNYLQIGQFKQPNSLEELSSTKNNDFVSKASVTNTYGISRRLGVAYGMGDNNWSVTASAFGRELTRNQAHGNGYGARGTWAPINETGNVLHFGLSYLAYDTDDDTLRLRARPDADLTTVRLIDSGAITNVDNVGVAGAEAMWITGPFKLQSEYFQENANRIGANAHDYKSDGWYVSGVWNLTGETWGYKAGVPTTPLPNEPASGMWQLAVRYDTLDLNDGHLVANGNTPFVDGVLGGKMNIWTVGANWYWRSNFKFALDYAKVDSTRYNSSTRGLVDDNPSIIEARAQFYW

SEQ ID NO: 17156 - protein, 875 aa, Xanthomonas campestris
MRPSTFKKSVLATNIALLMSGAMSVSAMAAEADAKTAAADENIEKIEVRGMRASMKASINEKRFSDSVVDAITAEDIGKFPDGDVGESLARIPGVTVNRQFGQGQQVSIRGASSQLTRTLLNGHAVASTGWFDQQAIDRSFNYSLLPPEMVSGIEVYKSSQADLPEGGIGGTVIVKTRKPLDLDANTVFVSAKGDYGTISESTDPELSGLYSWKNDNENFGILVSAAGSETDYQRNGIETLLGWGEIVPTTFQQDRKRTAINVAAQYRPTDALEFGVTYTGLEMKANNANTSIFLFPTQQGENTCNQTNAAGVCTDITHTGEGGFAWAQTWARKAKMTSDTIDFDFNYEADNFTVDGRVGNTKSDGGTSLTSNYGGSIGQPGDFAGHYDATGKIINIDIANKDFDAGDFNGDLSTAAWALKKQPNSDEETYADLNFTIPVELGAITSFKTGVRYADHDVTQQTDIATVGDIAVRDASYYYDGTISSGAGFTLPKPNFDAMINDANAAITGFERDKSGYGTLNEKNFSMYAMATFQSEGIRGNVGLRYVSSDVKSDYYALSNTGEFADNLSTDKASYSDVLPSINIAFDLTSDLILRTTAAQVMSRPNYSELFATSTLPGLNDGTPGNEKLNRGSVSLDPFKATQADVSLEWYFGGEGLAAITYFIKDVNSFISTRQKLNQQIGIEDNDLIAQGGSTCGDGVYDCWTVSEKYNAEGGRIEGVELQLQDSFDNGLGYSANYTFADAASPSENYPDHVGVFSDSSKHTVNLVGFYEMDSFSARLAYNWRSEYMMRELPGFYGNRQHEDYGTLDLSASYSVTEWMDVTFEAVNLTEEDSVQTGVAAADNPDVISEFKADYPVWSFEGEARYKVGVAFRF

SEQ ID NO: 17157 - protein, 376 aa, Xanthomonas campestris
MDAGLVYHRPVADTLTFSTRASAMVQEHFHGYGVDNDNDKHGNYLLETSLSGYRDNLDWVIGAAYQSDTYESDNYSDFDYSFDVPGLFAMVDYSLMEDLIASVSARMDHHSQYGTELSPRFSLLYRADGFTVRGSYGQGYYAPTPFVEEIEAAGLSRLEPLGELKAETARTASVDFTYRFDDLETSLTLFGSNIRNVTELEAFSLENNDTFDRVRLVNAEGENQIRGSEMLLRYYLGDLKLTASYLYLDATEPAQGRTSRREIALTPKHSAGFVAMWEQHGNFRAGFEAYYTGIQRLNDNPYLTESEPYWHLGLMGEMTFGRYSWFINLENLLDIKQSDTHPLLLPERTPAGQWTTDIWSRNDGFIANAGVRIKFG

SEQ ID NO: 17158 - protein, 350 aa, Xanthomonas campestris
MKKQCVVAALGVVPCVGAHAQASVTLYGVIDTNLEFLNHAGASGGSLVRENSGGLSNSRFGFRGAEDLGGGNKAFFILEAGFNGNDGTNASAGVLFNRTAAVGLSNAYGALSAGLQYTAMYDTLIKYDPMAFGQQYTWMPTTGSADGFSFKARVNNSVKYVGRFGGLTATADYSFGGSADSFQSSAAYGGALDYNTGSFAAAVAYDYRNGAVNATGMWTKSRNWSASAREQLGDVTLMGGYEHYLFNPTKGKSVSSALWFGGVRYLVTPAFRLTSAAYYQSNKADNVSNSLMGVLSADYILSKRTDVYATVAYAASMHYANDQYTPVGLTSDTAFGPNQIGVTLGIRHRF

SEQ ID NO: 17159 - protein, 894 aa, Xanthomonas campestris
MPVHHSARPVSRHARPLPARAVLCTTIACVLATAFSAQAQDSAPPAQPPATGTTTAQAPVTLDNITVIGQRASLNQAVQAKQMSDHVMEVISADNMGQMPNVTVAEALVRLPGVNGTRDRGNESLATVRGLGPRMTMGTVNGREIASSEPNRAVRWEVFPTEIVSTVKVYKTQSADLVAGGLAATVDISTISPLDYTGAGFVGTVGPVFYDHAKDVDGYSPWGNRFGASLVHKFNDNLAVAFGATYQKQKNSNSSIGSWGYTDATTSRDVDGDGIVDPTPFGAADQLKLTEQTRTGAMGTVQWRSGNFEMKFDGLYSRIEIDEDQLQNWFNGLAFSTFSTGANPYTTPGSSYTIVDGDVVAGTLANSNLQVDHVVSHYNEVKTLTAGGLNAKWNGDVWTLASDLSFSQAKRDNTWQAVRFGSNPDTVSFDFRRSVTPTIRTSSDTPEYGIAGQTEPQALRDKIAALALDAGRQIDMAAFTSVEFGVRAARREKQNRRFISNQSGYDQPISAYQNLIYPVTMPDLNVPTLTGGNMDAIADVGFGGFDPATLDEQLLDHWNVKEDVREAFAKAVFSSQLFGTDVTGNIGVRLVNTKTTSDGFDSVGTTVQASSDSKEYTDVLPSATLNFLIDDQRILRFAVAKVIARPPLDELRTGRRLDDPTVTVGQLTGSGGNPQLDPFKATQVDVSYEWYFHKEALAALAVYRKEVDSSIGYRTDREVINGLDYLVSAPFNGGGGHINGVELTLQTPFYFIPHMENFGVYSNFSLVDSNLKEFSPADNPLPLSGLARKTGTFDLWYSNGTFEARVGYKYHSPYTVVYGWNAARLARLQSEGTVDLSLNWQYSKQLGFRFQAGNLTNEPLRAYTDNKPNRLANQDDGGYQVFGRRYALEATYKF

SEQ ID NO: 17160 - protein, 789 aa, Xanthomonas campestris
MSLYSPVASSLSCLAARSVTRSSAGLQRTPLARACAALLFASVATGAAAQQAPASQGEASPTALDTVTVTAEHREQNLQDVPVSVGVVQGAAMREYTAGGDDTLLALSGRVPGFYAETTTGRIFPRFYIRGLGNIDFYLGASQPVSIIQDDVVLEHVVLKSNPVYDVDQVEVLRGPQGTLFGRNTTAGIVKFDTVKPGDTYTGRVNASYGSYNTISLDGGFGGPINDVLSFRVSALYQHRDDWVDNTFAGSSADGTRTPRKDAMGGYNDRNARLQLLLKPSEEFSVLASAHTRDYDGTSTLFLRNAVTRGSDKVDVPRDRVAYDEAHDNPQAYKTDGGSIKAVYDFGGVSLTSISAYETTSGYSRGDTDGGAAANYPVNGVPNGFGQSMGQIRDLDQYTQELRLASVGDDALQWQVGGFYFDGRDTTDFYQRAYFLQTAARNPNNWVRLRNTNTSWAGFGQLSYKATDALTLTAGIRQTKDTKETRLLKTADTAAGAVTYRGRRDVRLSDTQPSWDLSAMYEINPDLSVYARVARGFRGPTIQGRSAVFNSDFTTADSETILSWEAGIKSSLFDNRLRLNVSGFTYTVDDIQLNGNDADGNGVLFNADKAKAYGLEADLDWRPISNLSLTAGLSLLHSEIQDKRVYAQACALNGVVVCTVNDPTIRVGANTFAQIDGNPLPNAPKYNLNLAARYDIPVGNDGAFFVSTDWNKQGETSFVLYDSTEFRADGNFEGGLKLGYTGGYGAWEVAAFARNITNEKNVKGVIENYMAAVYNEPRIVGVSVNVNWQ

SEQ ID NO: 17161 - protein, 475 aa, Xanthomonas campestris
MQREDGFRDHSNGHLERGSGNFGYRFSPDAETRFYVNANTWRQRLPGELSKTVALNTPRAADPEFVRQDQQRNIDSMRVANKTTLRFGPTTVDLGVFTHQRHVDHPIYRYLDYYVSDYGGFARTTDDRLIGGFRNRLIAGVNLQAGVIDYKEYANPGNAVKGELLTSALQKSQNHSVYAENSLFVLPNVALIAGGQFLHAVRNQEDRILSNGDQSGRRTYDIFNPKVGALWDVDPTWQVFANISRSAEAPTFDANTFNSPVSSNVNAQTATTYEIGTRGRRPDLTWDIALYRAELRNELQCLRSSPFSLCSVVNADRTVHQGVEAGLGVAFIKSAFAQEDRFWFNLAYTYNDFFFDGDARWGNNRLPGVPPHTIRAEVIYKHPNGFYAGPNVEWMPQAFFADNANSLTIDPYALLNFRIGHDAGGPGWSGYLEARNLFDTHYISSTITADIATPASALFNPGYGRTIYGGLRYRM

SEQ ID NO: 17162 - protein, 738 aa, Xanthomonas campestris
MSASRSLKISALAVAVVSLLPLAAAAQQAPSDDGVVRLDAVKVTVERRSEDSKDVPVSASVLRPEFLDAISTSGSDIRVLAGKAPSLNIESSNGRVFPRVYIRGYGNTDFNTYASQPVSLIYDDVVQENVFLKGFPIFDLEGLEVLRGPQGTLFGRNTPAGVVKFNSVKPTIGANDGYASLSYGTYGTMTLESGLSIAMGDHWAARLSTLGQRRDDWVENRDGRDLEGYTDSAVRLQLLYQASDDFSALFNAHARHLDGTARLFRANIIQPGTNQLVEGFDPENSFIDGANRQELQTYGGSANLTWDLGDIALHSITAYEGIGKYYSRGDIDGGFGAVFAPPSGPGVIPFPVETAGGIKSLDQYSQEVRAQSQYEGPLNWQAGLYYFHDDVEGENYTYNTLSGGDLASYQLTRQRNTSWAAFGSLNYAATDRLNLRAGIRYTYDKKTFDALALDRVTLVEPSSGETDNSKVTGDLAATFSINDDVNVYARAARGFRGASFGVPSGTAPLTVAEPETVDSLEVGIKSDLFDNRARLSVDVYDFRVKNQQLTAVGGASNDVRLLNADKTKARGAEFDFEALLTQNLRVTAGGAYNWTRIDDPNLSVGICRTCTVTDPINAAGRAVIDGNDLPQAAKWMANATLRYGIPMGNDGELFFYTDWSYRSEVNFFLYDSKEFTGQPLVEGGAKIGYNWGAGAYELSVFCRNCTNQIRVTGAIDFNNLTGFINDPRIVGAQLRANF

SEQ ID NO: 17163 - protein, 498 aa, Xanthomonas campestris
MFGYRLNATHEEGKTYNDGNVRRDSVSVALDARITRDLKATFGALYQERHSTGITGSISTAQYTGTSLPHTISGGTGDLSGPDQHLNTNLQLYTAGLQYNLGENWTLNASYSYSKSSRDRNESTYYLLNGAGDYTDSRFAGKEGHQLSLWQVSAEGQVKTGPLQHQLVFGAAYQRQTNDYGANSFFGQIGTGNIYQPNTNTFGGASNYYTYRDSDITQKALFASDTIQLTQRWSVLGGVRYTNYEQHGYSTSGATTSTYSQNGVVTPTVAVMFKLAPTTTLYTSYVESLEAGTVVGDTYANRGELLKPLRSKQYEVGIKTEQGRWSATAALFRIERGAAYANSANVYTQDGESIFQGIEMGGDVRLGSHWNVGGDLMWINTKYERGAANNGNRVAGAPQFVVAGHATYSVPYVPGLRIGADAKFTGNTNVRPSSNLNAPGYMLVNLGASYATRIGGYDVTFRAAIDNLLNRRYWEYQYADYVTPGDPRTLSLNARIDF

SEQ ID NO: 17164 - protein, 772 aa, Xanthomonas campestris
MTPRISPLTSAVLLTLSAPAFAQPGDAPAPPGAVDLDAIRVQQERAQKPSSPKYTEALRDTPQTITVVTKQTMDQQNLLSLRDVLSTLPGITFGAGEGGGGYGDSINLRGFTASSDITTDGVRDSAQYSRSDTFNLEAVELINGANSAMSGAGSVGGNINLVTKTAGQGDFTNVLIGGGSDRYGRLTVDSNYDFENGTAVRLNTMGHTQDVPGRDEEFRHRWGFAPSVAFGLGSDTRFTLSYLHQHDNNLPQYGVPFALSPFNDGPLPGVDRETYYGYRNVSRQEIDVDMLTGVLEMDFDDNVKLRSLARVQRVDQTTTATAPEGTWCLPNNTNAYTGRACVGQPPSTWNPNSGPRGLVRETENFIAHSQTDLTATLHTGAIEHRVVAGVAFSKEDFELDSGSIFRNADGSTTGITYPLQTFDNPYNIWTGPQNYFRTGRSKGSLTNQAVYLFDTLQFNEQWMLNLGGRYEHNEGDSTTYTVNATGGVTGVTPGFPAGSEEDLFSYRAGLVFKPVDNASLYLSYANSKTPSKASVNGSCTPIATATVGANCNVEPESAVNIELGGKWDVLNERLALTAAVFRNERENYKVNSGDPLIPEQVLDGKARVDGIALGAAGYLTERWSVFANYTFLDSEVLQSVSNRTASLTGDPIAGRELVQTPRNAGNLWTTYQLNEWTFGYGVNYQGSFYPNNTSTAVYRKTDAYWVHRAMVGLRVNDWLSLQLNVNNLFDKEYYTSIRNNLTVNAAGTVTAGSGWALPGDGRSAVLNATFSF

SEQ ID NO: 17165 - protein, 906 aa, Xanthomonas campestris
MIRLFRQTTAVIRQFRMMAVIRLFRQTTAVIRQFRLMTGGDTPVPPDDGGDTPVPPDDGGDTPVKHNPVVYKNGVTWDQDAKTVKIRETTFTYSQNADGSYTLTAPEGKETIVKSWTVHDDSNTVVFDGVNTSGGITWSYDDDGLIHITKEAGVVVDGTTGNAIEFGNAIITDQGGNTALNGGTVMTVDGDNISLNNDGKTTAIGEGSVVGILTGDNITINNNGETEVDGGTAVIINGDNTKLNTAGDSTITNGGTGSLINGDNARVDNQGTMSVDGENSTGSKIVGDGATIKQEGDLYVSGGAHGIDVDGNDTFVSNKGNITVIEDNSIGMLLDGDGVSVINMGDLNVGQAAAGENAIGIQIDGDNATFVNVGDISATNAGTGVSVAGDKANISLAGGLDVGDFSTGLDVSGNNNNMTLATYELNVTGQKATGVNVSGDGNTIEIAGSILVDKDQKADNAQPYFFNPSTGVNISGDNNDVTLDGQLTVVADSKTTSRSYASYDGAQEHIAGIVIAGDDNTFTLNGGVHFVGEKNVMDDGSKPSASRRGIGDTPLINVDGHSPVYLNGESTISGEFPLGFENLIQLSHGAELEIGADATFDMSDVDSFTYYYRVALSTISIDSGAKATNNGEVELKNIGFAAAWNKDSTVINNGSIGLAMYDFGTDPAPKVFDVEYGGIGVNNGTMTTKMMNQHSVLNYPAEWNLSDGTSFNNKALGLTGMLASYSSSILNGETGIIDMYGRGSVGMLAIDKSTADNEGQITLDTLWVDENDETSLRNNVANSTAKDFGVGMASGTDAYNGALTKATATNHENGVITVYNAGAGMAAYGNTNTVINQGTINLEKNENYNDSLGVNKLVGMAVYHEGTAINDQTGVININAENGQAFYNDGTGLIINYGTICTFGVC

SEQ ID NO: 17166 - protein, 717 aa, Xanthomonas campestris
MIVRCLPSRRSGLAAGLSLLAVASAQARDAAAPAPAARTDAPIALDTISVTSTRTEAPAIAALSGTSVVTRAQIDRIQPSRLSDLLRDVPGVTTQENQNDPAQAVNIRGLQDFGRVNVLVDGARQDFQTSGHSANGVFYLDPELVGGVDVTRGPASTLYGSGAIGGVVAFRTRAIDDILTPDETMGAVQRWGFGGNGQRFVSTTALGARIGPAADLFGQFVSRHADPYRDGSGTLVRDTGSALTAGLLKANLRPAEGHEISGTALIQDFDFANAGTGQAGARFANRVQADTYTLGYRFARPDVPLIDLDAKVYRTSTHDLLTFLSDAPSGLYGGLGARPGNRIDYDIATSGLDIHNSARFDTWALSHRLTLGGDSVLDRVETDDRAGSFGAAFTPSGTRRLAGAFVQDEVGYSSWLRVVGALRYDRYALSGGAVHARGERLSPRITVGVTPLTGITVFGTYAEGYRAPSITEALVQGIHPFPAFTLLPNPALRPEVARTIEGGVNLASGDLLRPGDTFRAKLSVFSTGIADFIAVGPVGPTYLVPALPGLPASACARGAGRFPCVIPVRSLQYRNVARADLSGVELEGAYDWGGGFVSLAATHTDGRDAATRETLLTVPPDRISATLGLRFLGERLTLGGRLTVVEARRAVPAGATILATKGCGVVDLFACYRFDDRVRADVIVQNALDRRYTQYLNLLQSPGLTAKAALTIAFATC

SEQ ID NO: 17167 - protein, 666 aa, Xanthomonas campestris
MLLSRKKYLAQVITALCLLPAVPVTNVLADTAPDKEKMMERIVVTASGFEQQIRDAPASISVITREDLDNRFYRDLTDAMLEVPGVVITGGADRQDISLRGMGSQYTLILVDGKRQSSRETRTNSDGPGVEGAWTPPLAAIDRIEIVRGPMSSLYGSDAIGGVINIITRKVPNEWQGEVRLDTTLQEKSTSGNVYQSNFFVNGGLIKDLLGMQLYGQYTQREEDNIYGGYRGRDATNLTARFALTPNENHDIMLEVGVSNQELDSSLGKTVTPLAPGEACGRRGCPQSSTTEYENSTISLSHTGRWDFGTSDSYIKHEVFDNKTRKMKITNTDVQSSLITTLGQSHTATFGAAFNHQDLTDETGNQVSDLTDISRRQWSVFSEDEWRIVDNFALTMGLRLDDDENFGHHVSPRVYGVWGLTDSTTLKGGVSTGFRAPSLRQTVPDWGQVSRGGNMYGNPDLQPETSVNYELGVYSDLTENITASAGVFYNEFKDKITRVACPATQCTDGPNQFGSDPTTYVNIDDAVTQGIELSIDYRIRSNLSFTGNYTYTDSEQKTGAYKGSPLNQLPKHLIQASFNYEPIDNLSTWLRVNYRGEESQPTTGPSSSSLIAPSYTLLDLGANYQLNDSLKFSAGIYNAFDKDITQEEYGYLEDGRRYWLGMTYSF

SEQ ID NO: 17168 - protein, 885 aa, Xanthomonas campestris
MRTSAVARLSRTGLSLSISTLLMSGAAMAQSTASDADAGSGTSSAAGTSVPKQLDQVVVRGDYIPEPMLQTSEVASFVTREDMERTGDSSAAVALTRVTGLSLSRGKYVYVRGLGERYSSALFNGSPLPSPEPMQRVVPLDLFPSDVLASVTVQKTYSADYPGEFGGGVIDLQSMEIPDKPFLSLTVGGGANSVSTGEKGLTYYGSDDDEWGVDDGTRKQPAALRDAIRTGRRVDLGSFSREDIRRIGRSLNDANLYVLQEKDGIAPDVNVGGSAGYSMDVGKAKLGIIAVASYDNEWRTRTGKQQDGIFVGDSVEFNSNYDFATTRNNVRSNGMLGLGWEYGRHTIGWTTLYVHDTMKVARSRAGRDELAGFDVRDDNTEWYARQLINNQLRGTHAFGEYDDLKIEWRAAVANASRDVPYETGIRYELLDGYWAHDASRVQNYTRFSKVDDTVASGGVDVTWRSPMEHDLTVKGGLAYLDNDRSAWSREFRFLALDGPLPFLNQYQRVDYLFSDYNLSNDLLRLRETTGSFGAAAYEATLKVKAAYLQAEGEIVPTLRATAGVRHEDATQAVHPYDIFSGTRQDGVAPLHNSYALPSATVTWNFAENQQLRFGASKTIARPQFREMAPQQYLDPDIDRQFFGNPFLVDSELVNLDARYEWFFEPGQYVTIGAFYKNIDKPIEAIVNDAPGGGIVQSFINAPKAMLYGVELEAKKYLELPIAADWWGDKRLFVSGNYTRTKSKVSANAGDTVQPFGFSAPVQATLFVRDGSALQGQSDDIANLQIGVESESTHSQATLIANYVGERVSARGRPGQPDYIDRPGTSLDLVIKKGLTWSGDTVSVNFAARNLLKTKYQEYQKVASNRVDLYTYQPGISYDISVTARF

SEQ ID NO: 17169 - protein, 808 aa, Xanthomonas campestris
MKTHNKISLAVLAALSSMSASYLVHAEEESEATNEQRIEEITVVGRSVSYANNATSDDMFKQQANLSSVLAAVDNLPGVLINEGDTFGADDWSTSIVIRGFQVNLNEQQIGMTVDGIANGNSNYGGGAKANRYIDTENVQAVEVSQGTADIASRSHEALGGTLNFTTIDPSMEQGLVTSVTAGEFDASKYYVRYETGEIFKDTYAWVSLSSQESSDFMQQAAENTRDHLAMKFISTVNDVSLTGYLSYDDTHEDNYQRIYGLAQYEQNPDWDQLTDEWTGVPYQDQAYRRGWSTLRENLFAYLQAEFTIGQVDFMTNVYYHDNEGRGEWVPPYIVDITDDGTAGHSELVVGNTVYGGQELGQIYFVDRQGNQLSPIEGCQSSLTFPYGGAGAQYDPGCHEQGAIPVGSYRHTHYDKERVGVNADAVWYTKIGDFDNTVRFGIWWEDYERGESRDWHKITNSSISVDYDNVPYWVQYDRTFPVDTLMYYVEDELDVGFARVRLGAKKFNVDIEKSDNFDASNNLAVNTDSDTLFSAGIVAPLPYEGLEVFAGYGENFAAIKDAQLERNDTDLRFIKPETADNIDVGFRYASPGFNASVTYYNIEFNDRIQFTSNETSEGIDFLEAAAGGYKNVGGIESSGFEISADITLTETLSLFTSITLSESEYVATVGSSGTQYDTLAEAQAAIADPDNAEVSLVAIEDNTVIGTPDTMAVVSLDWARDNYFAGLSTKYVDSRYLDINNAAQVDDYIVSDFYIGGFIENIGPGVEELEVRLTVNNLFDEDYASTIAPGAFWIGAPRAVAVNARLTF

SEQ ID NO: 17170 - protein, 726 aa, Xanthomonas campestris
MAAGQIIYNPMKNSFLANSPSPQPLFRPLLAFAALTATMGTALTAHAQSAGATAPSTTTASASTLPSVRVLGDSDSDSRQVGDRSEITLNPQALPTTVQHIGQEDIANTNVGRDVSNIFRRVPGVLANNIDQGDTGNGFRMRGFATQGTHGADTAVYVDGVPQNIPSIQSIASHGAVFLEWLPPELIGGIDVIKGPVSALYGDQNRAGAVDIRTRDGGDATPSSVSVSAERYGLRRTALVLSNKLSQVDSLLVADLSRNDGYRYASNTDRESLSWKLSTQQDSGKYSLRLTRYVSDFQAAGYLALSDLQKGLDPRSTQFNNPGFGAARRTSVVVNRAPTAGEEGWYATAYGESLYRQRAVATSATRHLLGEDDRDMYGARVYHNTVFGDASLAVGTELRKDSGSAFRRIYVNRLPSANYANDVDLDLVTYGFFAQGQWRATRDLKLSAGARYDRFDYDIANLKLPAASTGYRKGVLTPKLGASWTVLPRLELFANVAEGMRSPATEQISSSGATGPLGASGGVISQVKPSKVRSYDMGFTANPTTDVMVSGSAYDILNSDEIVSQADGSFRSVGDTTRKGVELETRWQLGTASSVYASVGRILEAKVNNPAANTGAKLSVPGVQFKAGAQHKFGLGAGQMTLNADAYLIDDIPYYVGTPTTQERTMPLYTRYDVRSTYDYGPAQFSLYATFQPQRYGSEIAYGTAAGLLVSPVPKTTVGATLRYFF

SEQ ID NO: 17171 - protein, 961 aa, Xanthomonas campestris
MNCRSHRLALSISLSLALGAAVQPASAQQTDADSPRATSTLDAVSVTGSRIKRAQVEGAQPVVTISAQQIQQEGFATVYDVLNSMNQQGSVEADTQWGSHTPNASPINLRDLGPGRTLLLVNGRRVADYPLPYGGESNFSNYSNIPSAAVERIEILTGGASAIYGSDAVAGVVNVILKRDYQGDQVRLRGGTATEGGRDSFDVSWAGGRTGENWSLTYALQATRRDPLSGRDRAQMDDSDDMSYSNWTGQNRLYGFNPFTGLSLVDANTNERLAPPAGTCARFGGEFVDASRLSYNQNTGALTNAGDYCGMARDYADWGLVTGSEDYSAYLYGTWRFGEHTEAWATFSANRSIGRWTYDPPYAYLGPFQDADTGRSLYAIRQMTRREAGGWDRLANYNKEQSWDLSAGLRGVWADRFDWELSVGRSRYTVDEYVRTVDTARATDYFLGSPLGTAADGGAIYAVNTARWYAPLSSEQYDSLVVKSHNSAYSWVNQAAFSLSGDLFQGWAGPIRFATVAEVAKQGYQLSPDPCANECYPVDVVDSGGGERLRSSAGLELQIPLLSTLSANIAGRYDRYGNYRSSAVQTEVGTQSDTTWSAGLEWRPIDSLLFRSTLATSFRAPDMHYVLGEPSSTNQTVIDQYRCISSGAYLTGSCNDENSNIYYTVDVNRRGTPDLRSETGRSFTGGVVWDIAQGLSLSVDYYRIQLEEMIKDLDRDEILSAEAGCRTGTTVSGGAWNNPGGAGYCDTITSRVLRNADGTIASIERGPINLAQMETSGIDASLKYRLSTAGWGNFQLSLDYNTLIAYREQIYRTESDENRRDERVRSRVRGSVHWDNGGAWDWTVYFRRLGSMRAVNWGTCARFDDGYQPSAADECLVTDTANVHLGETSKRYFGRVGPAIYWNLSTGYKITDHAKVNFYVNNVFNEVGYENKERFYGYGFYNTTLFNPIGREVAAEYVFTF

SEQ ID NO: 17172 - protein, 382 aa, Xanthomonas campestris
MKKRNAVSLSGLAIAASAVCAPTAVHAQSSVTLYGILDAGITYVNNAGGSHQVKFDDGISYGNRIGFKGVEDLGGGLQAVFVLESGFHVGNGQLGFGGAEFGRQAYVGLKNNLGTLSFGNQLDMTEEFAYLYNISAWASGYAIHQGDFDRMNGDRLPNSIKFLSADISGFSFGGMYSFGNTAGDVHQKSAWSVGARYEHGPFNMGAAYTQLNNPFGIYAFDPYAMIGTHTFLGRPTVSVDPATGAVTDLYSSTSFPVDRQGAFAVGAAYTIGNVMLSGNFTYTTIKGLGQTSHMQVYEGGASYTFTPALMLYGGYQHTRFEGNHWNQGSLGLHYLLSKRTDVYISGDYLRASDGVNAVIGYSFTPSSTSTQADVRIGMRHSF

SEQ ID NO: 17173 - protein, 695 aa, Xanthomonas campestris
MSAAFVSGLYRRSLLASTVLASLGSIGLTTPSLAQQSASPNLLPPIQIAPPLERTTDSPPPSHRAVSRSRRAARSASRQTPVGDARVPGATASVIVSPTGIVTPADQLASSVTVVTEKDIQTQQYRSVPDILNTVPGLNVVQAGGPGAQASVFMRGTNANHTKVIVDGIDIGDPGNINGAFDYAHLLAADIQQMEILRGPQSGLYGSDAIGGVISIITKKGEGPPRATASIEAGSFNTFNQTLGLSGSEQNFNYAVNVAHLHAGDVPVTPPELLPPGRKAIGNNYDNKTYSTKLGVDLNENLTVNSVVRYTDATLLFTGDSGFPSFPNAAQSTHAVQQLFNREEAVWSLLDGRVKNYFGVNYTNSRGYDISPGDPVATTTTGTRLKFDWHTVAEIARDNNLIVGAEQQTDRIDTTDLAAQNGNKAGFIELQSAFAKRFFLVANVREDSNDRFGEHGTYRIAPAVILPVTETKLKASYGTGFKAPSLSQLYQNYPAFNFFANPNLKPEESRGYDAGFEQPLFNDRVRFGSTYFHNDITNLIGYNDTFTSLVNVNSATTEGTETFVSAQITERFGIRADYTFTRAVDAGTGLQLLRRPKEKWSVTATWLPVDELTLSATVLRVSNWLDVTRDGSASGIAAPGYTLVNLRGDYAINDQVKVFGRVDNLFDVRYQNPTGFLAPGLGIFGGIRVASDGVQ

SEQ ID NO: 17174 - protein, 926 aa, Xanthomonas campestris
MQFRTTSRKTPVTLLALSIGLALSGQAAAQDAAQSPAEPAVDLDTVTVTGYRASVEKALDIKRGEAGVVDAIVAEDIGKFPDLNLAESLQRIPGVVITRDAGEGRAITVRGLGPEFTRVRINGMEALTTVGAGDQSGGTNRGRGFDFNVFASDLFSQLIARKTASADVEEGSLGATVDLRTARPFDYSGFTFAASGQAAYNAMAEKANPRVAALIANTWADNTFGALLSVAYTERQVLEEGSNTGRWANGTSNGNFSAASPFAAARSADVYHPRFPRYVQMEHDQQRLGVTGSLQWKPTDRTTISLDALYSKIDATRDEHYIEAISFSRGRDSGTPRRADRDGKPATIVRNGEIRNNALVYGEFDNVDIRSENRHDEWNTEFKQVSLDLEHRFSDAFSVSGRVGTSRSAHENPVQTTIIMDKYDVDGYSYDYRGNNRAPVLNYGIDPTNPAGWELAEIRLRPQTVDNDFDTAQIDFNWNISPGFRLKGGVLAKDYTFSTVELRRASEIAVPTFADGTRIVPTDLTEQAGLKGINGSPSNWIVPNLDAVANQLGIYSNAGTYAVAPRANNTRSVEEKDRGVWLMGEFSTDLGSIPLSGNVGVRYVRTEQESTGYALINNAPALTTVGRKYNNTLPSFNLVAELAPDLLLRLGAAKVMSRPGLGSLTPGVTVAVAGGARTVSGGNPDLDPIEATNVDLGLEWYFNEGAMLGVGVFYKDIESFIQTAREVRPYASSGLPASLLDGTGASINDDFTFSIPLNTPGGELKGVEANYVQPFTFLPGKWANLGVQLNYTWVDSQIQYLSSTGAPVMKNDLTGLSRSSWNATLFYEGESFAGRISATNRDDYLTQAPGTEAGFNVDGVHGMSGTTMIDASLRYKISKQLELSLEGINLTNEASDEWVWSPQTGELPLQYTETGRQYLLGLRYKF

SEQ ID NO: 17175 - protein, 989 aa, Xanthomonas campestris
MSRLTGNHRTRRAPGTLRAVMLAGAALGTLAAALPATAQTPQGQVEEIIVTGSRIRQGNLTSTSPVTVIGSEEFAFQGTTRVEDLVNNLPQAFADQGGNVSNGSTGTATVDLRNLGPTRTLVLVDGKRLPAGTPGGTDASSAPDLNQIPASLVERVEVVTGGASAVYGSDAVAGVVNFIMQDDFEGARVDAQYSFFQHKNDNRLADVVRAANYELPKDDVTDGFTRDITGVLGMNSANGKGNITIYAGYREIDPVVQSKRDYSSCALGSNDDGSGYVCAGSATSYPGYFVVGDDQELTLDQATGGFRPFNLSTDLYNFGPLNYYQRPDERYTAGAFGRYEFNEAVEVYSTFMFHDDRTVAQIAPSGLFVGSFTTPCSNPFLSPQQAATLCTAQGLGPDDTAELLIGRRNVEGGGRQDDLRHTSYRFVGGFRGDFMEGWSYDASYQYGTVVFAENYRNDFSIARSQRALDVVTDPATGQPACRSFVDGTDPACRPYNVFQIGGVTQEALDYLQTPGFQEGETVQEVLTASVSGDLGQYGVRSPLATDGIAIALGAEYRREELELRTDAAFTTGDLAGQGGPTISVDGAFDVRELFGELRLPLVQDKPFVQQLSLDLGYRWSDYSTSGTTNTYKVAGDWSLTADVRLRASYNRAVRAPNVRELFAAQGVGLFDLSADPCSGATPTFSLEQCANTGVTPEQYGRILNNPAGQFNQLAGGNTDLDPEKSDTIALGAVFTPGFLANFSVALDYFRIKLEDQIGTVPPTLALDQCGRTGDPYFCGFIQRGAGGSLWTDPQGYIEAFNLNLGTLETSGIDLEVAYRMDLADLGLPDRGGLSFSFIGTWLDKFESRPVPVLDVEYDCAGYYGPTCEVPLPEWRHKARVTWSAPFGLDVSLSWRHIAKVNLDLSSDDPDLNGSFAAIDETLDSQDYFDLAANWEFYEGFTLNAGVNNLFDNDPPVSSEVGTGFGNGNTYPQVYDALGRYVFVGLTAQF

SEQ ID NO: 17176 - protein, 885 aa, Xanthomonas campestris
MRLLHPHSRPRCPALHCPPHPHALSLALGLALLGWLPSHAIAAEPSAGADAHTLDAVQVLSSFQSQNTRAIATKQAASTIVDSVAADSIGQLPDFNVGDAVRRVTGVSTVEYQGEPRYVTVRGLNGNYNSMLIDGFAFASNDIGSRQALMDVLPANFVDRIDVVKSLLPENDGGAIGGVTNLVTATGFARPDGLLTASAKGGANLMGSRYGGRTPVGEGELKWGKRFGHDGEFAFLGAASVWRRDISVPQQENGSALNWYNADGTRAPVAYGGTGAAVPSERRWYNYDNSRERSGVTARVDWQPEGPLSGHVSGYTFRQHEASDRNTQAAQVQSSARLTRSGPQSGTLDNLNQLVELGQLRWKRGLSGINGELLAELPAQWRGALRASTSRATVDNPQTWDRFQQNHLAYGFDWSGTLPAFTALNPALADNPSRYANFNHQQERTAYAERVSDLQLELRRNMDEDSRGLGLAWGLRQVRTHMQTAFQRTTWSGLPYSLADVLGDPTCALGCNAPMLTIDPDLADARWDAASGQARGVVDTTAQNSGTYSVDEQVRAGFAQAQWRGERWRLAGGVRLEQTRFGSSGQQLSGTVWSPVSAQRSYRNWLPSLAGQLQTSANGTLRFGASRSIGRPRLDQMALNGGVLTLSSTPPTLNQGNPDLQPRRSQNLDLGHDWTFDDGGSLLSIALFHKTIDDEIFRYGQLQTIDGQQVLVTQPRNTDRPVRMRGAELGAIKELGPWLPALAGLSVGANITFLDVQYPVVLGDGSRTTLSVLPQQPKQLWNLTLNYARGPLRSTLAWSRTGELWDDRYPNYSNQQEFYRNRYQQPLDRLDLKLAWDLSPAVAVSLDVLNLAGQGYEYHIGRHQEYVQSAWKMAPTVMLGINVKL

SEQ ID NO: 17177 - protein, 446 aa, Xanthomonas campestris
MSTASILSRATLLAVGIAGVLAVGQAHGAAFQLKENSAKGLGRAFAGSGSAPDDASIMVNNPAGMRQLDGRLFQADVSAISFSARFQPESANYANGAPVSGGNGGDAGMIAPVPAMYFHVPFGENDNMHLGTSLTVPFGFKTEYDRDWVGRYHGTKTELQAIDFNVAFSYDVNPYVSFGASVFAERLDIDLANAVDFGSVLAARRVPGFAPGSADGYSRIKGDSTEVGFTLGGLFSIDENTHIGFSYRSQVEHKITDGTADFTVPGSAAAVLSVAAPGTFVDTKGRATVKLPASATASFTHNVNEQWSIMADVTRTAWSKFDQVTVDFASNQPDSVLDFSYRDTTFASIGADYRMSDTVTLRGGLAYDQTPTTAEHRDVRVPDASRKWVSLGMSWRPSAQTEYNVGYTHLFTNNPTSDTRSATGDRLAGSYDVKGDVLAASINYKF

SEQ ID NO: 17178 - protein, 913 aa, Rhodobacter sphaeroides
MRGQSGTANGSIRGEVKDASGAAVPRAAVEARNGQTGYERKSLTDDLGGFELPLLPVGSYEVQVKAPGFAAYAQRGVVVELARASDLTIRLTVTTEQQAITVEADASILNTSSASVEGGLNQKSMENMPVTSRNSFNLALLAAGFNGTRDNEFGNPTFAFGGMQRRGFLVDGIDNTQRGGPGRLGIFAPETLQEVKVISNAMAAEYGRTVGGMISMVTRGGTNEYHGEALVLERRPGFIARQSLAPNKPFQQWQVFSGNLGGPVKKDKLFFFVSGEYEPLDAPRAITITPANAAALGLPASDLGSAPFAQRFQTYLGRLDYQFSERNSVYVRYSNFVTPSKFNTSGGLSPRSASNNFDDRNDTLASQLASVLSPSLVNEARFGFLRREFTRPPASGVVGPVIAISGVATIGSNTSANQYYNERQFNFIDNLTYRRGRHQLKFGFDIDTIRVISADRLNLTYSFASLAQYLNAVNGTGNYTQLTQEFGDNTANHTTNSFNFFAQDDFHVTEKLTLSYGLRYEYLAYPSLPAKAPLTESRSVPNDPNNVAPRFGFAWQPASKTVVRGGYGLFYDTTNLRLISTAIRQNGAQVLRYVISGTAAGAPQYPAALTQIGLTFSPTKPSVTNFSSDFRSLYAHQANLQVERELASGFSVTTGIQYYGGRRLPLLIDVNLGAPVSYLADGRPVFSNSNRPNPNFAQILQLKSVANSTYYGGFLSLNKRFSRGFQFTASYTLGWAFNTNDSTGDTGSSPSDSTNDRRDYGLSSSDQRHRFVFQGVWQPELRTHTLVDRMVNGFLIAPNVTATSSFPVTVVQGTDLNGDSVNNDRPLFRGRNDTPGYGLKEVNLRISRTFGLRERLRLEVIGEAENLFNTTNAGCTTGGCSGAVVSTFNAPDFLRITSTFNSRQIQLGGRLRF

SEQ ID NO: 17179 - protein, 390 aa, Bartonella bacilliformis
MNIISRVLLTVAGVAMVATSAFAGPTWTFGPDDEGLLKLDYKGQFQLDYRDTGSGSDNDDDTMEFNFRRNRISLVGAYGNLGIYVQTEYTEDVNIGPFSVSDGSDNEFQMLDAQIRYKFNDAFRVRAGKFKYNLTRENLEACEAPLTLDRSVLIRAPYVATRDKGVAVWGNLFDNIFQYRLDVMNGRNDSASAPDSNFRYTGRAHVTFLDGEKGYGYKGTYMGKKKVITLGAAYSVEEDVAYGDCANETDAVDYKAWTVDFFAEYPIEGVGTFTLSTAYVDYDLDDGYKGADPDSGIIGVNGEKNGGYTKVAYMLPETPLQFFFRAESWSLAYLDGVYDQEIDWYGGGLNYYLRGQNLKFTLEYSMVEFDDESAQYEDFDSLTAQVQVVF

SEQ ID NO: 17180 - protein, 3659 aa, Mesorhizobium sp.
MTLTLFVGSTGPAEATCTGPSGGVETCAGSGTQSDISYTAPGVTTLNVNTLTIDPSRISLTGSGANPAPATEVQHYTCSTGNAADCVITPEKPAQNGNPAVAESCAVASGAPAGTSCVAPPVKAAGGPSGNSGPTLVVNYNQPTANTNTPNSGAVIATGTIGVLGASNGSRGGNGSNGYVFSDGGDGANGADGGIVTVNVDGAVMTSNNCVLPTACPNAGIVASSVGGDGGDGGDAKGISGDAGDGGLGGSGGNATVNFNSGSVETQGNYSAGIAAISQGGHGGNGGGGGGLVFNPGGGSPAGAGGNANVFTGVGTTITTYGIYSHGIAAQSIGGGGGGSAGGFGLFSSSGGSGGNGGNGGIVQVTNNANIATWGNNSQGILAQTIGGGGGDGGSNFGLFASGGSGSLGGNGGPANVVTVGVTNSGAIVTHGQESNGILAQSIGGGGGNGGNSGGLVSLGGDGASTTNGGIVEVTNTSAGSISTDGKQSAGIFAQSVGGGGGNGGTSGGLFSAGGKGGAGGNGARVTVTNAGDIETGKNGAASVNSAGIFAQSVGGGGGNGGGAFSGGIGFSVAIGGAGGSGGTSGAVEVLRDANDTAYSIITHGDQSDAVFAQSIGGGGGNGGFSVSGAVGVLALAMGGAAGNASDGNIVTVETAGSLTTYGQGSRGIFAQSIGGTGGNGGAAIAVAVNATGTFAAAIGIGGNGGAGGASKLVTVSSLSDISTAGNNAGGIVAQSVGGGGGNGGYAIGGAIGGAVGIAVNIGGKGAGGGAGADVIVGSSGSIHTKGNNSTGILAQSVGGGGGNGGFTISAALGGGAASVGLGGAGADGSNAGNVTVSADGAGHTVATTYTGTWNLVTEGKNAVGIQAESIGGGGGNGGFSGSLAAGGLVGVGVSLGGTGGGGGDAGTATVNNGKKVGNTVTHNNILTIEDNSTGILAQSIGGGGGNGGFAVTLSVSGSYEGAGGAAAVSVGGSGATGGVGKDVFVTSYGNIATYGKQSDGILAQSIGGGGGNGGFSVAGTFTTGALGASVAVGGSGGSGQSAGEVTVTSAGNIQTHGDQSIGIMAQSVGGGGGNGGFAGAGAITLQGVSAAVGLGGSGAGGGSAKTVRVTSTGDITTYGDQAIGILAQSVGGGGGNGGSTVSLALAKDAGIGVALGGKGGAAGNGLDVTVISTGNISTGAGFISGGVRGTGAAGILAQSVGGGGGNGGFAGTLGGGKSIAVGVAFGGSGAGGGSADIVKVTSTGNISTNFDNSSGIIAQSIGGGGGNGGFSVAVTGALGDPDAATASVAIGGKGGVGGVGKDVTVTSTGTITTTGKFSNGILAQSIGGGGGNGGFAVAGSATTGNAGIGVGVGGTGATGSASGKVIVNSYSLVGANGQPVLLAPASNIVSIWTQGDNSSGIFAQSVGGGGGSGGFAGSLGVGLGGGGLGVSIGGGAGSGSTAETVTVTSYNNILTGGKDSFGIMAQSVGGGGGNGGFAIALAGSKDMAASVAVGGSGSSGGDAAVVTVTSHGNIETDGDGSHAIFAQSVGGGGGNGGGAIAGTLTGEGTGSLAVGVGGSGDNGGNAKAVTVSSTGDLRTEGLKADGILAQSIGGGGGNGGFSGALAITTGAGAIGVGVGGSGKGGGNADTVTVTSTGNIVTLKNGSNGILAQSVGGGGGNGGAAVTIAGSGQKAAAAVSVGGSGAKGGTSQLVTVNNIGTIDTTGDKANGILAQSIGGGGGTGGFAISGEMVVDGAGGAAVSVGGNGGTGQDGGRVIVNSNIGTTLANNNATIHTVGGDSNGIFAQSVGGGGGDGGFSGAVSVTGQNAKAAIGVSVGGSGAGSGDGKTVNVTSVDNILTGGNGANGILAQSVGGGGGNGGFSFAATIKGSLGKNPSKNGAVSVSLGGGAGSGGDAEKVTVDSTGIIQTSGNKAFGVLAQSVGGGGGTGGLSVAAALNLGEGGNQITAAVGGEGGGGGTGGEVLLTRHGSTITTGDQSVGLFAQSVGGSGGNGGMAISGVIAGTDAKTLSASVGGFGGAGTNASKVTVDNTGAISTYGVESDAIQAQSIGGGGGNGGMAVSAVIGSLGTGTNFNAGVTVGGFGGDAGFAGDVFVTNHGLLQTGLLAAGQTTTNGDGAYGIFAQSVGGGGGSGGNAITGVLGLKGNNAGTQVNVSVAVGGSAGNGNTGGNVTIRQYGGIETNGMGAFGILAQSIGGGGGTGGRANSISLQLGAKCTLPKVCEPAGGKPNWNLQATVGGAGGTGNDAMTVDVGNYDFITTDGDKSSGIVAQSIGGGGGIGGDAYVGTGGLLAIPYVPVDPTLLLKPLGTSSLTRSGTVAIGGNGAGGGNGGTVIVANEGVITTHGTKSDGIHAQSIGGGGGDGGDGEAGALGTVGLGGQGKAAGNGGSVTVTNGKANLSQAGAAIIQTFGTSPTPPAEGAPSADPEQGYSAGIFAQSVGGGGGTGGGAGGLLSLGGSGKAGGTGGHVTVNNYGGILTHADDSVGIFAQSIGGGGGAGGSLGISAIAVGGSGGASGSGGQVDVVNNAMIETHGIDSYAIQAQSVGGGGGSGGGKNGGITGSIPALISIGGAGGSSGIGGIVNVTNNNSLHTYGAGADGINAQSIGGGGGSGGRAIGFIAVGGKGGDVGNGTTAGSNGGGGAVTVNNNANGTITVEGIGAHGIFAQSVGAGGGSGGGAFGVSIVPVAIGVGGGGGSSGDGGVVTVNNHGDITTVSASSVAIFAESIGGGGGTGAMSVAASPAPGAFTFGIGGDGGANGKGGNVNVTNFSDGIIHTQGFGSTGIMAQSVGGGGGAGGASYSVSGGPPGLAIALGGKGAAGGDGGIVTVINNGAMQLDGDNSVAIFAQSVGGGGGSGGTAIAAAIGVPVFIGGDTGATGKGGDVTVTNTGQIRLTGNGSVGIFAQSVGGGGGVVTAGTDGIVQAVAGGSGNGGVVTINSNVAMLITGDNSVGVFGQSIGGGGGVGGFSGNYLGLDQVQSTSSKMAMAPQGFMGSAGGGGTGGAITFTQTADLAVIGKNSFALMEQSAGGTGNISDNGDINVTIASGVTIIGGSGAGGGIGYKDGKDNVLTNNGIVRSVLLIDGYAMRGGVGNETFDNMYLTVGSMDLGAGLNIFNNKTNAVYLMGDTVYLDLAGQFDNDGFAAPGGLDRVMTTDVTGNWSQSLGGVYLLDLDLDPEADRINVSGTADVNGLVSINIMNPGAAKPGNQDYIILEAQGGVTDNGLKLDTIPSAVAQYALKYPNPEDIVLNVDINFARTGLTENQTAVGQAINAIQTDLTSPNFTKIANAIFYIPTLDQLGAVYDTISGEGISGFQQPEFDANSTFLAQMSRQADAWRMGIATDPMSQSLKAPEAAYAEPPGKTNPFDALANGPNEQRWSYWATAGGNSGAVTGDPVVGSAALDYKSGNFAVGLDSQGDPDVLMGFALGGVAGSFAVPDRETSGNIIGGHAGAYGARKWGQFYINGSLAMDLYSNTTDRFTSVPGAPNPLNPVPPITREHWTGDFMSAGFGTSLEAGWRRPFGAGAITPFAGLQFQALAMQAFSEKSTSDGALGLDFDSRTVISLPVSLGLQLDTTMAIGESKTLQAWGRAAWLHEFKPDRSVEPGFQAAPGYAFVVQGAGAAEDAITVNAGVKLNWSANTSVFATFDGKFADRVQTYGGNVGFRVNW

SEQ ID NO: 17181 - protein, 414 aa, Pseudoalteromonas haloplanktis
MKFTKTLIAASLVLVSADSFAAAFQLSEQNASGLGRAYAGEASIADDASVVARNPALMSLFKEKQISVAGIAVLPDVSLKGTDTNNGLDPSVLNNDSIAPNAIVPAGYFTMPVNDKVSVGFGAFSNFGLATEFNGDYAAGQIAGETEIVTVNFNASVAYKVTEQFSFGIGLNYIYADATIIRKVGANPNIPASTDAVHLEGDDTGLGLNLGLMYQLDENSRFGFNYRSETDITFEGTFSSAAKLLPEMPGSVEITLPAIAEFSGSHQLDEKLGLHYSVMWTGWSSFDKLEAKVNGPAGEFTGFEKEENFSDSMRYAIGSDYQYSENLLLRAGVAFDESPADKNHMSISIPDTDRFWFSFGGNYAIDQHSDFDLGVSVLRGKTQNFTEKDNSQQEWSFESKGHALLVGAQYNYKF

SEQ ID NO: 17182 - protein, 439 aa, Pseudoalteromonas haloplanktis
MLKTRISLVALAMIAATQAQANEQAESKGFIEDSHANVLLRNAYINRDKKHGTDDQIEWGQAAIANFSSGFTQGTVGVGVDAFGLYAVRLDGGKGHNGGAGVDFFKPGNTKNADGNASGPHDLARAGAAVKFRISNTVLKYGDQMPSLPVLQYDDGRLLPESFTGTLITSKEIQGLELNAGRFTQEARKSAERRDGGGLKSINVFGGSYKFTDNFTASLYTADNEDVMKKHYLGLNYVFPIANDQSLTLDFNGYKSDIDKQYVQAAGLNGDSNTIWSLAATYAYGAHSFTLAHQRSTGSTGYNYGWYQNEGGVGDGGSTIYLANSYWSDFNAEDERSWQLGYGLDFGAYGIPGLTYKLAYVVGDNINTRNNANPQGFGEGKEREIFNQIRYVVQDGPAKDLSIKLRSSFLRTNNAVQQNGYNDDGNEVRVFVEYPISIF

SEQ ID NO: 17183 - protein, 351 aa, Pseudoalteromonas haloplanktis
MKLKSLTIAIALAATSVSTFAADKQEGFYIGAFGDYYDASWENMSAQAGLDVNESTGFGLEAGYRFSDFWSARLEYADLDFNAFDKAAGNRNNIDGSRFGIDALYHLDGGPFYGLVGIKSMDVVDDNTFLNAGVGYRHFITDNLFANVETAVYQGIDKGYTDVGAKLGINYFFGQNTMPAEPVQPAPEVVEVMVEPVDSDNDNILDADDKCPNTPMTDAVDGTGCTLYEDKEVTVSLLVTFPNDKAAVSQRYLDDIDQVASFLKDYPDTTVLLEGHTSAVGKATYNKMLSKKRADSVAKQLIADGIASDRITTVGLGEERLKNEANTAAAHAENRRVEAHIKTIKTVKVLR

SEQ ID NO: 17184 - protein, 739 aa, Pseudoalteromonas haloplanktis
MNKLQVSVLALAVTAALHAQAEEISSVSKSEQGSPPEKTEVIVISGSRMEQEIQQVAGSILVIDEAAIEKSMSNDFGSLFRNESAVGVKGGAGKPTTVTIRGIGGNRVMMVKDGVRVNNQYASPLGPGAEGTGRGLTEVQSLKQVEVVKAAASTMYGSDALGGVVVMRTKDASDYLMGDETYLSVNGGYSGINNEYSAGFTAANSVGNFENLLTYQRREGEETQNYQQDLPDSDLVQDSILLKSKYHFNDHTSLQLSVDYLEQKLERWEPMFDDSSALTEQIDTRRDTQVLNGALQLRSDKPSALHDNLTVVMYYGATKQNEDRDYYSFDGNKQSTNDRNREYIFEDERLGINSTFNKYIGEESYGHNITYGMDLELSSMLRHRTYAEQDSGEWLVSHPFTFADTDSQRIGVFAQDDIKLLDGKLNLIAGIRFDNFENTPDKSTLTSEQDPANFDAMSESFWSPKLGLIYHITDDVSVYGQYTYGYKMPTPDQKWGELVINEPGMPMEVLLKPNYDLESEQSNTFEAGVRGSHNDTSYELTLFYSQVKDYIDWQFLGMEMFPQMNLQYGYFNREEVKLYGFEAQVNQWIGDSLELWGNLSYTHGEDENGDYLNSVSPMRGTLGANYYTELAGMEADVATVVRFADQMDRTTDLDIFPGMDTFNSVYNTPGYAVVDLTFGLRLNDSWKLRTGVYNLFDKEYIDYADVAGQSKYLLNSLGTPDTNFTQPGRYFNVSVNYQF

SEQ ID NO: 17185 - protein, 1048 aa, Pseudoalteromonas haloplanktis
MKTQLRKKALTLAVAACLGVSGAAMANETSSAVKGQIMGPNGNPAAGTKITIIHVPSGSTKIVEVNDAGYFSVKGLRVGGPYQVIVDSDTFEDTLVENIYLSLGNDYPVNVALNAKTNMEQIVVTGSAISTMSGGTGPASTFTLSDLESAPAINRDLKDIVRADPRVYVDDSRGAIQCGGGNPRYNSLTLDGVRMNDNFGLSSNGYPTIRAPFSFDAIEQVAVELAPFDVQYGGFTSCNINAVTKSGTNEVHGGFFYDFTSDSLKGDEIKDEDVDNGNYTEKRYGFNVGLPLIQDTLFLFTSYEKLDGIKQLQYDGLSTGSVSQADLDRIINITRDTYGYDAGSMPGSMPVGDEKILVKLDWNINSDHRASLVYNWNDGYNLSQSDTGSDYVSLDSHFFEQGAEFTSIVGSLYSDWNSNFSTEIRIGKSKLDARVESLDAASGFGEFRIDTTDGGRVYIGPDDSRQSNDLNYDTTTFKVAGTYYLDQHTLTAGYEFEELDVFNLFMQHSQGEFVFDSVDDYAAGLAGDVYYNNAAGTNNPDDVAASFAYAQHTFYIQDEYSFDNIDATLSFGLRYDKYTSDDKPNYNKQFEDRYNFSNQKNMDGIDLLQPRVGFNWSASEDLEVRAGVGLYSGGNPNVWVSNAYSNDGITQIGRYAGNINLFDIPMTNGGKPGYEIPQFMYDDIQNTPIGQGDGTVNAIAPDFEIPSEWKYAVGATYVLEDDYTVSVDLLHTQKRNSAILTDIALRDSGKNAFDGRPIYESIEGRSGELLLDNVSGDDGESTILSAALSKEYDSGINFTVSYAFTDSKDVNPMTSSTASSNYGNLATTNPGNPGVATSDYEVPHRFTLQLGYKVELIEGYTTRINLFGQASQGQPYSFTFDGADSQFGDANSNRSRQLVYIPLVDDPNVVYTPYSKDPVTGKETGFDKALFDQFIESEGLTRGAIAGRNSNNADWFTKVDLRVSQQIPGFMDGHKGEVFFVINNLTNLLNSDWGTMEKGGFVGNRMVKAKVNAEGKYEYNTFNARNANLSVQRDASLWEMRLGVNYRF

SEQ ID NO: 17186 - protein, 809 aa, Pseudoalteromonas haloplanktis
MINNRTTEQQNNRTTAFSLAFSLLLCCLGINAEQLELDEISVMGKVPEGNSISFLKVSDAIIDGEKFKNRSATLGNALSSELGVHSTPFGGGASAPIIRGQEGVRVKILQNNADVVDMSNISPDHAITADTLLANQVEILRGASTLLYASSSPAGIVNIVDQRIPNKMPKKGYEVTLSSRFDTASKEKVYALGTTIGIGKHLALRLEGLDRQSQNYKVPQIKLGETLNYVPDTYHQSKVGTIGLSFIGEKGYLGASYNQRKDRYGLPGHNHKFDTCIAHIYDMRLQGKHSYTNLYPHLMSDEMVTENPHFHCGTDYDLDPSHSHDHPYGHDHDHTHIGPWVDLHSKRIDIKGEIKQPLPMLDKIQLSYAQTDYYHDEKDAGKSGDTINPNRVDKSKDFGKPVNIFKNQGKNARLEFFHTPIGGLTGMFGVQYQTLQSSANTPNNREVQWPLVDNRNKQISLFALEQYAWDNFAIELGLRTEKQNIHIDYDLAKIQKQQKFNERTYGKQVDPDLSDYDEKAISYTGAFNWFFHPDYQLSFTASHNERLPTPMELYYHGQHLATNSFEYGNKDLKKEISNNFELGLGYHTEKLDYKLSTYYNNFDNYIYNETLYRSNNLFMRRYNQAKATFYGLEGIINYRFTPDYQFSVFGDMVKGKLKQLPDIKGLNDVYGEPILNPDYDPEYDEPEDQYYRPYLGKEMIKQADRVSPRLPPIRLGARFNAQLTENLSGSVEWMKVFTQNKVSKLESSTKGYQLLNASLNYRRQIKGVEYTVSLTGNNLLNQAVYIHNSYHPYVPQMGRNFILGLDLSF

SEQ ID NO: 17187 - protein, 701 aa, Pseudoalteromonas haloplanktis
MHNALFLKNKLFIALSVTLGAFPGISLAMQAPLSDIEHLEVAGQRPGDHQQLGSAERLLGKQGVDFSAAGGMAALPVLNGMMGDRIKILVDGADVSAACANQMNPPLSYVSASQIRSVSVVAGVSPVSLGGDNIAGVIKVSSLVPRFGQSDSVQWEQGSLSAGWRSISHSQTYSASASASSKDLSFEYRGAFEDAESYRDGHGNRVTDTLFRAQNHSWLAAWQDEGQTLALKLTHQYIPFEGFANQYMDMTDNKGYGAQLNYDRKLASEGEFSAQLNWHLVQHKMGFFSDEKPGKMPMETEGSDYSYQLAWRLPESDGDVWLWGHEFFNQRLDDTWPAVPGSMMMGPMDYVNIQDGLRRRVALYGEWQHNFSPRWWLSSGVRFEYVTTNTGEVQPYSRMPVMGMPNPDAAAASTFNSSYRKQSDALLDATVLARYQGGDNWQLELGLARKNRAPNLYERYSWGRGVMASTMVGWFGDGNGYVGDINLRPETAHTLSLAYSYAGEDMQLGAAAWYSDIRDYIDVEVIGSFSRGGTDGSRNLLQFTNLDARLYGANLYVNYRLSEGQSGRWSVEAEATALRGERKDGSEPLYQIKPLETRLALAHRLGDWQTALEWQWVATKDEVDSRRLENTTDSYSLLNLESRITWQSLTLTLALNNLLGHYYQLPLGGVSVADYRNNKDAGFAPLAGAGRSLELSASYRF

SEQ ID NO: 17188 - protein, 318 aa, Pseudoalteromonas haloplanktis
MLNPLRRHASCRTLAVSLWLAGVTGLPSAFAQPPAAPADDSAQGESLSADVQPAKQGAYLSDWYNQDLMLIGSKDISFGPRPADDIYLEYEYFGRKGPFELYGYIDLPKILDIGNSHDKGIWDHGSPLFMEHEPRISIDYLAGRSLAIGPFKEWYVAFDWIYDHGSRTANRANTLYSGLGTDIDTHSRVNLSANFYGRYQWENYGASNEYSWDGYRAQLKYIVPIDSFSNGASLTYIGFTNFDFGSDLHKDNPARTANATVATNVLLYSFTHLRFTLVGRYFHNGGNWEDGSVLNFGDGEFRTRSNGWGYYAGVGYQF

SEQ ID NO: 17189 - protein, 695 aa, Pseudoalteromonas haloplanktis
MRITILASVVIPCLGFSASCMAAEDVMIVSASGYEKKLTNAAASVSVINQEELQSSQYHDLAEALRSVEGVDVESGTGKTGGLEVSIRGMPASYTLILIDGVRQGGSSDVTPNGFSAMNTGFMPPLAAIERIEVIRGPMSTLYGSDAMGGVVNIITKKNADKWHSSINAGLNQQESNKWGNSSQFNFWSSGPLVDDSVSLQIRGSTQQRQGSSVTSLSDTAATRIPYPTESQNYNLGARIDWKTTEQDMLWFDMDTTRQRYDNRDGQLGSLTGGYDHTLRYERNKISAGYDHAFTFGTWKSYLNWNETENKGRELVRSVLKSDKWGLAGKPRELKESNLILNSLLLTPLGESHLVTVGGEYQSSSMKDGVVLASTGETFRQKSWSVFAEDEWHLTDALALTAGSRYEHHEQFGGHLSPRAYLVWDVTDAWTLKGGVTTGYKAPSMGQLHKGISGVSGQGRTNLLGNPELKPEESVSYEAGVYYDNLAGLNANITGFITDFSNKIVSYSIDDNTNSYTNSGKARLHGVEFAGTLPLWSEDVTLSLNYTWTQSEQRDGDNKGAPLSYTPEHMVNAKLNWQITEEVASWLGARYRDKTPRFTQNYSSLSAVQKKVYDEKGEYLKAWTVVDAGMSWKVTDTLALNAAVNNVLNKDYSDVSLYRAGSSTLYAGDYFQTGASTTGYVIPERNYWMSLNYQF

SEQ ID NO: 17190 - protein, 846 aa, Pseudoalteromonas haloplanktis
MSTYRLNTLAAAVAFAVCAPGVAIAQEAPVQAAKNIEQISVLGSRVSNRTSTESSSPIDLIDSDDLNKGGYTELGQSLQATAPSFNFSRTQVSDGSDLFRPATLRGLQPDQTLVLVNGKRRHNQSIFGLNGTVGAGAAGTDMNAIPLTALKGVEVLRDGAAAKYGSDAIAGVINLSLNNSTGVTTGFVQYGGTSEGDGDTVTAGLNRGFELGNEGGFINLSLEYRDADGTNRAERDTGGSLNVEPGTLSEDVRWGQGNADSEFTSLFYNMALPVGDSELYSFGGFSERSALGNGFYRNFNEASKNVTQVYSDGFLPRIYNEAQDLSFAIGFKGDINPDWTYDVSAVYGENQYDFTSRNTLNASYAAEYLFNNPEASDADIAANAGPTGGYSGGFRFDQTTFNADFNGIVDIGRSEPLYVTIGAEYRKENYEIVPGSQASYACGLANTDTSYPSVNDENQFAQCGFQAYNGLRPEAANKSDRNSYAIFVDVETMITDAWNVSGALRYEDFSDAGDDLIGKLATRYEFNDDFAVRGAVSTGFRAPSLQQSGYTAFTTNLGSDGSLTQSFTANTGTAFPSALGVDTLELETSTNYSAGFVYDVSSELSLTVDFYRVEIKDRITLGSLLSADDVSFSPDALAALQATGAVQANYFSNSVDSTTQGVDIIASYRTEIDGANLGVTFAGNLNDTKIDNVNAEEGIPEAVAFDDLQRSFFTDGQPSERATLTFDYAREAYTSTLRFNYFGETDVKYFGNDHISLPGELSPTGSFKPTSTVESAVLVDVNVSYDINEMFTLSVGADNVFDETPDELGDDEVLNFITNGAFKYPVRALPYGFDGRTYYAKVSFEF

SEQ ID NO: 17191 - protein, 171 aa, Pseudoalteromonas haloplanktis
GEFLPLFTNIDGATGAKKKTADTGTTTDLYKASFMAGGGAFGYKMDDIRVDIEGLYSQLSKDTLEKAPDPAIAESLTAFSGLVNVYYDIAIEDMPITPYIGVGVGAAYVSNPLATKVTDDKASGFGVAYQAKAGVSYDVTPEIKLYAGARYFGSCGANFGKTTKDDAGIKV

SEQ ID NO: 17192 - protein, 1812 aa, Pseudoalteromonas haloplanktis
MSTCLLTSSFLSTSARAASFKDLVSKTPAWEKHNSTQQQNIWKDLTPNEKIKKWQEAALVPSFTQAQNDLGIKYKETDLSSFLDNTRHKARQARAEILLYIERVKQQDFDTKKQEYINQGVVPTDIEAATNLGISYDPSKIDNNVEHDQKVRRAEKDKKAVIELYISSINRDIKYKHYVDNDIIPEMQEVRTALNMNKDEAQSFVASIRTEIMENAKGQYIADSHIPTEKELKKKFGISRDDNRDGYIKSIRLKVMDKEKPQYIADSHIPTEKELEQKFGADKGEATNYIASIATQMMLGKKSYYIDNNIIPNADELMNEFKIGPVKTASYINQIRAGIEANQFLNNNDTTKPSTGRSQKKSGSKNDHWYMSNQSIHNTGTSSRIFTGREKKQRYFFDPISTFKTHFNTKANKGNLTQSQHSINRIIQQEENIEEFKNLIKTDPIIALTLQVDSSYKQEAVTTILSDFNDDTIQRVLFSNDKGQLDFNTNIDVKNRPILQELLENSSSEEKTKFAERIQDYATRNISNSQFEEKARLDLIKLAASKDKSSVENFLTLQLELKNIMQPYIVNSVYILTPEIVKEINIELKNKGLIRDSLTKDYMIKLAKEVSNHTLNSVIKVILSDSNILSNETNKILGLAVGNNANNLEQTQSGIPNPPPLPLNGGIPNPPPLPLNGSMPPPPPLHSQGFSSNSKHFDLNQLQTEYPHIHSLYIQFTHNTTVQSKAPLQPTASSATSTVRSTPETAYAKLYAEYRTETGGTKANDLQDQLIKRQADLTNVIRQILTESYANQGADEKTLLNLFSISTPEIAEKAKEAFNTLAQDQYIKDITVNGKKTITSEEIIKNLFNEDTDDAVKRILLSSCKISEELKRPIKLQFNQSELIRELQGKQNPFEQLEFAYINAKNFDQDIFGNRVDELINNPNILTIVQQATFLITEDTNLRKTINSDQAQAKLDDLRTAILSTIKFEELITANLPQHDFIAIVKEKDPELLKEFLKATTLKVTGNNNLDQLRLALPSFKGMSNEQIRILSNKLKMPIILKALKECSQEKATKYIHTGNMPPPPPPLPDSQDLELAYLTSLGITKFNANTSTLKTTPKTYHFSSDIALRYKEFTLSGQKSAGYKAKYSDADLLKKAIVESVAFEHSKNLSKAHQNNKYFEQIQEAVDTMYSSFIGPRTEIGQKIHNIYTSKLLELTKDKEFIKYVEDNIILSKKLTEAFTSADSDFIDSRTGLGQKIHDIYIQQLTKYPEEEVKEAFNTANPDFIGPRTEIGQEVHNIYKSQLLELTKDQELSLFTQQVLAESTELERKYGSDIQSGNSNNEKKVGRLDQEKLQSFKQENEATNDASSTKDDTQPEDSNKKSEQSDSKTALSPRLLSSNDSKNDKSSDDKKSLLALRSSDEDDTGYATDEEELEESNSTTNEELEESNSTTNEELEESNSTTNEELEESNSTTNEELKKDVVLESEDEAIDVSFKTEAITEQDEVTQRQQISDDTSGKVAILVQATSTLHKPVHYNINDRLTVAAIGAGDEETSINRGVWISGLYGINKQRIWKNIPKYQNRTTGITIGIDAEFINSHDVIGIAYSRLESQIKYNKKLGKTTVNGHLLSIYSLKELIKGFSLQTITSYGHNYIKNRSKNINNIIGKYQNNNLSFQTLLNYKYRTKYDLHFIPNIGFQYDYSRASNYKEYNVDIENLMIQKKSNQLFESSLGGKIVFKPIVTTNNIVLTPSLYGNIEHHFNNKNTKVNAKATFKGQTLQETIITLKQPKLGYNIGSNILMSRKNINVLLEYNYYTHRKYQSHQGLIKLKVNL

SEQ ID NO: 17193 - protein, 1006 aa, Pseudoalteromonas haloplanktis
MLKSKLSHLSLCVLTALTSQVVFAAEQTEVKEEEVERISIVGSNIKGSTMTSVLPVTELSAEDIIATGALDGDELLRSIPQIGAVGFTGTRGGNTGTNAARGDVGSVNLRSIGEGNTLVLLNGRRMVNHPITQTNFGVPVTSVNSNTLPISGLARVEVLRDGAGALYGSDAVAGVVNYVTKEDFEGGNFKVRYGAEQGTDRNDFTLSGNKGFEFNNSQTFFMISANYAKKTGLQASENGFSSNQDLRSRAPEEFAGDTDFDNRSTLEPYADLHYIGLPSKIDDYIIRPTSYINNAGEQQSAGSCGGGALASGGGVMGDVCLDAAGSHDRALRPNRNEERTLVPDIDRLNLFTNLSHEFNNGVEFYNESTYYRSKTKRQWEQSAILSNGTFDVPAHSYYNPFGPVNFADGRVNPNRIAGLDPAVVPVEGLAYNLRIRPTDVGPRQVEVESTSYRFLNGLRGTYDDWDWDTGVLYSEAKTDDNMSNRISSPLLLAQLSLDTADAYNPFTGVNPNNPASIIDSTPNPQSSIDPFLTTAQRSAKTSLTMVDFKASNPFMFELPGGEAGLAFGLEYRKETLDEDNSSNFDGSEPFVEGNADPVNLSSLQGSSVRLDVSGERKVLSAYVELALPLLADLPAIHSLDVQLAARYEDFSDIGNITRPKMAVSWFPVEMLQFRGAVSKGFRAPNLIQLNSPGATLTTGVDDYAENSLDANGNVVVNSDTLADGGSGNGNYNLSTSGNKDLEAEESENISVGLTLQLMDNLTFTYDWWEIETTGTVGVLSDENISRLDLIARGEGSSNPDVIRGAIDADNPLGEIVQINRRYENLNTRTITGYDIAINYDLNTSVGDFGLSLNGARTLKFDQEAGGDASLIVDAGADPAVLGTAVGDIVGTSSIPEWQATASLKWKSNDALWGAGLFVKYVGEVDNTSVSKTVDSVTTFYTSKAQTRANTYVTRNDFMGYEGVSLSFGINNIFDQEPPLADTTFGYDGSLHSSRGRYFYTSANFSF

SEQ ID NO: 17194 - protein, 693 aa, Pseudoalteromonas haloplanktis
MKYQTVTLSLLSIISMGSFAQEQESFEHIEVNYRQAYRGDVPVSEIPQAITTLDRSLVDDINISRFRDILLFSPSIALQNDGGNLWDSYSMRGFPGNENVPTGYLVNGFSSGRGFGGHRDVSNIEYVEVLKGPGSALYGRSDPGGVINVVTRKPQYAPEGYLKTSLGSDDRYRLEGDYTSGLSDSLAMRINGAIQDDDSFRDHVSSKKKVINPSLRWQLDKDTSILYSFEFMQQEQLFDRGIVVLDNNIKTVPRERFLGEPSDDPTKINSQGHQLTFEHYLQNDWFLTGGINARSTKLDGYSSDAELSGSRQKLFEDGRTLTRQHRRRDYDSDDLSVRLELSGNTELFGMTHHLLMGADAYRYDLYTLLARARPEPGTYELDIFNPQYGAAKPELQTQYINDENQKGFGLYVQDQLELNDQWHLLLGLRLDQYTQETLELVSGTESEQDDSRVSPRVALSYLPTDNLTLYASYSEGFVPISGTDFEGQGFDPEESDSVELGMKYSAHGFRLNAAVFDATKTNILTDDPAHPGYPATLGAATSRGFEIEGGMSLGSYTDLQVAYSYIDSETKNDITVYDWGVNVPAGSDLVNIPQNTFNAMVKHDLRHWQINADIGLTARYVDDRLGATVDQSYRLPSYQVFDLFYTHRLTDNTELQINVDNLFDEYYMSNAYSALWTTPGAPRQFSVSLTYEF

SEQ ID NO: 17195 - protein, 800 aa, Pseudoalteromonas haloplanktis
MFKPSLLTLAIAAALTSPLSVLADEVGANKEKSLEVIEITATRRSGSVQEAPLNITALDADLMKDQNISELADIARWVPGLTITDQGGRSGSPIIVRGLNTNSSGPGSDGGTVATYIGEIPVSIDMRLVDVERVEVLIGPQGTLYGAGTLGGAIRYMLKSPDLDLTTAEVYGDLFQGKESNNLGGETGFIVNLPLIEEKLAIRASLNFYEDPGFVDYNYVVREPGISQPDIDWTDSSALANNFKKMADANGETTTTGRVSVRWKATDWLDATLNYFYQKQDTEGRSIVHHNALNPSNGLNSVIGKYESAYRYDEPRDKEDSLLSLELKADLGFAELVSATGFSSFEAVGQRDQTDLLIRLDYGYEEFPSFSAFTREEQEEETFTQEIRLVSQGDSPLSWIVGGFYNSFESDSTSKEFTPGFGEFAVENFDGEQARPDNLEYYSVDRSDVTEQAIFGEVSYAFTEELTVTVGARLYEYEVNSESAVDFPLANTLFSGAGVNDISLNFKEISASDNGNLFKFNANYQLSDTVMAYLTVSEGFRIGGSNGLAPCPDPLPDKQIGCGQPAEMLYTADTTTNYEVGFKSTWLKNRVHFNAALFNVDWDDAQIAGATVVGQLPYTSNAGTANAKGIEISSRAMLTDSITAYATYAYTKVQLTSDAPYLFNTDGTDGGVDGDRLPGSPENQFSLGVNYQTDLYEDKTLDINYGFTAQSDSISKLGLHANGETLPGYGLSNISAKVTADVWSATVYVNNLFDKYTYTSVRRDVADITTANGAEIQRNYGHYINRPLTVGIKFNYQFEL

SEQ ID NO: 17196 - protein, 2365 aa, Pseudoalteromonas haloplanktis
MNTARSKKASEPFPRLLLPTGVFLALSGAGIVPAHATCSQAGTTVTCSGVANPLAPSFSSNLNNINATVNPGASVGVLLGLGGTAMSLTGNNTTLTNNGTIDPSALGSGLGVLSSGAVIGNAAASSVNVTNNGVMNGSTGVAISGVTGMALSVQNGTGGTSTITNTGSIGSSALVGATLIGADAPVVAAYGGGTVNMTNSGTISGRVSFGSNNAPGGGNTFTNSGVINGSVSMGANSTNTFNAITGSQVNTAGGTGGAFNITVGANTLNVAQTGIVDGGSGGNNTLNLQQGASANGTIAVNNYINFNHLNVQGGNWTINGASTAQDATLSGGVAIINDNASLGTGNITGNGGALQAGTAGLNVSNNVSLGVGGLTVQGTTGLTLSGTVSGGGALTKNDGGTLTLSGANSYTGGTNLNAGGLVIGNNSALGIGTLNVNASASLDTSTNVTLGNTVNLASGSTLSIGGSNSLGLTGAINGSGGLVKNGAATTTLSGVNTYTGGTTINSGTLALNGAGSLSATGTVNLTGAGATFDVSAASGAQTIGSLAGAAGTNVNLGVNSLTLGGTGNATYAGTIGGSGSVTLSGTGVQSLTGTNVYTGGTNLNGGNLVVGSNTALGSGAVNVNGSSTLDATTNVTLANGVNLATGTTLTLGGGTDLGLGGVISGGGGLVKNGAAALTLNGANNYTGGTTLNAGSLVLGNGSALGTGALTVGGAATLDTNASLSVGNAIGLGTGATLTLGGSNALGLSGAISGTGALVKNGASTTTLTGANTYTGGTTINAGTLALGAGGSLSSTGTVNLVNAGATLDISAGSAQSIGALSGGVGTSVSLGANALTLGGTASGTFSGTIGGTGSLTLAGTGTQTLNGANTYTGGTNLNSGSLVLGNNGALGSGALNVGGAATLDTNASLSVGNAVNLGTGAALTLGGSNNLTLGGAISGAGSLVKNGVATTTLTGANTYTGGTTINAGTLALGAGGSLASTGAMNLAGVGATLDLGGATGGQTLGALSGVAGTNINLGNNALTLGGTASGTFGGAIGGTGSLTLAGTGTQTLNGASTYSGGTNLNSGGVVLGNNTALGTGTVNVGGAATLDTNASLTVANAVNLGTGAALTLGGSNALDLSGAISGAGSLVKNGAATTTLTGANTYTGGTTINAGTLAVGAGGSLASTGAMNLASAGATLDLSAATGAQTLGALSGVAGTNLNLGGNALTLGGTASGTFSGAIGGTGSLTLAGTGTQTLSGANTYTGGTTIGGGSTLALGAGGSLASTGTVNLAGAGATFDLSGASGAQTIGALTGAAGTNVNLGGNGLTLSGNGSNTFGGAIGGAGGLTLAGSGTQTLTGANTYTGGTTISGGGTLALGAGGSLASTGAVTLAGTGATLDLSGATGAQTIGTLAGAGGTSVNLGANALTLNATTNGTFGGAIGGTGGVTVAGTGTQTLTGANTYTGGTTINGGSTLALGAGGSLASGGAVTLAGAGATFDVSGATAAQTLGTLTGAAGTNVNLGANALTLNGSGNGTFGGAIGGTGGVTFAGTGTQTLTGANTYTGGTTINGGSTLALGAGGSLASGSTLNLAGTGATFDMSAASGAQTIGALSGVGGTNVNLGANTLTLNGSGNNTFGGTIGGTGGVTLAGTGTQTLTGANTYTGGTTIHGGSTLALGAGGSLASTGAVNLAGTGATFDVSAATGTQTIGALSGAAGTNVNLGANALALNGTGSSTFGGTIDGSGSVTVASGTQVLTGGNTYTGGTTIAAGGTLQLGNGGTSGSVAGNVVDNGALIVNQSGNVTIASVLSGTGSLTQAGSGQLTLTGASTLSGPTTVSAGTLAVNGSLGQSTVTVQSGATLTGTGTVGGLVVQNGATAAATQPGAALNVGGNVTFQPGSTFQVAATPQQSGSLAASGTAMLNGGTVQVLANQSAYQPSTTYTILSASSGVQGAFTQVSANYAFLTPTLSYDPGHVYLRLVQNGTSLPDVATTPNQRSVATALGGLGAGNPLYDAVLTTDAPTARRAYGLLDGELQASLKSMLLLDSRYVRDAVTDRVRQGLAPGSGPLAALSSGGAALCGDNTAGVADPTLPPERRIGSRDGCYGGTPYQPVVWGQAFGGRSRLAGDGNASTINRSMTGFIAGADMALNDKWRAGLAAGVTHSSLDNDQSSSAAVNSYYLSLYGGAQYGALGVRGGASYTWYRINSDRYPGFAGFSDHDSAGYNANSAQVFGEVGYALPVGPVAIEPFAGLAYVNLHTDGYTETGGAAALRAGGETTHVGFSTLGLRAASQLGSIASGTFTARGTVGWRHAFGNVRPSSAFTFANGGTSFQVSGVPIARDSAVLEAGIDANVTKRLTLGLTYSGQYGSGVRDNAILGNILWKF

SEQ ID NO: 17197 - protein, 711 aa, Pseudoalteromonas haloplanktis
MKLSPITAAVLSVLTANFVHANSEVTQFDEVVVTANKVEQPLSKVAGSITVINGDDLETKGTTELYDSLNKEAGVSVTGGAGRPQNITIRGMTGNRIVIVKDGIKSSDGYGASDINDKVGRNSFDLSNVKSIEVVKGASSSVHGSGAIGGVVIIETKQPEDYLKGNDFYSDVSGTYTGISNKYKGSSNLAFRSGNTESLINLSYWQGEETRNYQQDLYNRNVDGVNGAYTVNHYIGEELMLTAKIEYYTEDMLREEGSASIQKDGIWHISTYNHKENTQDINAYIGAEYTPYDAFFEKLNSKLYWRDTTTSSDINRLMSRERNNIVEKRREIKAQSFTDQLIGFDNDFISSATLLNQVHNLAYGLSLTSNQYERPNSKSTIDWNGNNVNHTQPFAPARAYSLGIYLRDMVEVNNWIITGGLRFDAHSLTPSDSDSIAGFSVKKINSSELSPSVSATYQFTDTLNAYLSYNHGYRAPAYDKAYGYNNHDFVPLTPFLIIPNMDLEAETSDSIEHGIKYDSGKTQIYGAVFYQKFENFIDVIQVGMDPSTGNYLKQYQNISGVETYGAELTLAHQFTQEWGINSKIGYVDGKDGDGEYIRTITPLEGNVGITYDLEKLSAYSSLNWASSMDRVPQCATNIGMATECATTSSWATVDLGVNYAVTTDFNISANIINLFDKEYIRYQDVAGIMDSAKGYSTEPGRYFTVNAKYVF

SEQ ID NO: 17198 - protein, 902 aa, Pseudoalteromonas haloplanktis
MKQDRLFQTLLLTGAFSLLLTTPVFSKEKQKIELQPFDTSDTSINSQKIQHSKIKVPLTGSQKLVQSTEQAVILITSVKVNRTDKGVEFILETSKGEQLQVSAKSEGNTYISEIRNAQLQLSNGQTTFSQDNPTAGITLLQVTNQDQNTIRVTLIGESGLPTVQLFDSNEGLIFEAASTISPQPPQANTEFQPPEPEQIASEPPLPEDEGIELVVTATRTEEDVVNIARSVTVITRDQIEQQSKLSTNLADILAKTVPGFGSPTNRSNTFGQTLRGRNISVLIDGVPQNANLQSIPAALTTIDPSAIERIEVVRGPNAIYGGQATGGVVNIITKRPSGQRLTSTTNIGLDTSLTRSEDSFGYNLSHQISGTEGIFDYTVGFSLVTTAGFYDAQGDRIANFSGDEDSRKINALAKIGVELSPEQRLQFTFNHFNQKQDTNFESDEAIDDIPGIQKSRVLQIPEGTTVIGADYGSFINNTLLSLNYTNDNILNSKLQAQAYYRNYGFGGGLPSDNRGGRLDAITQSEGESEQLGGRLQVETPFNSEQTVSLLWGVDYQNEQSSQKFNIFDGDELDASGGRVFRKIDERVFVPEYDFSELGVFGQLQWEVSDNLRLSGGLRYVNIDVSLEDYTTAESPRRDIQGGDRSFDSTVFNTGIVYKFTPEVSVFGNFAQGFSVPDLGRVFRRPPGGVVNILDSLQLTEPQKVDNYEIGVRGQWDNLQASLAGFYNYSDLGSAISFNANTDFLETVRAPQKVYGIEAAVDVQPSEGWNLGGTATWTEGENDEDNDGEYVALNSITVPPFKLTAYIENQTLEGWRNRLQLLYSGNRDRGFEDGVEDGKISSYVTVDYLSSIKIGEGELQIGIQNLFNNQYFPVYSQYFSPFFDSANYAGKGRTLSFGYRITW

SEQ ID NO: 17199 - protein, 519 aa, Pseudoalteromonas haloplanktis
MNLMKSLYLGSAAGLVVMSGAHAADLPLKAKAVEYVKVCSLYGAGFYYIPGTDTCIKLGGYMRADLGVNTNTIFQGNTGLQAGAQNRSGNAFTWRARSDLTIDTRTATDYGVVRTFFEGVFTWTSGGYRGVRVGGSAYDGNPNGGVLGGQLGVFHAFIQFAGFTIGKAASQFSAPWGQYPGNIYDGLVGGGGALTGVNQFTYTTEFGNGVSASIGVQDPSAYYQPGIQNLSVYPGFNALDAGGFGSAQPFFGPVALGTLFFGYGLSAYGGTTFPDIVGQLRVDQAWGMFQASFAAHHNNPAYYTGLETSGGPGGKWGWAGQGALSIKNIPTGPGDVINISGVYTNGATRYNIQDMTALAGANTIYGGSGVGSIGFGYAPDSVYFPNSQLQLVSTWGMRGAYTHHWNPYWSSSVFGAYASISYTGEAKSYMCGVSIPRALGAGFTACNPDFNIAQVGANLRWTPVKNLTFTTEGVYTMLDQKHAGVANVPNNFAVYKPTGNYQLRDQDIWTVMFRAQRTW

SEQ ID NO: 17200 - protein, 277 aa, Pseudoalteromonas haloplanktis
MERLLKKGVSAFFLGASLNANDWTYTIVKKEELGHKRFLKKKCLKNTARHPCFARPKRAKRKPLNLDKNSYYYGTSVVQMSWLESKETFKNHSEYKNIPFAEVSLIFGYKHFFPKKEHYGFRYYAFLDYAYGFLPKSKSDFKASLRESLQIPKSYQNKLQKKETFINTLIYGMGADIVYKRAFGTLILGVNLVGETWFYETNIFKQWAKNPLNTYHPNMFQVMLNAGYRYRFSRHKNWAIELGTRIPFLINRYFKTPLYSLYFKRNLSIYLTSTYDF

SEQ ID NO: 17201 - protein, 389 aa, Pseudoalteromonas haloplanktis
MKLRNILMACAGITLLASSAFAGPTWTFGPEDEGLLKLDYKGQFQLDYRDTGSGSGGDDDTMEFNFRRNRIALVGAYGNLGIYAQTEYTEDVNVGPFEVSDGSSNEFRMLDAQIRYKFNDAFRVRAGKFKYNLTRENLEACEAPLTLDRSVLIRAPYVGTRDKGVAVWGNLFNDVFQYRVDVMNGRNDSESAPDSNFRYTGRAHVTFLDGETGYGYKGTYMGKKKVITLGAAYSVEEDVAYADVANEADAVDYKAWTVDFFAEYPIEGVGTFTLSTAYVDYDLDDGYQGADPDSGICGVLGEKNGGYTKVAYMLPETPLQFFFRAENWSLAELDGVYDQEIDWYGGGLNYYFRGQNLKLTVEYSTVEFDEETADYEDFDSLTAQIQVVF

SEQ ID NO: 17202 - protein, 806 aa, Pseudoalteromonas haloplanktis
MNINHKRDASRMLATVSVAVLALTSTSAWAQEAPAPAPADETIYTDDAIVVIGVTKQSANIQDTPIAITAFSGEMLTEQGIGKVEDIATFTPGFNIRGAGNNPTALTLSMRGQIQNDTLATLEPSVGTYLDEMYVARAYGLNVELVDVESVQVLKGPQGTLFGRNTSAGAVLIQTANPRYDEFSGKVSATYGRFDERTGQAVLNLGLSDSLAIRGALYYQKRDGFKTDVDTGAKYEGRETWNGRVKLGWRPTENLEIILSGEWYDTFIDGPARQNLFFNAPPNFGAAKPIVDGIAAADRAQFDGNPNRVAITPPGAVPGADPRGIFNDTRTQTYSAKFILDTSFGQIRWINGYRGVQSENLIDLDGSSFRAHFTEGRQDLKQYSSELQLTGTVFDDRLNFASGLTYFRETGFDQSRSNLFGATFAAGPTVPAQFVGATSWSNFSGSLDNDSFGMYAQLNYELTDALRVTGGLRYSIDDKRVTTQSGNVANNTDVFVNCSPPTVAVPCLRSSQETFTNLSYTIGVDYDVTPDILVYAKHSKGYRSGALQLRTLTLADSIPSQPELVYEQEVGIKTTFLDGRGTFNIAGYHNVVKDAQRSPVLAPNGQSQTVIENADTETWGLEADASIEVADGFTLFASGALTDPKYTRYEGRGVSGAFGSQVIVPIDKSDYDFVGIVEKQFSVGANLSKDLGSVGLDANVVYAWQGKMPQIELPEALLTSTGIGGLGLTPAQAAQVAAVSDSGSLGILNARVALKFGPEKNFELALWGKNLTNDQEQQYTLLLSNIYIGTSYNEPRSYGVTASYKF

SEQ ID NO: 17203 - protein, 1134 aa, Pseudoalteromonas haloplanktis
MKTKLNGKLLPLRKGVLIFIMRVFILFFCISSFGFSSNELFSQNAKIKIEKSTTISVEDAFQLIKEQTDYTFIYPSNLFDGAQPLRVKAGIISAKDLLNRCLALVDYTYEFTEEHVILLKEKDVFFDSETKTISEQSTVTGVVTDSKGMPLLSVNISIEGTNRGTQTDFDGNYSIEVAPGEKLSFQYIGFQKKTIEVGDQQIINVTLEDDLESLNEVVVVGYGTQKRSDVTGAISSVKSEELNKVVSTNPLDAIQGRVSGVTVTNSTGSPGSAPEISIRGIGTFGNNEPLYIVDGVQADPYFINTNNIASIEILKDAASGAIYGTRAANGVVIISTKKGEEGKPRIDIESSLSINTPREEMQLLNADEYISVHRQMYENAGAELPQYVVNSPINDTDWIEETHRTGYLSTNNIRISGGGKNINYSVGGNYADEIGLLIGSNFTKKGVNSQLNLDKGKLKVSTNLNYSETYREDHKFSIRETYFISPLIPVFDEEHESGFGYRTGDLPDHRNPVGEDQFLEGYTKLKYFLGNINFDFEAFKNFHIGAGFSVSDLQDYTYNFHQPFRVRDVQDIAEREFSFISEFHSEFRRLNEEYTVRYNFEIDKHAVVLLAGYQRIREPFKSTYAQAEGYKLDDEGNKVAATILDPNFNTLDAFSDGTYSASGSNAEYALVSQFGRINYAFDDKYLVQASLRRDGSSKFGKNNQYGVFPSFALGWKITEENFMENQEVFNFLKLRYSWGQAGNDSALGYYDYVALISQGKSQDDGGYVFGSPQNSYLGSIARDLQNDDLQWETNTSANFGLDFGIFDNKLQGSLNYYNSKTEDLLITKEVSPSAGINNPIVNVGAFENNGFEFEANYRNRDNEFKYAVGGTFTTINSEVTKLSNEDQVLYGVGLLFGSDHFVNQTKIGYEPGAFFLPVADGIFQSDQEVQTHSVNGNLIQPNAEPGDIRFTDQNGDGVINEDDEVYAGTAIPKYEYSLNLTGEYKNFDLTIFFQGVGGNKIYNGNDFRLLSLDTGRNYRTAALDAWTPSNTNTDVPRAVLNDPNRNNRASTRFLEDGDYLRLKTLQLGYTLSPDVLQKTFIESARIFVTGQNLFTLTDYSGLDPEVGGSVLSRGIDLNLYPKYKSLITGVQLSF

SEQ ID NO: 17204 - protein, 937 aa, Pseudoalteromonas haloplanktis
  misc_feature (754)..(754): Xaa can be any naturally occurring amino acid
MYFDAGESEDFCIQYSVLQDIGVTVSGNQDECANLDDELNLRTRFDFYSKRMDIFVSPKFVPRKKNGLAPIKLWDEGENALFTSYNFSEDYYHFKGDARDSYSQYANIQPRLNIGPWRIRTQAIWNKNNNTKGEWSNNYLYAERGLGNIKSRLYIGDGYFPLKNFNSFKFKGGVLKTDENMYPYSEKTYSPIVKGSAKTQAKVEFFQDGVKIYSSIVPPGDFSISDYILSGSNSDLYVKVIEENGSIQEFIVPFTYPAVAVREGFTYYEIAMGETQQSNDYFTQLSFTRGLPYDFTVLTSLEYSGFYRSLEIGLGKMLGNLGALSLIYGQSNFSKSDNSKNKKWDIRYNKNIPDLNTYLSFSAVSQTRGGYSSLRDALDYEIGEYTFNSKNSYTASINHSLGELGSLNFSGTWRNYWENKNQTRSYNLSYSTQIFNGKAYLSGSLIRSELMNFNNKISDTILNIGVNIPFGLSRGIQSVSYNTSSVKGGRSTHQLGISGSEFDNKLYWHVNQGYSDNYSNTSMYGYYKAKYAQVNAGYSVSERYNHAYGGIEGGILVYDGGIILGRNLGDTMSIIEAPGAENTKIRGWGSIETDWRGRAFIGYLSPYQNNDISLDPSSLPLDSSLDITTNSVIPTTGAIVKTTYNVKKGKKVMLTLKKSNGDAVPFGAIVTVMDGDQNTSIVGDNGQLYLGSSMDTGRLKVIWGNGEDKKCVVDYIVGDNKNIAGIYIGSAEHVFSSMLLYGKKISFLSASVWXVIGVVKAFLTTLQSNNEWRTHSEKNDFSIDFDVGVGRSFAAVGPTKDMSLGANLTSEPTLAIDFTPIENIYVGANYGKDIGTLVFTTNDLTDITLMSSRSVVDGRQTGFFTFMDSSATYKISTKLGSSNDVNIQEITQGAKITPVSGEKTLPKKFTLKLHAHRSSSTVPDTYTVGLNVTSNVI

SEQ ID NO: 17205 - protein, 790 aa, Pseudoalteromonas haloplanktis
MSSSHQRAGRSPSAVLSNLLGATLGLAMLSAAHAQPGVSAAAPDASSSPGATLPAIDVNAHSSPYRTEFLQSDQFTAPLLDIAQSVAVIPKKVLDEQQAQSLQDILKNVPGITFTSGEGNLGWGDMFTIRGFSGEQSMTVDGIRDAGLAGRTDTFNVERVEVFKGTGTIESGVAAPGGSVNLVSKEAHAGDAYHLSTTLGTASYRRVTADLNKQLTPTSAFRLNLMRHYNAVDGRAVTDYDRWGVAGSLALGLGTPTRVTIDYLHQNDVNTPDTGVPIERGTGGARMPGVPRNGWYGDPNLFTDREVTDRATVKVEHDFNDNLRMSSISRFEQTDRITVLSPARFNSTGGTSYGYTGTGPLVTSSAGLASYSGFAPIANASPLAVLRGSNYGTSKRYDIVANETNLNLSFDTGGLHHDVVTGAEVYHERYGDLARTILAPSVNPVMNLTNAYGTNMVGVPTLEGGAGDYASLTDAGVYLRDTVTVTPKWIVEGAVRYDRFSLKQVNGAANAHTVARSNDGALSGRIGITYKPVPFGSLYATYSRAAQPSAVGATTNNVIYGNTSSQDLQAAVAQTWELGSKWDLLDHRLSVTGALFRTELSDSWDYGDGTTTVVRALPPRRVDGLELGVSGNLTDRWSAFAGFAAMRGRITKGANAGLRPANVPNATFNLWTTYAVTPKLSVSYGAQYVGTRRYTDNRYVGGQSNNSSTVNGASGKHPVYVADGEKAPSFWLHSIAARYEVDKHLTFGLNVQNLFNTFYYSAIGASLDGFQLYGVPGAGRTVMATADVRF

SEQ ID NO: 17206 - protein, 1358 aa, Pseudoalteromonas haloplanktis
MNLRLPLPLRRALLAAMCVLGSQTFAAEYTASTLEEFQTAWNQMADGDTLTITGSIDFEGVELGSLPADASIVLKSDGKGSISNFNYKDMSAVNMQHLNVSGRGTVHVGNMTEGMLSGWDEEGNTLSIENASTLEGTWLVLENNKLVAGDGAVLSRNEVTTGHSASIETRIDPETGAFISTVVTSTPGEIAMDLGKNVRIHEMDLSMNDGVRGQIVSHGDISLSDSTLISTGAVNTTSVYENEDSGVLIGQSETVGAHGGIDFSAGAVTMQDTNLSTVGGDSQSTGGEILLGDNSTLTAKERAEITTEALVLSQGIARQDEDGTYLPGTSMEETMGLFGDITVGNGSSIENYDMDAQGSIFIGEGAKLTSVTLDAVSVELDSLSITEGEDGIRTVRMTTGAGDQATVSIGANSTLDDVDIYAEGGNIYIGSNTEITGDNDLSGSQMADIWAGDTVGSIGDDGASTRGTVSFEGTIKQNAEGDYVLASGEYAEGTYGGNVVIGDNVTLTMTTVAAENTITLGDNVTYQGTEDAPVYHMSAFSDADNSLIRASIIDTDENGNILNGTVTVTERENKITTGRGNTFMNSKAPGRSAAMDISRGGALYAHGDIVIGENNSFISNTAAGSGGAVFAQNNIAESITYTDGERTSKLTTEVLDITVGNGTVFSGNTAGANGGAIASELTSNLAQQDGDNVEDLFENEGANIWLGRDVTFTDNAASGLGGAIHLMENRILLIGSGAFFDGNTAGEEANDIFAEDGSVILADTDANDITIINSGISDADYYSLDDGPWTRGAATLIQAGGGDLLYGGSDTEDNGFGGTLIQQSGAGSLIVGHLAEVDDIMVMEGAQLGVEDLTDYEMNGAGVILTEDSVLAGDTLEINGNAVIEMGEGSSLLLNDIAFNGHSSIKLWNIDEAGNGRDLTHTAAGTSSVDNVTITGAEVSELPLFNTAFVSTSATPHENGTIRLTQNMHGVAAPMQGYSGNISGAAAGMEQVRTGVRDGSAAHRFFETLLGTSSADAAAAMIQSVSGETVINAAWASNDALKGFAALGRTQGGISAAQGLNITAAKPVQSADAKGSPIAMAPVASGRGSVWVGGLGSWTDQHSRSGIDGYKYDAGGYAVGADCKLSSSVLAGVAIGQSYGTFQDKGGLSSYDADSFMAMLYGRYTPAGTSKLSLDGYAAFGTTSFDGKARLADTSAAGKFDSDSFGAAIYATWTEQFRNKLVIAPFAGLEFMTGKTDSFSEHGDLARTFSGARAQNWTLPVGITLSRTYAAGTNATLTPSVTVAVTQDLSRLNPKGTVSSDLGAWTARGVNVGRTALRVNAGISAAFGNRWGARIGYSLESRAGLTAQGINGSVSYSF

SEQ ID NO: 17207 - protein, 695 aa, Pseudoalteromonas haloplanktis
MKFKLNLITLALLANTGFAIAADGYGLANANTEKVKMSAWSCKGCVVETGTSGTVGVGVGYNSEEDIRSANAFGTSNEVAGKLDADVTFRGEKGYRASVEAYQLGMDGGRLEVNAGKQGQYNVNVNYRQIATYNSNSALTPYSGVGSDNLTLPDNWVTAGSSSQMPLLMDSLNSLELSLKRERTGLGFDYQGESLWSTHVSYMREEKTGLKKASGGFFNQSMMLAEPVDYTTDSIEAGIKLKGDNWFTALNYNGSIFKNEYNQLNFDSAFNPTFGAQTSGSIALDPDNQSHTVSLMGQYNDSTNVLSARLLTGQMSQDQALVTSGYGYQVPTEALDAKVDLIGLNLKVVSKVTNSLRLSGSYDYNDRDNNTQIEEWTQVSINNVNGKVAYNTPYDNTSQRFKVAADYRITRGMKLDGGYDFRRDERNYQDRETTDENTVWARFRVNSFETWDMWVKGSYGQRDGSEYQASEWTSSETNSLLRKYNLANRDRTQVEARVTHSPIESLTIDFGARYALDDYTDTVIGLTESKDTSYDANISYMITDDLLANAFYNYQIIESEQAGSSNYSTPTWTGFIEDKVDVVGAGISYNNLLENKLRMGLDYTYSDSNSNTQVRQGITGDYGDYFAKVHNINLYAQYQATEKMALRFDYKIENYKDNDAANDIAVNGIWNVVGFGDNSHDYTAQMIMLSMSYKI

SEQ ID NO: 17208 - protein, 391 aa, Pseudoalteromonas haloplanktis
MKLNRFAAVALAACSGSALAQSSVTLYGVVDANIEYVNHVGAVPTAANGFNPGPGHDVVRMNSGGLSGSRWGIRGVEDLGAGTQAVFVLENGFSGDTGTMQQSSRLFGRQAFVGIKNATYGQISLGRQYTSLFDSIVNFVPAYFATQYEPITLFAGANFREDNTIKYTLNAGQFTGVAHYSFGTGLALPQTVQSGLAIGGNGEVPGQARRDSAYGASLSYAGGSLWAAIAYDQFNPTIGTTTSASSGSFKKATAALSYSLPWGRIMGGYRWGQNKTPAGATIGRDDFFWVGGIYQVGPALSLTLEYDYDKVRNVFGNTSVANPWQVNLIADYSLSKRTDVYLSAAYAKNAGLMLDSALIAYANSLSLGNSYVLGNGNSSMLGVSVGVRHKF

SEQ ID NO: 17209 - protein, 753 aa, Pseudoalteromonas haloplanktis
MAHIKSRKHPIGRRLNCSAAVALAVMTLPAAYAQQTGDTSAQKAATLPQITVQGAVESYKADSVASPKFTQPLVDTTQTISVVRKEVMQDQAATTLTEALRNVAGVGTFFAGENGNTNTGDAIFMRGFDTSNSIYVDGVRDLGSISRDIFNTEQVEVTKGPSSTDYGRSAPTGAINMVSKQPTLTDAASGTVGFGSGSYKRATIDLNKALTGIEGAAIRLNAVVQDAGVAGRNEVENNRWAIAPSIAFGLNSPTRTFLNFLHVDQNNVPDGGVPTIGLPGYSASAGSRVNSKNFYGTPYDKDNVTADMVTLRVEHDFSATTTLRNTTRWGKTSQDYLLTSFMAPVTTSPNPANWTVARSSPTFKDQTNEIITNQTNLTTSFETGSIKHSLSTGFEITREEQKNVGIGTTGAWTAANLYNPQMNATGLGWAPNGADSKGSTDTVSLYAFDTLKLNEQWQANIGARIDHYKTKYNALGVCGGARGPACGALPTGSLVPTANHLQASDNIVSWKAGLLYKPAPNGSIYVNYAVSKQPPGGSNFQLSAATNNANNPNVEPQQAKTAEIGTKWDLLDKKLMLTGAIFSTEVENEIVTTSDGTVDQTGKKRVQGIELSATGQITRDWAVIASYTYQDSKVAQGNNLAQDGSNGLTYTPTDAFSLWSTYQMPAGFTVGGGARYTGGLKRGTDGAVGTPNFTDAYWVVDAMATYRINKNVDLQFNVYNLFDKEYVAAINKSGWRYFPGVERSARLSANIRF

SEQ ID NO: 17210 - protein, 277 aa, Pseudoalteromonas haloplanktis
MKFVALLAATAASVLAVPAVAQDNRDPSRDFDGPYISIGGGATLQGNDRGETLVFDTDRDGTYGDTVNTAGGTNAFSPGFCNGAATSTANVGCRNDKDGPEFFGRLGYDKRMGNFVLGAVVEGGHSVARDSVSGFSTTPASYTMSREADYQANARLRAGYTPGGGALFYVTGGGAYARLDNRFTTTNTANSFADNGKTNAWGYTVGGGAELMVTNNIGIGLEYLYTDVKDKDYVVNVGPGSAPATNPFLLNGGGTDIRRSDPHFRTHSVRGTLSYRF

SEQ ID NO: 17211 - protein, 401 aa, Pseudoalteromonas haloplanktis
MINNKKTGILSATLLGLTLMTGTAFAGPRITFGPEDQGALQIDYKGQLQMTVRDTGSGENNDDTTTNFNFRRNRLAFMGKYGEMLSLYVQTEFTEDQNVTTLGVASTNQGTEFQLLDAVMRFKLNDSFHVNAGKFKYNLSRENLEACEMPLTLDRSLFIRTAYTTTRDTGVAVWGNLFNDIFQYRVDAMEGRKAVSGDTAPSSNFRYSFRGHVTLLDPENDYGYKGTYLGKKKVLTIGGAYQFEPEIAYGDTVTRTDKKDYQAWTIDGFFEYPLEGIGTVTASAAYEDVDLDDAYKGANPDAGTIGLNGQKNGWYVKGGYMLPNLPLQFFGRYEKWRFAELNNISDQKVDWYGGGANYYFRGQNLKLTFEAAHTAFDKDGTVNGVTSKDFTTFVTQLQLIF

SEQ ID NO: 17212 - protein, 418 aa, Pseudoalteromonas haloplanktis
MNTMRLAVLIGGCLACGSLFSVASFASTSYASTSFGSPNTVDNTIKDNTRKKESWRENLASEHNLTLGLDYQVLGLSASSPTEGGDDNSAAGVARFYGSWNLTGLESGNVGGLVWKVEHRQAYTDTAPKSYSFIEPGLGYIGMIGPTYSDQGGRLTNLYWKQQFNQGKTALMAGYLDTSDYVDTYALASPWTGFTNLAFSTGAGAIGLPDDGILGLAVGHMLDENFYIIAGAADAKGRSDKPLDGFETLFNDHKLFTTFEFGWTASQEHIYTDNVHLTLWHIDGGTQHNLTQPSESGQGVNFSASFFVTPQIMPFIRGGFSEGDVALYDKSLTLGVGYFGLGAEKNNLGFAINFSEVNENLGKAYGVTDDKQFTSELYYNMSLGEFVQLTPNIQYIDNPAISTEKDTWVFGLRARVTF

SEQ ID NO: 17213 - protein, 678 aa, Pseudoalteromonas haloplanktis
MIKTITTSSALALICIGKPAFAETSEKASQTSADAVVAGNDIVVFGRGEAMIGTAKSASEGSVGGADLLVRPLLRVAELLEAVPGLVAAQHSGSGKANQYFLRGFNLDHGSDFSTYIDDVQMNFRTHGHGHGYLDLNGLIPEIVGREDFRKGPYRADGGDFALAGAAYMTTIKGYDRPWASAETGSYGWRRVAAGGTLHDLGGGDLTLVAQAKAYDGPWQEPERLRHYSGFAKYSMPTGAGTLEASLHAYRATWHPTEQIPERIIGTALCADVFCSPDPSARGETTRLVANIAVKQPTWRANVYAQFYDWSMFSNPTYTDPDGTSAQIKQFDRRWVLGLSAQKHWEIADSLAVSLGTENRYDAVGNVGVDRTAARAFLESLGHFRVGELSSALYGEVAWKPLAGLRVTGGLRGDYYHYSVRARDSVAASLGEGSGSASILSPKASIAYQVTPHLELYANWGRGFHSNDVRGAVNRDTPVPVLVRGIGKELGGRIQFSGVTLTATYWWLHVGSELRFIGDSNAVEPSGASGRHGYEIVAFWRPFPWLALDGNYTASHARFDNGDHIPNAFENAASAGAAIILDPWEASIRVRHLGPSPLVEDNSVRDRGSTVMNARAAWKGKKVEIFGEVLNIFDSRDKDIAYYYESYIPAFDAGAPVEGRLSRVVEPRTVRIGAKVNF

SEQ ID NO: 17214 - protein, 325 aa, Pseudoalteromonas haloplanktis
MALLRVAGDHERSFSKRMIRARRPLPSHSVSVEAKQRKPRAPQSDAAGDWARFFPRHVVRQLQQFAFMLLNGTVPGAPKGNNTRMKKILILTACIGALCAAAPSFGTDLAGQPVKVKAAPLPVAAPIIDWSGYYMGANGGWGTSHNCWDFNGITSEGCHNSTGGTVGGQIGYRWQIFNMVYGLEGQGNWADFRGSNVSTAFPTDTVGTTTDAFGLLTGHIGYAFNAVLLYGKGGAAVTSNTYYVNSVATGTELGKNNDVRWGGVLGAGAEVSLTPNWSAGVEYNHLFMQRSNISFPAALGADRAHQDVDLITARLNYKFGWPFAR

SEQ ID NO: 17215 - protein, 1049 aa, Pseudoalteromonas haloplanktis
MNMQPMKLNNIQTGFKRILLTVATVFMLGNGWAQDAKVLKGRIVNAEGEPIAGAVVNVAEASRIALSDKDGFFTLKNVKPADELYVSSVGYLPATAIADFDENFKIVMDADLDEYAHTTPLPFNRKPKKFVTESTSIVTGEELEKHPVTVLQNAFTSTVTGVETYEAQSEPGWSETAMYIRGIRTMNASARSPLIIVDNVERDLSFLDAYPIESITILKDAAATAIYGMRGANGAVLVTTKRGETGKTKINFTQEVGFQTIAGIPESQNSYNYALSRNQARYLDGLSPEYSDEDLKYYRRVCNGEQLEGMAKYKYFNTNWHDTMLRDAAPQYRTNLSVSGGNARARYYVSFSYLRQEGLFDTKWTEWNEGYSTQEVLNRYNLRSNIDIDVNKFLNVSMDLGGRIDNISQPGIDVWNLFTWGAGENLPVYPVFCPNGEFFMPTSSDSKNGAAQIAGRGVEQNRRRNLYTTVTATGNLDALVPGLKAKMTFSFDSYETFQKVQQADVNVYYYNYMADVNDPSEYTYQRMRTYKALPNATTSPRDYYYNLNMNGGLAYEHTFGKHAVNAQAFIRTYQNVVRGQESSNRYLSYNAQATYVYNNRYILSGNISRMGSDNYADGERFGTFPGGSVGWVLSEESWLKNSFVNLLKLRASYGRAGQAVTGVSRYPYQGTFTEGGGYNFGTSQSYTEGVYESTAGNKNIKWEISDMANFGVDFDLWNKKIYGSVDFFKEWRSNILVSRSTVPGLFGVNAPQDSYGKAETKGFEITLGHSNRIGDFEYYIDGMLTFNTNKITEMDELTPDYAYQARTGNRIDQSQLLIWKQWASNPDLIPESYEDAVANPQKYPWNAAGKYKLGNAVFQDTNGDRKIDSYDKVPTGYTNIPELIPTIRLGFSWKGFDARAVLTAYLNRTVPCRENMDYGFGWGGTSTHEITNTWGYYTDDPTDPRNINAKYPRLSTSFSDLDRNYPYNESTIWVVNGDFLSLRNVEVGYSLPARLISKVNMTKCRLYFSGYNLCNWSHLPKGFDPENPTNYIWAYPKTRSFTFGVNIGF

SEQ ID NO: 17216 - protein, 821 aa, Pseudoalteromonas haloplanktis
MKKSTLFYVLFTCFLYQVSAQTATVQGIILDDAKTPILGVNISSSNNGTETDINGTYSLKIPSNQDVEITYSHVGFKNIKITVNLTSGDIYEFNPLFKTDIEQISEVIIKTGQRQRVEGIVTLAPETIRKIPGANAGVETLLKLLPGVSNNNELSTQYAVRGGNYDENLVYVNEIEVYRPFLIRSGQQEGLSFVNTDLVRNVEFSAGGFQAKYGDKLSSVLDITYRRPVDFGASLEASLLGGSISVEGISKDDKFSGIVGLRYRDNGLFVNSRETETNYRAGFADAQTFLSYRVTDKFELGFLGNVSVNDYNFEPQARQTNFGTLQDPLALVVFYDGQEEDRYETYFGALKATYDVSDNYTAKLIASTYNTQEQEHFDIFAEYRLGVPNTDIGSEDLGEVEFTRAAGSQLTHARNDLDALIFNLEHKGTISINDHLIDYGIKYTHEDIRDRQQEYEVVDSAGFSIRPPFSDFANDQPYQAFDAPLTPYSSVRAFNETQIDRIQAYAQYGNKTVIGNTEIFYNLGIRAHQWTVNDNLTNTTESQAVISPRAQFAVKPDWEKDMIFRISGGLYHQPPFYRELRDSTGTVRPNVKAQQSVHLVLGNDYSFKLWNRPFKLVSELYYKSITDVNPYTVENVRIRYAANNNAKAYAYGLDMRLNGEFVPGTESWVSFGYLKTEENINDRGYIARPTDQRLKFGVLLQDYVPRIPSLKMYLNLVYNTGLPGGSPNYADPYDFQTRLRDYKRADLGIFYVLADQNKTFSKGHWLHPFKELTLGFEIFNIFDVQNSITNTFVRDASTQQQFAIPNFLTPRIFNLKLGMRL

SEQ ID NO: 17217 - protein, 718 aa, Pseudoalteromonas haloplanktis
MAHKFLVSTLATAVALSISATAMAKDMGKVERNFEQITVIGSQQAINDIPGSATFISDAELQKFEFTDISRVLASVPGVYVQEEDGYGLRPNIGMRGTGTGRNDKISVMEDGVLVAPAPYSAPSAYYFPTMGRMESIEVLKGAASVKYGPRTTGGVLNLLSRSLPTEPNSSTGMLDAALGSDGYYKGHAYFAKEKNNTAGLIEVFTYGADGFKDLPVGDDNTGFEKTDLLLKLGHTFGKNDAHNLELKIKYSDETSDETYMGLTDADYQATPYHRYAASQNDEMNTRHNAYQLNYAYRFGAGYELLATAYLNDFHRNWYKASKVSESYLEQYSEFEANPTTQGIEGIAIKANNRDYQAKGIQSELHIPAGNHYITVGMRYHEDEMDRFQWQDEYTLNQDLSMTLTERGVPGSDSNRVDSATARTLFIQDEWTLDALVISAGLRFEDITITREEWAKSDPTRSNGLTKNVSNDTDILVPSLGATYTVNDNITLLAGIQQGYAPAAPGNADQEEEKSVNIEFGSRYNVSGINGEIIAFYSDYDNMHGNCTAAVGCSDENIGDQYNYGEVAVSGVEFSAGHTFNTDTVMFPVKLTYTYTDSEFKNTFDSEIWGTVEKGDAMPYVPKNQVALSMGAELSAFVVHSQLRYVSDSHADLTDSGLNAINSRVVWDLAAKYRIDDNQKVYLSVDNLFDKTYIANRANGGIQPGKPRTLQLGYTYSF

SEQ ID NO: 17218 - protein, 803 aa, Pseudoalteromonas haloplanktis
MLNKSKLFLALITLGASKILLAAEGPVTTLNTIVLTAQSDELGSELLGKSLNVSNQFIDTSKLKQRSTTLGDALGTELGIHSNQYGGGASTPIIRGQEGKRIKVLQNNADVLDMSNMSPDHAVTVEPSLAKSIEIIRGASTLLYSSNSAAGVVNVIDYKIPTQMPQDGLEGNTTLRFNTGSNEKLTTAGVTVGLSPHVALRAEGLYRNAGNYKTPHYQSSSYNSLEDLENQNSIYKNLKYLPESWAESRVGTLGLSWIDDNTYLGVSYTHRHDEYGLPAHSHLYEGCGASAIGIDSRISGLKNYLLYYPQLMDEQDINYINPRPDCHQHNHIHETNFSHNAPYIDLNTRRYDVRGEFTQPFTGIDKIRTSLSYIDYFHNELEGDKITNFFKNTGKVGRIELSHQPLGELTGILGLQYLEQDNSALSPVHSQEGHTTYLDNQQLLNRNVTKNFSVFGLEKYNWNDFTFELGARIEKQKVSMDYDIEKIKDSMKPWPNKYNSPYVEKNNKIRAQNLKSILEAVQPNKETAFSYAGTVHWRFAPNYILSLTGTHQERLPNAQEMYTHGMHLATNSFEIGNRFLRKEKSNNLEISLAYKDDLLDYQISTYYYDFDNYIYLQTLNEVLGTTKVRDQHTLRINHYSQSAANFYGLEGNIGYQFNSVYHGSLFGDYVKGRLTNLPDAVIAYDIWNREPTLAPQKDRYTPRLPPARLGTRLKADFDESLKGEIEYYRVFKQDNISKFEQVTSGYNMLNMTLAYKNKLSHTEYDLFFKANNLLDQKVYAHETFLPYIPQIGRNFSLGLNLNF

SEQ ID NO: 17219 - protein, 774 aa, Pseudoalteromonas haloplanktis
MKRHYLGIIALGALGLQNVYAEDIKANENDTIKTYNMGEVIVTSSTKETNNLRTLPGSVSILSPQMISGRQIDALKDISSFVPNLYMPDYGAKLTSAIYIRGNGARSSGQSVGLYVDNVPYLDKSTFDFELTDIQRIEVLRGPQGTLYGRNAMGGIVNIYTISPFDYQGKKLSLSAGSYGQYKVKASHYAKLSETIGFTAAAYYDHSDGFYTNAYDGKKIDKEDNVGGRFKLEGRFNPNFRASYSLSVDYTDQGAFPYGMFIGTGNTDHKYVNPININDPSSYKRTVIANNLSLEYRNEHVILSSITGHQYFKDDMKMDQDFSPLSIFTLNQKQKQNAFSEEFAIKSNTRNNYQWSFGLYGFYDDLHTDGPVDFKEDGIKTVLQPVFDQLKKDHPKMPYLKILDDYLYIPGSFDTPSYGLALYHQSTYNNLFTEGLSITAGIRLDYEKQKMDYNSEAKMRMGFGFVENGPVIDIEKLFPIPTTVMDASVSQDFWQVLPKVSLKYECSPNTFTYVSVAKGYKTGGYNVQMSADVMQSQMQYDMMSAFKDMMPIEVKEPTPIEEVASYKPEKSWNYEIGIRSELLFQRLSAELTGFYMDIQDVQLTKFVNSGNGRILTNAGKAKSYGIEASLRARIIDGLTADVNYGFTHATFRDYNNGKEDFKNNFIPYTPRHTLNVGLQYTRLFRYAWIDQFSASAQFSGVGKIFWTERNDIYQKFYGTVNAKVGVRKGIVNVNLWSRNITNTHYSAFYFESFGNPFIQLGKPFQIGAEVAIAF

SEQ ID NO: 17220 - protein, 453 aa, Pseudoalteromonas haloplanktis
MKFTKNFFTPTLIASALALSTTYANAAAFQLAEVSSSGLGRAYAGEAAIADNAAVVATNPALMSLFNTKQFSIGGVYVQSKINMTGDVDVQLMGREVAKGNATKKNVVPAALVPNMYFVAPINDKFAVGAGMNVNFGLKSEYEPSYDAGVFGGTTELTSINLNLSGSYRLAKGLSVGAGLNAIYAKAKIERRAGILEKAIRSAVQQLRGDPSLQGMVGKLSNVKSDTIVTQLQDNNAWAFGWNIGAVYEFNQGNRIGIAYHSKVDINFKDSDALSSAGLIRGKGGLTLHLPDYLEFSGFHQLTEKFAMHYSYKYIKWSRLQSLHAVYDDGTEAFHKDEKFNDSSRVALGATYNVNDKLTLRAGIAYDESAANEHPSASIPDTDRTWYSLGATYNFTPNLSVDFGFAHLRGKKLQFKETQKIEIIKGTNFGSIDANYKSTARANLYGLNLNYRF

SEQ ID NO: 17221 - protein, 116 aa, Pseudoalteromonas haloplanktis
MLNSVGNSADMGDSIALSLGYQADSIDTLFGWTSIVVLDEDNVVAGAAKKEGYDVHNLYAQWTPYSVPNLVLTFGVDNVFDELYVSHASRVGLAKSFVADDYEPGRSYKLSAAYQF

SEQ ID NO: 17222 - protein, 1164 aa, Pseudoalteromonas haloplanktis
MSTKLLSETICRKGLMVKCFVALIVFCCSVGEAFAQTDTKVTINVNNVLIRTALDQLQREAKIHFVYDEENIDSGKRVSLFYTKTSLNAVLDDFCKQTSLRYEVKRNLILILPSKVEKTTGKHEPFYMTGVVMDETGESIIGATIMIGGTSQGTVTDIDGRYSLRVTPGDLVSFTFVGMADKVVKVQAGKKVVNVKMETNATALADVVVTGYQTLSKERATGSYSVISEKSTKGKLETDVLSRIEGLVAGINKTSSNSNDVVIRGITTYMGNTKPLYVVDGMPYEGDLASINPTDVQNITVLKDAAASSIYGARAANGVIVITTKRGQEGKTKVSYNGSIKLSPKPDFDYLNLMSSSELVDMQIEGFDYYHTAYENLNKRQAVNPVVSLLYQHERGQLTDGQLADALLPYRTNDNRKQIEDEFARVGIVHQHNLAISGGSNKNRYMATVNYMGDYGNQKYQSKDRIGFSLKDDVDFFDWLSADFGVTGSFYRSKGDNGAGSYSSLMSSYPSYYMLRDLQGNPLDFQRTKSDYELQRLQSIGLMDETYSPIKNRAEESYHNNSNYYRLHAGLKFKILEGLNIDLKYQTEGTYDKNRTLYSNMSYKVRNMINDAAQYDAATGSLTLNVPKGGQLDESRYESYSYTMRAQVNFNRILGKHAISALGGAERRLVRRTGAQNYYMGYDDNSLGVKPINPLVMSPINGTEALLGSFNWVYGEYNALTHTEDRYVSFYANGSYTFDERYSLTGSIRIDQSNLFGTDPKYQYRPLWSVGGSWQIANEPFMEDCTWLNRLNLRMTYGVGGNVPKNAGPYMTVVDSGYNDWVGDFGSYIKNPPNSQLRWEKTASTNVGLDFSVFNSRLSGSIDYYYKKTTDLLGNRNADPTLGWASLLQNYGSMFNRGVELSLQSVNIQNKNFTWGTNLMFSYNKNELTNLEGTKETVFYYSAYNVAAVGYPINSVFSYRYAGLNPTNGNVLVYNKEGEKVSKVSSIDDMVYSGTRTPKYTASLKNFFSYRDFDFSFMFVYYGGHVLRDVVAGYMGGAPSANLTRKALNHWRKPGDENIPGVAPSFNRNIYYTDAQTWYSADIHVKKADYIKLRDISLSYNLPKNWLRKYFIESAAVTCQISNVWWWAANGDIDPEAYTTSGYGWGALTLPNPTTYTIGLSLNF

SEQ ID NO: 17223 - protein, 864 aa, Pseudoalteromonas haloplanktis
MLNNKVSKAVRLAIAFGAASTAAFSASSFAAEEDSAAKVERIEVTGSRIKRVDMAGDLPVTVIDRTAIELSGETSVADLLRNTTFNSTGSFRPRSGSSAQGATTVSLRGLGSDRSLVLVDGRRLPKSTLTGSSQDLNSIPMAAVERVEILTDGASALYGSDAIGGVINVILRKDFNGAEVTLGSGRIEHEGGDRENGSVLFGATSDKSRVLAGASWSGRDIVYARDFPWYSPGGSVYSNNFTTFTTTDGERASNFDFFSPEATCEGVGNENFYRIGARCGFNFAAVSADEASIKNRSAFVKASYEVNDDWSIYTDINIAQTKSFGRYAPGLDTTAFDGSTDTVFVSADSPNNPTNPNSPIYDASLEMEQQDLDFWHRFAALGNRDNNLSTELKDIGFGAKGMIGDVSVETGVRKTINESHNVGTGYILRSIARQYINDGTYMLNDPFGASEEVRGAMTVTTSRTGKFNQEEFYANASFDIVETDAGAIQAFVGFEYRSEDYADVYDSLSAAGQVGGSSGSSAGGGRSVRGLFFETLVPVTEEFELNFAGRYDDYSDYGSDFSPKVSARYNPIDDLVLRASWGKGFRAPSLPDLTQQPSESADSVSDEATCLAIGEDADCSSQINALVIANPDLGSEQSDQYSLGVVYQVTDAISVELDYYNIEITNRIRAFTAQSIIDARLRGDSVPDAFTVSRSPNGAITSLVRGFGNDGSLETSGIDFKANSMFDFGDAGTLRTNFNLSHIVDFKTDGGRNFVDDPGVPQMRLNLSNVYSISDFDFTWNLNLIDSQCEDITADGECEGHIPSWVTHDLQVAYNTPWNGKVSFGAQNAFGKEPPLFAFDGRPYNFDLYSGFGRTMYLNFKQSF

SEQ ID NO: 17224 - protein, 448 aa, Pseudoalteromonas haloplanktis
MYAFSSRLEYDFDDMTVTAQTSYARLNDQNDYNFPDARIASDFSGLPPEQFLDPATNFIDWRKRDSRLTQEFRLGSLPGADIGWLAGVVFYQDRARRDRTSEMWYFGPSASGSTDYDLKTTGQALFGEATIPLNERLQLTVGARATREDKDFHSEYHSNGAEGAVPYFRESGSEDYRFLTGRTSLSYRWTDDLMTYASVSRGYKSGGFGLGSSLMWSGVPREPYDSSTVMSYELGMRSNWLDDSLVVNGALFFNDMSKEQMQSWDYENFTGKNLNLDARSAGFELDARYLASRNWWMEVGVAYTYSSLRHVSAEAAALQDGLRSGNRLPSVPEWTARTALGYEALGRELGFSGWLAEQRVNAMLTYNFVGSRFTDASNFGRLAPVHLISARLGIDWGDGEFYLFGDNLLDKRYMTIKDRFGTDPQGQPVYGVSYARGATLGVGMVLRF

SEQ ID NO: 17225 - protein, 330 aa, Pseudoalteromonas haloplanktis
MKLKSLTAVIALAATTLTASASMAEDVTVYGKVNVSLNKLDYGVNGDDKWELESNASRFGIKGSYEINENLKAIYKLEYEISVDGDDDEFKQRNIYGGFQGNWGTLIAGKHDTPTKIAAAKVDRFNDLANGDIKSFFAGENRVGNTIMYTTPKMSGFSATIAAIQGEDTNEVDGPTDGASLALTYRAEGFFVALAHDSDVTSKDINGDKYLTEITRLVGEITFGDLKIGAMMQDAEATDEGVDVQQNGYLLSSQYKIDQWVLKAQYGTTENDIYFVDVDATQIAIGADYKLNKRSKLFAYYSAIEYDTSDGMITIAPENQIVGIGYEIKF

SEQ ID NO: 17226 - protein, 806 aa, Pseudoalteromonas haloplanktis
MQYLQRHISKTKIMLFMMTFVSSITLAQNKVTVKGFVVDTTNVPVSFANVVILEKDTNTIINGAITDENGRFTIKVAKGTYTLKITFLGYEDYQQEINTNITLDIGKIELQENLNELDAVVIKAKREMISRRGDKLLMKIENNAFAEGKSAAEILKYAPNVWVDPNSDAISIKGLSATIMIDGKRTNMSSADLMNYLSSLADNELKTIEIISNPSARYDAEGLGGIINIVTNRKNKKGLNGSINTNTEYAQFFSHSASLQLNAQINKKLSLKTYLVHQDGTYLRNEDRTERILNSGVDYIYKRVDTSTNSTAYANIDLLYDISETDNLTFQYRILNNDSERFQNNDLLITDDTETFSNGIYNNRRKRDHMSVGINYNKKLDTLGQELSIITDYYTSDIEARNQYINLFFNGDGDLINDNNRRSISPTTYDIISAQVDYSKPINDNMLELGSKISSVENTSNTVFEDLINGEYVVDDNFTNSFNYDEQIVAGYASYAIDKFITEGLSLQVGLRGEFTKGRGEIPNSNFTLSKDYFNLFPSVFLTKQLKNKASVGISYSRRINRPNYMRFNPTIFYITDFTSQVGNPDLDPTYTNALELTYNKSDLNVLLFFDDIQGEAREILTQTSPTELRYQWRNLDKTYIYGMSASYNKRVNDWWTLFGAVSWYGKTYKSTFADAVDNIDVSKGTVQFQVASQMKLPWNMTSEISFEYNGPETNGQFETGENYAFYINLSKRITKDLSFYLKITDPFDNLRYIFTNTQRGIRTNQFRNNFNTSVRLTMRYNFDFGGETKKFRVNKSNSDLRNRSN

SEQ ID NO: 17227 - protein, 572 aa, Pseudoalteromonas haloplanktis
MIKLIWNTFKHSPSVFSIALLMAGSAIAAETPLQNLGTDESPVNQNLTQGSIEIAQNFDTRLMPMDDPSLTPVGVSDLENGEYMDQVTSVTQLSDVRPTDWAFQALQSLVERYGCIAGYPDGTYKGNRAMTRFEFAAGLNACLDRVTELIAAATSDLVTREDLAVLQRLQEEFSAELAALRGRVDSLEARTSELEANQFSTTTKLNGEVLFWLSDTWGERAAGRGTKKSEEDKTETTFAYRVRLIFDSSFTGKDRLRTRLQARNVPKYDSRDLTNTMMTRLGTDDDFDDDFVLNKLAYRFPLLNGRGQIELAANGYGLDDFMGPITPLDSSGSGSISRFGRFNPTFYRAPADAGVKFAYAFNDAIKLTVGYAAPDPEDPQEGKGIFNGGFSGFGQVTFEPNDRIVFQAGYVRGFHPKGDVNLTGSTGSFKAKDPFKGIRTSADNINFEAQWLITEGFQIGGWFGASFARPEDNNDTDDITIVNGALTLAFPDLLKEGSLGGIIIGVPPIITDGGDDDSLKDDDTSIHVEVLYRFQMNDNIAITPGVFVITNPNHIEDNETLWVGTIRTQFRF

SEQ ID NO: 17228 - protein, 1283 aa, Pseudoalteromonas haloplanktis
MTIQKPVAAFYFFKKGFGYFLQFFFFLFWPLKPLGIGLMLAADEQGVNSSSFFLMPEVLVSATSPQNEGQATAEELPRSSVYGPELVTGPVGVIYGPQEFSGGYLDELTKQTYFDRFREDAFYTFGMYGTNFWNIDLGGPIKEGELAYRLVYFGQDGYAPYNYHEGSYLNRQCAYLALSLKPSGTLRLDWNGELDFNDLVPYTGIDRPTQNLIDNGLYQSRNWIGYYTPPAISSSPFGQFHPGVGTPLPGFGYATLWGPLVPLSIKSNIFNIPFDFSCQLYAVSQPISSLELTEERAFVNRWLFPTWVVMPYGIDVADRLELRFNEARKGSKKFWQNLDTGVAFRYLTDLEYSGSWHSTTNQAKRVVPLTFVFASLPLSYALVVSLALLALFLKIPAKSFSQHEGRGGRAKKASCLHNLSYKNRKASRGDYALFFICRDHEDPRWQGSKLALSTARREEGKIQLVSTTILSLFSLCLNCGYTVPPDSSSSVVGTEIMLPEVSVTAAALPASDVLPTESSSVYGMDFSVLDTPRQLTQVSQTLIRSSGMAAQGYIDPLSTAFLIPGSISENSGGMMAAPSVRGMAAQPYINGIQLTALQAGMPLTPFNWNMVESEDITEGPANAVFGQEQPAGGTVNYITKQPYFDRFRGQLWDTTGMYENYMWGADLGGPVDKEHKAAYRLSYMGIENGSYYQPNVHNDQENVYFTLGARPTESYSINFYSDFGTYDFTPMMEWMNRPTTALIQNGLYNTGSLPLSQIQIGTVNNPGFATYAGPLEPISRRMVANNPESEGRAYTGFIQLVQQLQLGDGLLLRNNTFAYYGRNAVVAPASYYTEVAMGDYQIDNRTELITRFGGSNDLSDKISSWEDRLLGKLLVQHQIDAGVEWGFEHNLDYESQLWFGSANAWDILRTNPTSWNFTQTAFFQSLIRNPSAPGGGEWPIPGMPGVYFEPLNGSAGTTDSNYWTVAPFYQHDIQVTDKISILVGARATTYFISSQTPPGTPPELFIQAQTIQELPMVNASVIYKVVPWWTAYFTYDWMYVANVGAVGGFNVYPSGLPSSSFNLKEQLFEGGFKWSLLDNKLYASLAGFSQQIPLFNFVNVPPTPATVTGLEANLTYQPNRHWWMRTGYFFGHGVEDWSGLPSGPPMSQTYSTALALRANLPLNDNLSFPPGTYPFIGWPQQVINAMVTYQAESGFGVTLSALVMSPQFLGYNYATAIPWQYLINGRIFYSQPKWEISLWIYNLTNEHYWLPYAIGSMPDRTNDYGGIVAGLPFWIQGTIAWKF

SEQ ID NO: 17229 - protein, 144 aa, Pseudoalteromonas haloplanktis
GEGDVKGIKLALQYHVDWLKQYSENLNMYFESSLNLWEYGAENDYDSNLVLAISPVIQYPITQMADKPIFIEFGIGVSLLDDTVFAGKNVSTHYQFEDRLGLVMKFGKNNRQSVAIRYFHYSNAGFKKPNPGLDFIALNYTRFY

SEQ ID NO: 17230 - protein, 1058 aa, Pseudoalteromonas haloplanktis
MLIIAGALTATPQISQADVVFTGNNYGSFSGSYMSIGDGGIGTLTVSGVDKHGVREDKTIVGDLHLGRRDSVGSGIARGELYVLDGARLTVNKDINAGFYFDGPPAPTEGAQILVSGEGSVLSTLSRLGFGYGNSALTVANGGTFSAPYWIRLGDNRDARFAVNIGAAKGEAAQAPGILDIPSIYFRYATSELNFNHTDDAYIFDVDIGSVLASEGPNHTINHLAGTTIWTGGVGVFFGSNNRFAGTTNITGGALIVNGELPGQIKLTGGTLGGAGTVGNVEATDGTLSPGSNGSGTLKIGGNLVLDENATLAFGLGTPDGTVGLDSDLITVGGDLTLDGTLDVTDTGTFGAGVYTLITYDGGLTDNGLTIGDAPLDYDYALSTTVTPGTVSLLASTRDLLFWNGTSTADGTVHGGAGTWNSSSRNWTNSASFTDLAYDPDSYFVFQGTAGTVTVADEGVSVASGLQFAVDGYQVTGGEVTLDSETSIRIGDGTNAGADFTATIASDITGTGSLNKTDLGTLILEGDNSYAGGTTLTAGKLVVNGTVGDVTVNGGSLGGSGTIGAVAFNSGAVIAPGNSIGTLNATSLVFNGGSTFEVELNDGGNAAGINNDLLAASGNVTINGGTVHVKPENGTDDGSTYAANTVYTIISAVGGVSGTFDSSTPTDDFAFLDFALSYDANNVYLGSQMASSSFCIPGMSANQCATGEGVFSLGSGSLFSSVLNLSNSDASRALYQLSGEAHASIKTALIEDSRFAREAALSRVRIAMDSVAADGQEQVEKRVGESLAFWGQGFGSLGRWSGNSNAAGLDRSIGGFLLGGDAQIGENSRLGFFGGYNNSSFEVNGRRTSATAETLHLGAYGGTEFGPLGLRAGASYAWHDIDTTRSVAFTGFAENLSGAYMAQTAQIFGEAGYRFDYAATSLEPFANISYMQLSSDGYSEAGGSAALKAGRQAMDSTFTSIGLRAETQANLGQFTAKFSAQAAWQHAFDDVTPVVNHAFAGGDDFSVAGIPIARDTLLLNLGASVDLGRNTTLGLAYEGRFGSGFTDQGLKANIALKF

SEQ ID NO: 17231 - protein, 3397 aa, Pseudoalteromonas haloplanktis
MNRAFALVWNAAIGNWVVTHELVRRRRKPGSPRRQLPALVVLAVGAAAPMLAWGACTPAIPAAGATVTCSGTPVTSNSFSSSANNLTVNVASGSQMTAGLLGGTAIALSGTNSTLNNAGTIDPSVLGLLSVLSSGVTMGNASSTAVTVNNLASGTLYGTGGLLGANLLNLDGMALGLTSASNGTVQINNAGVIDSRPLLGLSILGSDTPVIAVTGGGTVNAVNTGTINGRVGFQSSATGNTFVNSGTINGSVSMGAGSTNSFTAVTGGSVNSGGGLALELLGPGGLLSFAQTGVVDGGLGGNNTLILQNSAVGTGSGSTGTGTLSTAQYINFGNLRVNSGTWSVGGASNFANSALNGGVLQFANPAQLGTTITANGGTLQATAAGLTLAPTNGIALGAGGLTVQGTNNLTVGSAITGTGGLTKTGTGGLALTGTSTFSGGVNLVDGALTVGTNSALGTGTVTASGGSLLAGAAVNLANAFSLSNTVGIGGANALRIGGTISGTGALNKVGAGTLTLGGSNTYSGGTTLGAGSVLLETSGALGTGTVTAAGGLLDNTAPLTLTNNFALANTLGLGASGNALTLSGTLAGAGGVNKTGTGTLSLSGTNTYSGGTTLAAGTLQLGTASALGTGALNVTGASSLSTTAPLTVTNGISLAAPLNWTGAQALTLSGAINGAGSLIKSGTGDLTLTNANTYTGGTTLSTGRLVVGSNAALGTGTLTASGGELDATAASTLGNAIALTGNLGVGSSGNALNLTGTISGAGALNKLGGGTLTLAGLNTYTGGTSLNAGTLQVASGTALGTGTLNVTGSASLQNTAAATLSNAVTLSTGALTLNGAQALTLGGAISGAGSLVKAGGDLTLSGNNTYTGGTALNTGKLTVGSNTALGSGTLTAAAGTTLDNAAVSTLANAIALAGQFTVAGSNALTLTGGISGAGSLDKLGPASLTLSGNNIYLGGTRLTAGSLILGSDGALGTGSLSVSGGLLDSTAARVLANNVVLDADLQLGGSQDLTLTGGISGIGGLVKDGAAALTLTGANTFGGGVDLNAGSLSVGSGAALGSGVLTAAGGTQLQATTATTLGNDVVLNGALSLTGNNNLGLSGTVSGAGSLVKQGTGALTLNGNNSYTGGTALNDGALVVGSNTALGSGALTAANGTLLTAASAVTLQNALTTNGALTIDGQNLTLDGAIDGTGSLIKTGAQTLTLNGNNTWSGGLQLQGGSLLVGSDTALGAGTLTAAGGTTLDASTAVALGNAVALDGTLTLPGTQNIALNGVVSGIGGLDKQGSATLTLSNANTFTGGVALDAGRLVLGNNAALGVGDMRVNGPAELDATAALTVGNNLALNDQLTLVGSNDLVLNGSVSGTGSLVKNGATTLSLTASNSYSGGTSLTAGTIAVGADNALGTGSLSVLGNSVLSNAVAVALGNDIALGAALTVDNAADMLASGAISGSGSLVKTGLGTLTLSGNNSYTGPLAIQAGTVVASTAASLGNASNVDVAAGALLNLTNGGLINTLTGAGGVDTDTGATLQLGGGDFAGSLGGGGNLDKVGAGTVRLLGTSAIGGSTQVSAGTLDVVGSLGTGALNVASGGTLTGTGAAGNVGAAVTVSDGGRLALTSGSSLSVGALTLAPGAFVDVALGAPSATRLLAVNGDLTLDGTLNITDLGGFGTGVYRLIDYTGALTNNGMLIGLFPGSVDISQLALQTAIGQQLNLVVTAPGSIVQFWDGVQTTANGTVDGGAGTWGAATNWTGQDGSANSTWQGDFAVFSGTAGTVGVQGTQNVGGLQFVTDGYQLTDAGAGALAVTDPLTSIRVDPGATASIDVAITGTGGVQKLDTGTLVLSGPNTYTGGTALGGGSLVLGNTQALGSGTLTAAAGTTLDTNQALALGNAVVLDGGLTLPGSNDLTLAGAISGAGSLIKNGTSTLTLDGSNSYLGGSVLNAGTLAVGSNTALGTGSLSVLGDATLSNAIALALGNNVNLGANLTIASADALALTGVLSGAGALTKTGLGTLTLSGSNLFSGPVSVQGGVLATSATGTLGTSASVDVAAGAGLSLGSNTALSSVTGLGNVAIQGGSTLQLGVGNVGSTFAGALNDAGNLEKVGTGTVQLTGTSTIGGTTQITAGTLDVDGTLGSAGGVTVGTGGTLSGSGVVNAAVTVNDGGRLVVTSGALLTTGSLSMAPNATLDAFLGIPSQTGVLAVNGDLTLDGTLNITDIGGFGTGVYRLIDYTGTLTNNGMGFGTLPGTVDPAQLTLQTSLAQQVNVVLLASGSNVQFWDGAQTVANGSAEGGTGTWTAGTTNWTSVDGLINSDWQNSFAVFAGTAGNVGVQGTQGITGMQFITDGYVLSDAGGGALSANAANTIIRVDPGVTGTIDVAIGGSGTLQKLDTGTLVLTGANTYTGGTALGGGSLVLGNAQALGTGTLTAAAGTTLDTDQALALANAVVLDGALTLPGSNDLALTGAISGAGSLIKNGTSTLTLSGNNSYAGGTTLSDGTLAVASNTALGSGTLSVTGDSVLSNAIAAALGNAVTLGAALTVDNPADLTLAGNISGSGALIKTNTGTLTLDGSNTYSGGTTLTAGTLVGDSASLQGAIVDNATLAFNQAADGVFTGSITGTGTVVKEGAGALLLSGANGYAGGTTIAAGTLIGDTASLQGDITNNAALVFNQTTGGVYAGAVSGTGSLEKTGSGVLQLLGANTYTGGTVISAGSLVGNTTSLQGDVVDNATLIFDQASDGVFAGVVSGTGSVIKQGAGALTLVAPNTYSGGTTIASGSLIGTTDSLQGNIVDNAVLVFDQATDGTYAGNVTGSGVLVKNGTGTLTLDGVNGYLGGTTVNAGTLVGNTASLQGDITNNSTLTFLQNSAGSYAGRLFGVGRFIKLGTGTLLLTANSSTFTGPTEVNAGTLSVGNLANPGAVLGGPVTVGPGGTLAGSGSVGSLVSSGTVAIGGAGGTISVGGNATFAPGSALQVTPGDGGVVTPVAVGGAASVATGTTLALVRATDLPLFTEIPVISAGGGLTGQFTNVISDYAFIEPDVSTTATGLSVTFGRNTVGMVDAVTTPNQQSTAAAVDGLPNTSPIYQAVVRLPDDPEAVRTAFASLSGESHASTATALLDSRFLYSGIANHLRGDSQDTLVGDTMVWITGRSLPTRVDGDANAVSVRREDNGVMAGAERRFGERSVVGIAVGNQDIESWSREWGDRADVDGTHAGVYGRADWSAFSLQGAVDYASYRVDSTRRVMLPGVLEERMDSRYDATAVTVSLEAAWNLRTEGAVYSPFIAADYTRLKTDGFTERGGISALSVDSASDTFSTATLGVRGDWDLGQKAALYASAGWRHAFGDRSVQRSAGFVGTASEFSVQSVTLAKNAAIGELGVSLITSPRSRLALSLQGLSGDGQTAYGGQVTWGVSF

SEQ ID NO: 17232 - protein, 250 aa, Pseudoalteromonas haloplanktis
MNNKLLCLALLVSPTAMADNMVNWWDVSVTALYGENYDLAPSEKQTTLTFETAGDWKYGDWFAFQDVTYFNGSNVSKDNTTYGEISTRFSAGKILGKTVGFGPVTDLSLALTLEEGEGPVKAFLYGVGMDIKIPYFSYFQLNTYRRHAISSDNISDGWQLTPAFRMDFPIGNSNIVFDGFIDWVFVADEAVYETNFHFNPQLKYDLGAVMLGEHQKNKLFVGIEYDYWKNKYGVDGIEQNTFSVIAKYHF

SEQ ID NO: 17233 - protein, 254 aa, Pseudoalteromonas haloplanktis
MGNFRFPWVGKIGFPLTFGTVSLGRQYAPGYFFNYDAVLGANVSPQSILSNNAKLSITPNSAARWDNSVAYTGSFSGLTARAIYSMNAVETDPNPNDDDAYGLSLDYANGPLSVGGVYQVKQNNTEDQEEWGIGAGYDFGMVKLTGSYQAVDGLGFVKGAEGDLWQVGVIVPVGAAGNVHLAYGEFDRDDVSNVGAESYSIAYTHALSKRTTAYVAYNNTENESNTNAFGLVAGSAGDLGDDSDLFTVGIRHTF

SEQ ID NO: 17234 - protein, 511 aa, Pseudoalteromonas haloplanktis
MTKLSSTPRSLPRPRLAVLATALAPAALAAGLGLWSGDAEASGIATARFGGEHGHPTTENATGIYYNPGAIALSKGTHIFADGIIALRGVTYTRPESAVDTQNNLDSSPNVSLMEAAGANDGSASLFNVAGAPFFGVTSDFGTDFIYGGAAFYYPFGGGATWSKNEAFQDSEQFPGAYDGQQRWFAIDGSLRSAYITGALAFKIKPARMTIGVSGSAIYSSLDTVRARNADGTDNLVSGSNPDNYILKEGRSWLQAGGWQGGFAVGLTAEPVVDKLWIGASYTSQPGVAGGMTLKGTLTNIFASAPGPDETEIELTQSMPDIVRLGFRYRPIPRLELRLFADYTRWSVMDKQCVLIANTEGRKCDFDNTDTALSDPENFGASGDGTVGVTQHLPRFWKDAGGVRLGAGYFAIPDELEVYAGVGYDSSAIPAQTVDPVLFDMDKISVSLGALWQAHEHFAMGVTLTQIIYFTLDTEGQSAFDDFAPPTRQPSADGVYEQWLSVGNLYFDVSF

SEQ ID NO: 17235 - protein, 945 aa, Rhodobacter sphaeroides
MKHFTHSFTHTKLASAVAFALISLHTTSPVYAQQADDQEVEVINVKGVRGALVSAANIKRDSDGVVDAITAQDIGKFPDTNLAESLQRITGVSIDRSNNEGNQVTVRGFGPSFNLVTLNNRQMPTSSTLLEDGIDRSFNFREIAAESVSGVEVYKTGKANISSGGIGSTINIKTAKPFDYDGFKAVATVKGVVDTSVEVGDSVTPEVSGMVSQQFADGKVGVLLSLSHAERDSRKERVGTPGWVPERGSNVDKSGIDTNLNPSRTHWAPLSISVDTHDNHRERQNAQLVLQMAPSDTLVATLDYTLSRFEETSNINRTSFWFDGDTGGDADANGTVTNPFRNDDELNFWSYHNYFNTENDSIGLNLEYQATENLSFNFDYHDSTSHSQPDGRNSETIMNLKNPRVNDTNGDGIADRGGVDVSITTHPNGRPDIFFDAADLPGQDPYASQNIQFDLFQTRGYEIENNIKQAQLHGQWLNAYSGALNKINFGVANTDYTIDTYAKRTIAFVPLDISTLDLQFNSSNGFGKDIGGNSNFFPLLSSYSAQDALQLVKDQGFYFQEDPVYNGVNEETFAVYLSFDFETEFNQMPIKFNAGLRWEDTDVTSTSLQRGIKSLNYVNTAGRFGEVFTDEPTNIRLEGSYTRLLPNMDFNIEFTDDLVGRVSYSTTLSRPDLSSLFPSTTIDARPDGPYSASIGNPGLLPLESKNIDLSLEWYYGNGSYASVGFFKKYVENFIGITTREGTMPDVNGNPLTDPSIIPRPGCPDEVVGGNPACFSTPDDPEITFLISSPDNLNDAEVDGWELNLQHIFGESGFGTVANMTFVDGNVEYDVYDVNSTFALTGLSDSANLIAFYEKDGFQARIAYNWRDDFLLALYQPQRQGEPNFVEAYGQWDINVSYDINENLSVFVEGLNITEETTRRHGRFADQLISAEQFGARYNIGVSAKF

SEQ ID NO: 17236 - protein, 715 aa, Rhodobacter sphaeroides
MTPRHADRSRLLLRHPCLRALLIGGSALVAMPTGLRAQDAADDAAAGAFRLSPIIVDAAAAADDDANSVVAQELWVGGKVATSLLDTPASVSVVTQAEIRARAATTTEEVLQYSAGIVTDYYGSDDRNDYFLVRGFQASTYRDGLTLGSMRGVREEPYAYQRIEVLKGANSTLFGVSDPGGSVNFVTKVPQFTRFGEVYGQIGTNDHKELGFDLGDVLNEQGTLAYRFTGKVKDSALDYDTSRDDDAFLMGGLTWAPTEATTLTLVYDHLKRDGTPNSGGYPLDREYDRGDFFGEADFNDHDVERDTLTAMLRHDFGGGLSLTANLRYSDLTDDFGYIYLSDSASRVGTELSRFYFGTDSTAEELIGNAILQYDTSFGSTDSSTLVGIEYRDAALSSASFYGGAGTIDIATGIATGVPSNLAPYETRKSDYTTKSVFLQQNLSFADRLVATVGLRHDWLDLRSRGTASGTVFDDSDDFSETSIRGALTYKVTDEVSAYASYVESVAPPSIGVEPERGEQYEIGVKYQPAGSRALLSAAIFDLTRQDMTIPVVLGDGTIVREVVGETRVRGFEIEGKAEIAENWDVIAAYSYQDAELTRAVVRGTDVSGNQFANVPKTMASLWVNYTLPGRARGGDMTFGLGARYIGSYQFAETNATGESDATTLFDAAFSYDIAENTGLSVNVSNLFDEQHVVGRGTADYYNPGRTVTATLRRTW

SEQ ID NO: 17237 - protein, 799 aa, Rhodobacter sphaeroides
MSILPHSLFVSASLAMAFTVSAQEQSRPAQVGTEANTSNEQDNNLEHVTVTGSAQPTLIMSPKNAVIDGPFGKDKNLTEIARTLTSISSDMLEQLSIDDLQDVLTLVPNTYSASGFGAPSLPTIRGQLGELFQQGMRRQAGNNGFGIPLSFNSVGQIDVVKGAPSVILGTTQRNGGFVNLNNKTATLSGTDLKLQASAGSWEHYRGQVDVNTTIEEGRSGIRVSAEYIDNNSYYDFTEFQSEDLFIAYKILPDDKSSWDISFEYYDVEFTDNAGINRPTQNLIDNSLYITGQGVQPNGSQVPGAFAVVSPTGEVRIPRSTVLTDPDNINNAQTYVFHSTYERQLNAVHTLTNRSYFQYLDREEIAQNSFVEIIDGAKTAQNRLELTSAWSGDQQTTWGIDLRYNDVLGYSQFTTEADLPIDLLGSIEQRRIPLTEAQQARLVELRPGVFVSPGANYDIDGDGNNDFSLSDTTDSTTWQTGLFAEQDSDWTSRFSTTVGLRADHYDVTARDALPPQGQVAAEDSFSKWLYSGSASARFKINNDIVTYATYSYSEATSNSMGGGTVLGAENKINPLNFATENELYELGVKFSPVGSPWYADASVFEQSRSLRNRDGSNTGIIAKGFEAQVFYQGSSLWANLGYSYLDARYDDSASAQDSQQVADAFDNSRPDIIQGTGIGAPNFAGFAPSNERVQGIPQQTVSASAGYQIWDNWDVSGSAIYSKSYPLDYLATVLIRDQITININTNVALTDQSSLRLEIRNLTDENNWRPVFEGGYFGSTLVFPELPRNVQLTYTYNFKA

SEQ ID NO: 17238 - protein, 391 aa, Rhodobacter sphaeroides
MKQIKHAAVGSVLGLLACAFSTQVLAQTSVQVGGMLDVYAGSIKRSGDAASTSVVNSGGLQTSWWGFKGTEELGNGLKAHFALTGFMRPDVGAMGRFGTDTMFSRDANVGLSGSFGTVSLGRDLAPNFVPSLTFNPFGSSFQFSPLGLHTQTSSSRYAGRAWSATVAGDTAWSNEIMYVTPKLGGFTTSLFLQLGEQAGSSGKNNFGANTMYANGPLSFGAYFQSVKSNNPVDPVTGASQVFSFTPYNRASGATYALAASKNDTWFVGGAYDLQFIKLFGTLNYSTNKLLNAADDSRYDLKSNTVQLGASMPIGKGSALLSWARTNVKADGDLSAVLGNSDVQSSLVRNTVSLGYDYFLSKRTDVYSVVSYDKLTAQSSGVSAGFGIRQRF

SEQ ID NO: 17239 - protein, 1202 aa, Rhodobacter sphaeroides
MPMKRHNARRRACLATSALCLIVAPRLLAQTAAPAPETADETIVLSPFVVEAAEDSGYSAKATLAGTRIRTELKDVGSSISVVTQKFLEDTNSTNMEDLLVYTTGTEVAGQGGNFLGQGDGMVLVSQNVNRPVANTRVRGLAAADNTRDFFLTDIPWDSYNVGRVDLQRGPNAILFGIGSPAGIVNSSLNPAAFKNAYKIENQIGSFGTIRTTADLNHVLIKNQLAIRIALLDDETKFRQDPAYKDDRRVYGAIRFDPAALNRGSAKTSFTANFEKGKQTRLDPINTPPIDAITPWFFAYTPAQRAVGFSAADPANYSPSTDLNDPLVQQYGAYLGNYNGSRPVGLSQSDPWLGAPGGRVFDGVVTAYEGGQPGFVFPTKIQNWPTNASIPGTVLGNNGIVGITQYAAGVGGFSGNAGLVGSSIGAYKAKSLTDRSIFDYYNHLLGGPNAQQFNDFKAFNVTGRQTFFDDKLGFELAFDKQDAKFGNWSLIDNAATAVSIDIMRTLIDGTKNPNFLRPVVYAAGGGSGGSWDRSEREVVRATAFGELDFATISGRDSVLAKIFGRNTFTGLFARQKTYDFRANYNRFYIADSFVPAAGNGAVGQASRDNIFAVYLGSPIPANAASASGVGLQGIKTFIDAPSQQTIRYYNNQTNAWQTLPLDTVNNDLAADEQKTYRTSRKTKDIVTSKAVVWQGYWLEGALVPMFGWREDEDVFRDAGNPPAVPANPQGQGGLVNPFSPNWTLPEASSAENTVRSKTYSLVTHLPAKWRERMPGRMDVSLIYNKSENFNPDSSRRDIMGASVPNPAGKTEEYGVAITALDDRLVFKWAHYETSVTNATLDSAGISAQYLIGAVEAWGQKSAVQFRDSLAPGGPRVGNASTLYGLSSDGHQVTWQPDGVLASQNPDGSYQYTQAQLDATYAREKASVDAWFATQVPAAFQDAWALTDYATGGGSTNYGASGLVVTGDTISKGDEFELIANPIKGLSVSVNAAKTSASRMNLAQSYVDWINQRWEEFQGPAGDMRLWGPADDSQSPNGRQFGHGGETARGKYSRETMAGYNLFLALEGADVPELRPWRFNVVANYDFQGGISWLKGVNVGGSYRWQQRNTTGFPVVGAGTATDPYRYDVSNPYKGSDEGIFDGWVGYRRHLGWKNVAWRVQLNVRNLLANDHLSRVTVQPNGEPGAYRIPEPRTITLTNTFEF

SEQ ID NO: 17240 - protein, 200 aa, Rhodobacter sphaeroides
MKRIVALALGGLLAAPAFAGGPVTVAPEPVVEPVPAPVVVAPVADWSGFYVGGQLGYGKVDTNIDDLDGNGAIGGLHAGYRYDFGRAVVGAELAYDVTNIDLDGIADSELDNVTTLKLMAGGKMGKGLLYATAGGSWADASIGGADVSDNGYVYGIGYDYMVNDRWSVGAELLRHTWDDFDDSGVDVDATTLQAKVGFRF

SEQ ID NO: 17241 - protein, 1032 aa, Rhodobacter sphaeroides
MTEFTKSRGLRALALAGASLSALIAAPAFAQSAEDETADEAQSRDTIVITGSRIQSDGTLEAPSPVVAVGGDDIRTSGQIDITALLRESPQLQASLPGTFSAFNGTPLGASLLNLRNLGTTRTLVIENGRRHVAGIEGTSSVDVNTISTALLSRVEVLTGGASAVYGADAVTGVVNFIMRDGASFDGMEVRTQAGISSESDAEEYFISLANGFESADGRADIVFAAEYQSTESIEAGDRDFGGTGLFSLVPNGPATGIDPRFSNVWLPNYRLPISSHYGIIALGDGGASAFVEAVSSGGVPGCDTLGLAGIPTCQIVDETGTLRPYNPGDIFIDGFNASGGDGVFAEPDDELLLPQTDRFLFQTAFSYELTENVEFFADAKYVFTETIESNQVNGFNDDIPISEDNPFIPAALRAQLATLRAEGIDPVIAISRDVLDTTTRSNPVAERKTMRGVAGFRGFIPQLGFDWEMSYTYGRTDADITSRLRLEDRYFAAIDAVIDPSTGDIVCRSDIDPTANVPPSSPYPAQNAGFQITTFTPGDGQCVPINIMGANSISQEAADFIFQPATAQNEIEQRDFLATLSGTSEQFFSLPAGPIGFALGYEYRKEESAFTPDAYSAAGLTFGTINSNGGPTNASSGLIEVSEFFGELQVPIISDVPFIQDFELNGAYRYSDYDTFGETDTWSVGARWTIIDSLTVRSTLSRAVRIPNITEAFSPNFTVSLGASNDPCNPQFIDAGSQFRRANCEALIGIPIDTYNSTDYVSARIPGQSGGNPDLEPEEADSFTLGAIWRPVEDFGGLFDGLTVTVDYYKIEIDGLIDQLGAFDIAQNCVDAPTINNQFCAAIDRDPTIGFITGFRSGFVNLAAVETSGIDWRIEYAFDMPSILGLEDAGELRLSSLGTNFLSNEETRDVSAPDEITDVLTTMSRPEWIFNLNATWAIGDLSLGWKGRYESEQLLGGIELDDLESDPNFANITHADGAWVHDFSISYFLKDELEIYGGINNAFDEEPYLGQYSRPAGPRGRFFYAGVNATF

SEQ ID NO: 17242 - protein, 1055 aa, Rhodobacter sphaeroides
MQMHARADSCALTKDGSFMKDASTTRHTSVTPLRQAIRAINRASCGALACYLATLGVAHAAPYVEAGQAGNAASWRSAEFNADWGLGAINADQAYAAGYSGKGIKLGIFDQPVYAPHPEFSSANKVVNLVTSGIREYTDPYIPVKAGDAFRYDGAPTLDSGGKLGNHGTHVGGIAGGDRDGGPMHGVAYNAQILSADNGDPGPEDGIVLGNDGAVYQAGWNALVNSGARVINNSWGIGITDRFDKGGRDPAFPHFTVQDAQVQFDQIRQILGTRPGGAYQGAIDAARSGVVTIFAAGNDYNLNNPDAMAGLGYFVPGIAPNWLTVAALQQNPDAAAATTPYTLSTFSSRCGYTASFCVSAPGTRIYSSVLNGTSLEDLTVGWANKNGTSMAAPHVAGSMAVLMERFPYMTGAQVADVLKTTATDLGAPGVDALYGWGMINLGKAVNGPSMFVTEADIPAEFRINGAYGDSQFVADLPGVGAIVDAGKPTQRTCTGLQCGLDVWSNAIAGHGGLTKQGIGTLVLSGANSYSGPTLVNQGRLAINGSLASAVTVNNGGVLGGTGSVASLTANQGGTVAPGNSIGTLQVNSNVLLEPGSTYAVELSPTASDRIVVGGTATVSGANMALTLENDNAALLSSNQTSSVIGRQYNVLQAAGGIQGQFGSVTDDYAFLAGNLAYTGSGVTLALERNGDSFASAAQTYNQRSVAQAIEQLSVGNSVYESVILSPDTATARRAFTQLSGEVHPAIATQLINDSRQLRDAVGDRLRVAGLYDQPAPGSEDNSVWVKALGAWGKNAGSSDAASSTSSLGGLLAGVDGLISDHTRLGAMAGYSDTSLSLGDDTHSRASADSYHLGAYIGHEQGPLRLTAGASHSWHRIDVKRDLQFGAFSDRQKVKRDAQSSQVFTEAAYRLNLQPLTLEPFANLAYVHFDSDSFTEKGGATALNGSDDTRDTVLSTLGMRAGNRFNLNDTQKLDVSATLGWQHNLSDTSAEQHLAFASAGNSFNTQSVSMDRDAAAVGARASLALGKDARINLDYNGVLGARDKTHGVGLSLDWQF

SEQ ID NO: 17243 - protein, 353 aa, Rhodobacter sphaeroides
MKKTAALCALLASAPVIAQTSSLTLYGIVDLGLHCSRGITSAHAPATGSQTSLGSGIHTTSRWGLRGSEVLSGDTRVLFNLESGVRVDSGAPGMASKSFDRASWVGLQGGWGSVQIGRQTSLLADAIAPVDPLGLRFGGANVNAGVVALSRHGLGADFGNAGSNSSSYRLDNAFKYIGQFGGFTARAMLGLGEVAGQASALSSRGLGLAYAANGWTVSGAFQTFKDADRRSLNGSTLGLAYQWNSLRLAANAGRNEAQTAAGTHTGQRVLSSGVIWTAQPALNLGLTYYHAGRSRTGAHKDGYGRWVTFAEYKLSRRTQLYAELDSTRWRDGYQGAANPATATGIAAGVVHRF

SEQ ID NO: 17244 - protein, 699 aa, Rhodobacter sphaeroides
MKTKHRSMLLAGASTIALAPAALFAQEAIELDAIVVTATTDVTTQADGYKADYNQSATKSDTPVAETTQSVSVVTAEQIKDQGAETLGQALRYSPGVLGDPYGVDPRFDSPTIRGFEARGSQYVNGLRQLRYMGAPAYETFALQQIEVLNGPNSSLYGAGSPAGIINQVQKRAQGFDFGELGVGLDDNGSRQSFFDWNRTVSDTLSFRATGIAKDYESQVEEIGLERGYLGLAARWKPTDRTTLDIISSYTDDAPTSPPGIPFALTGQGNDKYLRELYTGEPGWDDHDRQIFNIGYELSHEFDSGWTFSQGFRYEKFDWEYTGHYVTGIDASGTGITRGANYQRENTTGLSLDSRLAGEVLTGGMEHKLLFGLDLRKYDADTVTEFYNATGGVTNLDWRNPIYGGVPTGAPWYVSTPDVTQTQIGLYAQDEITAGRWRGSIALRHDWSKQEGTTYTNFAGEGEIDQSDKALSGRAGLGYEIAPGALVYANYSTSFDPEIGVDGAGEQLEPTTGKQWELGVKYQPDSFNALFTAAIYDLRQENLTVNLGGAEGRRQVGEVKSSGLELGAVGELAPGLNLRASYAYNDTEQVDPSGANDGNEMPNAPRHLASLWLDKAFDNGVSLGGGLRYIGEREGDLANLYSLDSVTLLDLAVGYSRENMEASINLNNLSDEVYLANCGSFGCYYGEGRTISAKISYKW

SEQ ID NO: 17245 - protein, 317 aa, Nitrosococcus oceani
MQVIDGVRQNFDLAHRGSYFLPMSLIQEIEVIKGPSSSLWGSGALGGVVAMRTPNALDLLKNNDKFGVKIRQGYQTANNLSERDVSVFAANDKFDVLISGFYNNADNLRTGKGNKLNNTAYKQFGGLAKFGWQINDANRVELSHRETRFKQTAPGNNEVENELTNEKITEQIRDFHGSSNSFPRVNRTQSEISEFYSKVKTRFGSVSYLSDQQIPDQSTVFNYYLTPDNPYLNTHIALYNNKTIEKEQRKVSGVKDQTKLTTRGINLRNSSELSHISFIYGWIICEIKSVPNEAQTIVMRSFERNPIMRIQTLQAFI

SEQ ID NO: 17246 - protein, 760 aa, Nitrosococcus oceani
MYFQLSRRALLCAGTALCSLMILAGAPARAEDDATDMPEVVIKEKPSVMERYKIPNTAESITREKLADTVNVVDPEDAVKYMPSLSVRKRNNGDTQAVLMTRTWGYNSSARSLVYVDDIPISALLANDNTRGGPRWGMVAPEEIERVDMMYGPFAAQHAGNSMGGVLQITTRMPEKLEVTAKQTETLQAFNLYKTKDTYRTDQSSSTIGHKIGDLSLFVAATSTYSEAQPVSVLTSSSAVTGTTGAISAVDKSGSRADVIGMGGLLRTEMQNIKTKLAYDFTPELKASYTLGFWQNHGRSRTESYLKDASGNTTYGAASTTSKAATAFAGSNYILEQAQTSHALSLKSDTKGLWDFEGNVTHVHYDRDIQKQPLGTAGGTTFTTNGKYTQMDGTNWTSADAKGIFRPGGLGGAHEASFGVHFDRYILFAPTYTTANWRTEAPVTGRTTDARGNTQTYAAWAQDVWKLTDTVKATLGGRYEYWETFKGYVMTSSSDFHAASSDRSAFSPKGSLAWEFVPQWTVTGSAARSTRFPTVSELYMTSGTGVNMTIANPNLAPERTNTYEIALETSLGDGKTRVSLFHEDVANALISQTNAASGGGTSTYVTNVKAIRNRGVELAAQQNNVVITGLDLAGSLTYVDAEIRKNPAWAGGTETVGKRVPNIPMRRATVTATYRPTDEWALSTAARYQDRMPTTMDNTDYVNKVAGSFDAFFVMDVRARYKHNENLEAAIGIDNVNDCKYYEFHPFPQRTFIAELKLKL

SEQ ID NO: 17247 - protein, 139 aa, Nitrosococcus oceani
SDDHENGVDLNLEVQFAPLAFPGSPRPHLGATLNFTGDTSVAYAGLGFRVWHAARWFADANIGAVVHDGPLHKDPARCEQFSDCGFGTRFLPRLGAEIGYRVSPRASIGLFYDHMSHKWVVEGENEGLDHIGVRYLHAF

SEQ ID NO: 17248 - protein, 461 aa, Nitrosococcus oceani
MRKTILNLSFLFFATTVLAQSGHIMQGVGAVNMSMGGAATAQPLDISGAMQWNPAALSVFDSKSIKLDVGLFFSSPELSSSLPPNMLWQPGDFGPGAPGSPAVNGTTMDDRGMSPMPALAMVWGKEGSKHTFGASAFGISGFGVTFPQEANLPMDTSGNPNPNWNPTDSNPINWPQSLNGFGHIESDYMLLQVGLSYAYELSDKFSFGIQPNINYAALELAPNPTANPTMAGYPTADKASAIGFGAQFGLFYDSGLGLKLGASYKTAQKFGEFEFDNTYLDNSTAKNNFQMDYPAILSLGFGYSAGDVDLALDFRRVDYENTEGFSETGWTPTASVAGFGWKNISILSAGLQYKGINKLPLRFGYTYSSNPIPEEVTFFNIPATAIIKNAYQFGLSYEVNNTWKLDAVYHYGDSNGATEGKILNPMMTSPNNPLGAVPGSSVSYEMTTSMIMVGIGYTFNQ

SEQ ID NO: 17249 - protein, 422 aa, Nitrosococcus oceani
MLKRTLGLTAALASSQILAGGFARTEQSISGMGVGQAGRASMAQDASTVYGNPAGMARLEGRQITAGVTFVDASTDISHAAGRSRGSNDGDMVPFSSVPFGFYTQKLDEHWAFGLGIYAPFGLSTDYENGFQGRMFASKSDLKVVTVQPTVSYAFNDRLSIGAGPTFNRIAGTLESDITLNPAIADTRVKVSGDDTAVGFNIGVLFNATDTTRVGLTYHSKVDYKLGCHTQVSTGAGTPPQLLASNRYDCTLKVATPESYDLSVTQKLSDAWTLYASATRTGWSSMQDLSLRNQPVSAAQGGSLASALTGSIQEGLNWHDTWAYAIGTAYRLDQQWVLRAGVLFDQSPTSNTDRSPRTPTGDREVFSVGAGYEVTPQLTLDVAYSYLQEESVDVSRANALGSYSATYQSHANLLGVGATYRF

SEQ ID NO: 17250 - protein, 1129 aa, Burkholderia pseudomallei
MTRHKKRKTMKRSGAKLLAPVVVAAAAAVAARPGWAQAAPYPDPGRRGDPASWRTPEFTNAWGLGAMHAEYAYAAGYTGANVAIGVLDSGYYAQHPELPDSRFVPVTAAGVSGVLNPNNNNHGTLVSGVVGGARDGVGMHGVAPDATVYEGNTNATDGFRFGVSDPKFPASDAKYFAEAYDALAAKGVRIISNSWGSQPANENYSTLNKLTDAYKLHEAVRTATGRGTWLDAAAKVSRDGVINNFSSGNTGYDNASLRGAYAYFHPELEGHWMTTTGYDQLSGQVYNQCGIAKWWCVMAPTGVPSTSYSGGAAAPTGATYANFNGTSAAAPHASAALALIMERFPYMTSEQALSVLFTTAQNMEPDPSRPDYTNNGLFSTVHPAKPGASGVPNAFGGWGLVDLRRAMNGPGQLLGTFDAALPAGTADVWSNDISDVALAARKREDDAEHRAWLDTLRTKGWEHGLPAGASNGDRIDYALGVARETAYQAREYQGSLVKSGGGTLTLAGANTYRGPTTVDGGELRIDGSIAARAVVNPAGRLTVNGRAADIAVNGGVATIAGTSANLSIDRQGRAAVTGTTADVRVASGFASLGGTSGNVAVGALGVAAITGRTADVAVDGGRASLDGASGNVAVGNGGVVSGSGTVRTLTAAANGTVAPGHSVGTLTVSGDVRFAPGSIYAVEVSPGGAGDRIVAGGRAQIDGGALALALENTPPPLTPEQSRSVLGRRFEILNAAGGVAGRFDAPSGYLFVNPVLAYGPTTVSLTIDRNATPFASVARTANERGVADALETADPGSAVYNSVLFAASAQAPQATLAQLTGEIYPAAYAALVNESRQVRETALERLWTARGAPGRAGAWARLLGAWGSARGGDVNGYTSSTGGFLAGADAALLDSVRAGGFAGYSHTGVNLRNQPSSASFDSFHLGAYAGWQPGALGVRIGAAHAWHRGGVDRAVQYGAVAENETTALHAETTQVFGEAGYRFALDGAATLEPFFGVAYVHLKNQGTTETGGAAALRVRQGNHDVTFSTLGVRGETRLGLTSRLQLTLQGSAGWQHALTDGQPSGTLAFATGSDTFTVSSVPVAKDAAVLNVGAGLELGKNGWLRVGYSGSLASRQSEHAVQGSLHWKF

SEQ ID NO: 17251 - protein, 205 aa, Burkholderia pseudomallei
MHIRLVACAVLALSVAVPAVAADLTYETPPAPSAGEVSSAYDWSGFYLGAQGGYSWSQAKILGSDQDIDSGTSGLHAGYNFQSGNIVYGIENDFNYNFEKNDNANLEWDASGRARVGYAWDRTLFFATAGVAAGGGKVDISAAGKKDGILIGWTAGGGIEHAVTDNILVRGEYRHSDFGNKDFGSTIGDVGATQDKVLFGTSYKF

SEQ ID NO: 17252 - protein, 400 aa, Burkholderia pseudomallei
MKKRTAVAMTAAGLAAVATAHAQSSVTLYGIVDNGIAYQSSSTSLGSTTGGRSAVKMSTGVWAGSRFGLKGSEDLGGGSKAIFQLESGFSTANGTSQFAGGIFTRQAWVGLTNPTYGTLTAGRQYTAYYTLLSPYSPTTWLTGYFGAHPGDIDSLDTSYRTNNSLVYLSPKFYGFTFGGSYAFGGQPGSVNAGSTWSAGIQYMNGPLGIAAAFQRVNNSTSGGGDWGANSTTSNGGAQTAVSAINNGYKTAQAQQRVAVTAGYQFSSAWDISVSYSNVQYIPGVNSTFRNTAIFNTAGAVLHFKPSAQWDFAGGYAYTRATQSNGITSAAQYHQFTLSQYYSLSKRTGLYAVEAYQRANGKTLAGGKIIDATASIGDGFNTSPSSSRSQVGVGVGLIHRF

SEQ ID NO: 17253 - protein, 258 aa, Burkholderia pseudomallei
MRERRLKGIEMQRTTRHLARIAMVGAMLAGTFASAQAADLPVYKKAPPPVEAFNPWMVRLRVLGVLPDAGGSTVNVAGVPSLSSPNSGLSISDQVVPELDISYFFTRNIAAELILGVTRHSISGTGSLANLPIGKTTLLPPTLTLQYHFDNFGAFKPYIGAGVNYTVFFNNSAANAPAAIVGPPAIVATTTSLHVSNAWGGAVQFGFDYMLDRHWGLNVDVKKLWLRPDYSATVSGLPVTGNAHIDPWLVGGGVTYKF

SEQ ID NO: 17254 - protein, 750 aa, Burkholderia pseudomallei
MRYGVAGPERSRRGAAPVGRFGGRRWRSSLCLGVLIAAHPGAAALAGTAAKSDAQKNDMQRNENVREDTRRLAAGAPPAGGELKAISVSAPKDAADDPSVATVGKMPLALREIAQSVSVTTRERIEQQNLFSLDDVMQQSAGVTVQPYVLLTTAYFVRGFKVDSFEFDGVPVVLGDMASAPQDMSAYERAEILRGANGLLHGSGNPAATVNLVRKRPQHRFAASASVGSWGRYRAQADIGGPLNPAGTVRGRLVAAYEDRGFFYDRAKQDTRSIYGIAEIDVARDTLVTVGAQYQSVASVPDMSGVPMARDGTSLGLPRSTFLDVGWGHFDWDTTRVFGSVERKLGGGWKAKVSGEYQAVRSDLKYAGAYGAIDRATGAGGTLMGSAYQFSSYSRSVDANVQGPVRAFGLTHELLFGATYASSSSGQLTAPLLAGAGTPVNVYRWNPDGVPEPGVGPYRQDMQNDISQKGVYGLGRIKLAQPVTLVLGGRLSWWNQDSLGAHYNAGRQFTPYGGLIWDVARDWSWYASYAEVFQPQTKPTWDGGILTPVKGRTYETGIKGELAGGKLNVSLAAFRIDLDNNPRIDATRPCAGRSCYYVNGGSVRSQGFEFEANGRITPWWSVWASYTFDTIRYAKDVANGGAFAAELTPRHLLRVWTNYDLPWQERRWSVGGGVQVQSDFSAASSGVTMRQGGYALASVRLGYRYDRHWRAALNINNLFDRTYYQSLSQPGWNNRYGEPRNVMLTVRGQF

SEQ ID NO: 17255 - protein, 779 aa, Burkholderia pseudomallei
MKRKSILVAPVLAILLNTSLNAEQFSISNLSLKQAIEEISKKSNMPYMVDGKLLDGKKAPNINNVEGVENALNEILKDTNLKATIEDGTILIREKAIGQGTVLEPISVNDSYLGSTTENSNSYTTGSMNTATKLDLSIRETPQSVSVVTRQQIEDMGLQDITDVVNSVTGLSSNNMDSERNSYSARGFGINNYQIDGVTTTYQSGFMTGETSQDLTIYDRVEIVRGSTGLLTGAGNPSAAINLVRKHANSKEFKGDISLQGGSWDKYKGTLDVQTPLDEKGNVRARIATSYEEKKSFIDYYENKKTVLYGVVDADITDNTRVSLGTSYQKNDPKGSMWGGLPSKFSDGTSTNWDRSKSTASDWTYWSSENKNYFTNVEHYFDNDIKLYGAYSYSDNYGDSKLSYVSGSLDKNTGSGLSAAAVQGYENFQKQHNVDIYTSIPLQVNKLDHEIVAGVMYSEQDLEAYNTPSIAGSFNSSIDNFYTYKGTSEPKWGKSFQVVDTNTKQTAGYLVGKISLTDSLKFIGGSRITNWERDAFNYGEKQNYEHNNILTPYAGLVYNIDDNYTIFTSYTDIFNPQSERDKNGKYLNPIEGKNYEAGIKAAFFEDKLNASFSVFRIEQDKLAQTDPSGAMIPGTTTQASIEAEGTTSKGFEIDINGEITDNWNLGVGYSQFEAKDADDNKINTSFPRKTFNVFSKYSWDKFSLGAGANWREKTYENGVEQESYVLVNAMAKYKIDKDLSVQLNVNNIFDEKYYTNIGFYNQVSYGDPRNFTLTMKYDF

SEQ ID NO: 17256 - protein, 278 aa, Burkholderia pseudomallei
MSLTAIVIFIKRPVDTVRFRSPSKRLKERRGTANILTARRFALNKKLLTTAILAATASAAHAQSSVTLYGLIDAGVSYVNHSKSASGSDKLFKYDDGIAQGSRWGLRGAEDLGGGLKAIFVLENGFNSGNGTIGQGGAIFGRQAYVGLSHKDAGTLTFGRQYSFTTDILGANYSTGGNTVAGNYAYHVNDIDQLTSSRINNAVKFQSANYAGFTFGALYGFSNSTSFAGAPATTTGTTTTPGSSRAYSFGLNYANGPIGLGAAYTDIRYPSQATPAFT

SEQ ID NO: 17257 - protein, 399 aa, Burkholderia pseudomallei
MKKGAAAWLVAGSMCAGAHAQGTVTLYGIVDAGLGYTSEQRVAQTKGALGSPVGYRNESSYGFASGIWSGSRWGLKGKEELGGGLAAVFQLENGFNIGTGQAGQGGRMFGRQAWMGLSSERYGTLTMGRQYDPIVDFVGTIGAGAFLTGMGAHPGDLDNIDNQARENNSIKYVSPKFGGLALGALYGFGNQAGSVKNQNTWSVGGQYVNGPFSLGAAYLYATNAYGANGGAWTGSYDGTFASSINEGFASAKSMQIVAAASTYQIGAVTLGLSYSNTRYKSGAFPTFNGTATYNSIGGTVSWQATPELRVAAGYDFTRGSSIDGQSAPKYHQVNFASYYYLSKRTALYGLVGYQKASGKTLDAYGNVVAATASVGDVGNGISSAGDTQTLVRIGVRHTF

SEQ ID NO: 17258 - protein, 772 aa, Burkholderia pseudomallei
MHQPLLARRPLRAALFGAFGLYAAAARAAGPASEPAAAAPPAAASAASAASTSQVRHAAIAAARKDAPALDPITVTATRTASAASRTAASVSVITDSDLEEQQADNIKDALRYEPGVTVRRTAYRPANAALGGGRDGDSSINIRGLEGNRVLLMEDGIRLPSAFSFGPLEAGRGDYADLDTLARIEILRGPASALYGSDGLTGAVNFITKDPSDLLSIHRKKTYFSFRPSYDSVDRSIGATVTAAGGNDRVQAMLIASGRRGHELDTHGDDNSASTRRTRANPQDVYTESLLGKLTITPTARDTIKLAAETVRRRIDTNVLSAINPPTTLGLTANDRLERNRFSIDYDLRDAAARGFQTAHVQFYYQESTQDQDAFETRGGRLQSRSRSNHYSERALGGSAFAESGFATGPLAHKLLYGVDGSIDRIKSLREGTVASPGESFPNKAFPDTDYSLFGAFVQDQIGFGKLLVTPGLRFDAYRLSPSSGDPLFTGKTVSSSDHELSPRVAMLYEASPALIPYAQYAHGFRTPTPDQVNNSFSNPIYGYTSIGNPNLKPETSDTLEAGLRGTLGTGYGPLRYSVAAFAGRYRNFISQRTVGGSGRPNDPLVFQYVNFANARIHGFEGRAEWVMPNGFTLKTAMAFTKGTTQDNGAASEPLDTVNPFSAVFGVRYEPSERWFAQADLLWQAGKRGRDVSSAACQKKTCFTPPSSFVVDLRGGYRFNKHVSAYLGIHNLFDRKYWNWSDVRGIAADSNVLDAYTAPGRSVAVSMKVDF

SEQ ID NO: 17259 - protein, 209 aa, Burkholderia pseudomallei
MAGGFANDRLYGAALQYQRGGLTVGASYPKMNRARSADAAGAVTGDNTFDASSQRNVGIGATYAFSKALIGFAYSHVDVYDPTSNAYFTGTTRPAGEHWQSWKFDHFEINGRYRVTPAFYAGAAYTYTQARADSTAGAFHPKWRPLSTKLDYDLSKRSSGFAEGVYQHAQHAMNARTGTDFDHAYIPGAAHIASGPNQYVVRLALLHPF

SEQ ID NO: 17260 - protein, 430 aa, Burkholderia pseudomallei
MPAARARNHIHRRINWFSVRFPVRIVQRFERQIDHEENHHMKQTKHLAALAVPAGLLLSAGAHAQSSVTLYGIVDAGIAYVHNVQGADGRNEASLFKFSSGNLSGSRWGLRGTEDLGGGLAALFQLENGFNLGTGQQNGNREFGRKAIVGLASNTWGSVTLGRQYDPVVDLVQGLTEDNYFGGVFATPGDLDNYDNSLRVSNSVKYTSPVLSGFQFEALYGFGGVAGATGSGRTYSFAASYANGPLSLGAGYLYADGGANATNGVRTWTGSSDTLFNTVINQGFASAKSIQIVRAGGQYVLGSATFGLAYSNTQYRRDSLSAFSDTAKFNSGSAFFNYQFSPALRAGVGYNYTSLTGPASAHYHQVNLGAGYALSKRTDLYALFGYQKASGHTLGANGAVIDAQASVGSYGANSGTDSQELAIVGIRHKF

SEQ ID NO: 17261 - protein, 815 aa, Burkholderia pseudomallei
MGDKRMGRMRQSQVKGRTRSLLLATTLLTTGFAVPAAAQNAPASLAARTISIPAGPLTSALNQLAAQTGMQVLFDASIARGKTTRGAQGALTANQALSVILNGTGLVARATGPNAITIVGPGASATGAAPAGAIALDTIDIQGETAWGPVQGYVANRSLTGSKTDTPIIEIPQSLSVIGAEQIRDQKLVSKFDEVLRYTPGVVAGTFGTDHRDDWFLIRGFDAQNDSLFLDGMQLSYFAFGGFKMQPFNLERVEVLRGPSASLYGGSGPGGLVNAVSKLPPAEPLHYIEAGVNNFGNAYTQFDFGGPVATQPGNGKMLYRIVGQVQGGGTQTNFVNNDNYFIAPSVTWLPDIDTRLTVFAMASRTRTRASNFLPYVGTATDAPFGRIPTSLFTGDPSADRYTRTQEMVSYQFEKHLTDNATFRQNARAAHVEVNYTGLYGQGWATTPAAANITRGNFLAASKATQLNMDNQFEYRFATGPFRHTTLMGLNLKHYAIDDRQGIGPGTDLNVLNPVYGVNAPFDGPLYQDGYLTQGQLGIYLQDQIKWNRFTLILSGRNDWVGLVFNNRLGPSPNRNDSKFTGRAGLIYNFDNGLAPYASYSTSYNPIVGLNPFGGLLLPETAEQTEVGMKYQPVGLNARFGIALFDLKRKNALTTDPTNVLFQTQNGEVTSRGIELEALANITRDFKVVASYTNYALFVSKDLDPTLIGKVPTAKPRQVASLWMDYTFRDNWLDGFGFGGGVRYVGSSFADAANTLSVPSVVLGDLAVHYEWANQWRAAINVVNIADTQYVASCGFVTSCFYGDRRRITGSLSYKW

SEQ ID NO: 17262 - protein, 359 aa, Burkholderia pseudomallei
MNRLFRCMARLTACIGAIFVIESACAQSSVTLYGRLDAGLLYTSRTFDVKSGRNGGRQLSVIDSGASPTLFGLRGVENIGGGTKVLFTLESGVNLMDGGFKNSNGNLFGRQAFVALAGPYGQAKFGLQFSPFFLALFETDPRGFSQFGSGLVNYVNNVLGTGAFNANGISYASPSIGGFEGSALVALGGKPGDYQAGRQYSASLKYQNGNFMVNAALYSGIGGGTVSTPIPTTLQFSGRTVGTVYKFGAVSAKAQFVNYKVAGSFNSNLYGLGVDWNATPALNLNGGVYYRMDQNDSANSSIMGAIGTVYSLSVRTALYAQVAAINNRGAMNSGLAIGYALYGLQGTTTGATIGIRHNF

SEQ ID NO: 17263 - protein, 219 aa, Burkholderia pseudomallei
MANWLNQLQSLLGQSSSSTSSSADQGLVKLLVPGALGGLAGLLVANKSARKLLTKYGTNALLVGGGAVAGTVLWNKYKDKIRAAHQDEPQFGAQSTPLDERTARLILALVFAAKSDGHIDAKERAAIDQQLRGAGVEEQGRVLIEQAIEQPLDPQRLATGVRNEEEALEIYFLSCAAIDIDHFMERSYLNALGDALKIPQDVRDGIERDLEQQKRTLAE

SEQ ID NO: 17264 - protein, 788 aa, Burkholderia pseudomallei
MQAGADMADGAKYSRALILGASVVSIAALATESGLAQTASPQAEHGSPERPKQAKRKPAKPLAAQQATPDALNARAQAGSAAPVQTLDTITVAATKTRERAIDALAPVSSISLDQIQGLQPNRLSDVFHSVPGVSFQERGDDPATVINIRGLQDFGRVAVVVDGARQNYQRTGHNANGSFFLDPELIGGVDVVRGPTANIYGSGAIGGLVSFRTKDINDVLRPGERWGVDLSGSYGSNNNRGLGSVFGGVRATPDVDIFGGAVYRTQGNYKDGNGTEIGNTGNQVEAGLMKLTVRPALGHEVKFGAVFQDYQYDIGQFNRGPTTTQALIALNRGSSVYASDAKNYSGTVTWNYSLPSDNLFDWHMSVYGNRTDNDQTKTYHYGTTPSAYCNGGFGNNVSGCVGDKRGYVLNTYGVDANNTTRFNVGDWRNALTWGVDAFQDDVITTDSRGNSNITTPSGIRTVSGGFLQLKQNYSTWLEAVSAIRYDRYDLDSGKTSTGGDRFSPKITLGVTPVPGFQPYVSYAEGYRAPSITETVISGAHATGGGPAFFVCPDGTAGLFCFLPNPNLRPEVGKNKEVGINLKYDNIFSANDSFRGKINLFRNDVSDYIDLVASAPVAVPPFGSFSQFYQYQNIANARIRGFEAETMYDAGDWFIGVAGHYIQGKNVATNIGLATITPRKVVTTGGVRLLDRTLILTAQWASYGPNNDVPAGYLPATGYELVNLYLTYNATRDIVLSASIDNLLNQYYRPYAIPGSSTDGTTQNDVLWSSPGPGRVYKAGMKIHFGGA

SEQ ID NO: 17265 - protein, 755 aa, Burkholderia pseudomallei
MKKLHRVILCAGAAGWASIAATQGAFAQAAPVDDSGEIVVTAQKRAQSVQDVGISLTAIGADELRRNQMTDVNQLANQIPNVLATTSSNLPAFTVRGIGLNEFASNFDSPVAVHIDEVYKSKPYMLSMPFYDIQRVEALKGPQGTLFGRNTTGGSVNYYTQEPQFTPSGGFNASIDNYGRVRADGFFNQPLSDTVAARASYYVAQGWGGPYRNLLTGKDFGKPNQLAGRLQLKWAGEGTTARLMVYGFKDKSQLTPYKSPGLFNPDGSYCAAVFTGAIQKDRGACLKFGSFVPGPDPRGLRETQSIRNMNADAPWKADNSAFGGYLRLEQEAGAFQLTSITAFDYFERDQVDDGDNTPYVAVNQNLYSRIKQLSQELRATAKFDRLNVLIGGFFEHDSIDEATNANTSENPLTGLPPFAPRLADDYKQKVRSLAIFTNNEYAVTDQLSLIVGLRYTNDRTSLDGSTYLGANDPSGRRHLITPVIPVDALVAHRTDGTTSFRGGVNWKASRDQLFYASISRGFRSGGYSVPFGGVITTFDPERLTAYEIGSKSRLLDRTLDLNLAAFFYDYKDIQTNVDDPLSPLVPITRNIGGSRTYGAEAELTWRPDPSWTVRLGGSYLDARFRNTTAVITTYAGPVPLDGKRPVNTPKWTAQGLIQKSVPLSDDLDLIGSTDFKYTAKRYLEATNQLFDRAPAYWVQNARLAVASKSGGWEIAAWGKNIFNKDYLTYLNNISFFRIEIYGEPVSYGLSASIKF

SEQ ID NO: 17266 - protein, 379 aa, Burkholderia pseudomallei
MKKTLIVAALSGVFATAAHAQSSVTLYGLIDAGITYTNNQGGHSAWSQSSGSVNGSRWGLRGAEDLGGGLKAIFVLENGFGINNGTLKQNGREFGRQAFVGLSHDQYGSLTLGRQYDSVVDYIGPLSLTGTQFGGVQFAHPFDNDNLNNSFRINNAVKYTSVNWAGLKFGALYGFSNSNEFANNRAYSAGVSYSYAGFNVGAGYLQLNNDFGPTVSNASGAVALDNTFVGKRQRVFGGGLNYTYGPATAGFVFTQSRVNRATAISSGASGVSSGIALDGTFMRFNNYEVNARYAITPAWTVAGSYTYTAGFIENHHPGWNQFNLQTAYALSKRTDVYLQGVYQKVNSDGTGLGAYINGVGGMSSSEKQIAVTAGLRHRF

SEQ ID NO: 17267 - protein, 400 aa, Burkholderia pseudomallei
MTIGRRLAAAAATLGCMHAHAQGSVTLYGTVDTGIIYSTNQQFTRADGSTGGGHAWQMGGGNLVPSRFGFQGAEPLGGGLSAVFTLEQQFLSANGQALQGGTAFSRQAWVGLRQDAVGTLGLGRQYDSYTDMLGASVSSNNWATPYGSHLGDVDNLNAAFNFNNAVKFTSADFNGFTFGGTFSFGGQAGDFSAKRGYAVAATYSRAPVSLSIGYLDLHQPLDAALGGANGYIGDFACSNPGAMYCLLQDARSMRAFGAGGSVTFGAATVALTYTHTRLGDSRYFSASAQPRTQAFTFDVGELNVTYLFTPALQGGVAYIFNAAHTDGRGTTRFHQVNVGANYSLSKRTALYALAIGQLASGTGLGTDANGNAANYAQIPVLGNSNSNRQLAVMAGIRVNF

SEQ ID NO: 17268 - protein, 1011 aa, Burkholderia pseudomallei
MPARAARAGLLLAGALACSAAAHAELLGVDGGGPSGGAGASGPGLAGQPGNGPAPGLGGDRTMPRPGGNGGAGGGAGAASGGSELIHYGGGGGGSDSGGGGGIAIIDPMGAAGGNGGGVAQALSAGADLQSSRGGAGDDGGAMSSGSEPGGGGGGGGSGAAVLAGGGYRALAVSIVGGRGGAGGAGFESGGGGGGGHGIRIDAADVRIELLATQAAGGQGGDGGAGSGSSGGGGDGGHGLAGAANDLRLHVAADSTLRGGDGGASRPVTHRAGAGGPDGTGLSLSASRWQVKTAGLIQGGNGGRGEASREFDGGKGGAGGAGLALAGNMGTLHNRGRIQGGQGATGGTSVLAAPGAAGAGGVGVRIAGNGNRLVNAGRIAGGASADGQQADAVRIDGAGNTFELHAGSVLQGNAVATGSANVLALGGAQPGVFDVSALAAGAPAAWSGVPRYAGFAAYEKTGAGTWRLTGGNAAALSWTVRAGRLAVDAEMAGSAMTVAAGGTLGGTGTVGDTTVRAGGALAPGNSIGTLRVAGDLVFEPGSRFEVEADPDGTASDRVVVSGTADIRGGAVLHVGPEGGFEARQRYVILTAGQRRGQFDAVGSGYAYLAPALSYDATSVALILQRRGAPGSGDLAFADLADTANQRATARAVETLPAAHPVYRAIETLPEGAPPAAFDALSGEVHASTRSALLTGARQAQRVNLGRLRDHLGLAWQAGAPMAASGGAPGAAALPGAPSPAWAEVVGAWQRLDGDGNAAQVRQHVGGLFVGADTALANGWRVGGSLGFTDGRIEVDARASQTDVASYTAALYGGRAWDAGAGRLNLLAGAAYTWHDIASERRVDVGDLRQELTADYGASTTQLFTELSYAMPLGMTAELEPFAGLAWNQLRVRGFTETGGSAALSGASSRDDMAITTLGARVAAPLGAGATLRAMAGWRHAFGDRTPQSTLAFGQGSAFEVAGAPIARDAALLGVGAGIEVARNAFLDAAYAGEFGGGNRQHTASVVLRWRF

SEQ ID NO: 17269 - protein, 754 aa, Burkholderia pseudomallei
MKLCKKKLALATVLVLQQWPVHQAGAQQIAKLDEITVTSTRGLGGDINRAAATVSVVTAEEIEQQNAKDIKDALRYEPGVEVRRSVARTSGISGAGATAGRGGNEGITIRGLDGNRVLLLEDGVPVPRAFSVGTLSAGRGSYLNTDLYQRIEVLRGPASSMYGSDGLTGAVNFVMKDPQDYLNIFNKSTYFSVRPSYDSVDNSFGTSGTFAVGGERWQGMVLLNARHGKETDNKGDRDITGTNRTAPDPLTYDTQSALGRVVFRATANDVFKWTLATTENKTAGSSPSAIGPAAGGTFVTGYQTTSKVQSDRFTFAYERDDADNPVVQKIRANVFYRDANTNQYTFESGTGPTRPRFRDVTYKDQAVGGGVMAESSFNVGGIKNQLVYGFDVSKSQLSQQATGTGWSSCTGTQYCELFPKTNYSIFGAYVQDDIRIGKLSVIPGLRYDSYELDPKASARYDAQANANGQPAARSKDNAISPRLAFLYEVTPAFVPYAQYARGFRAPSPHEVNSYFNNVGVPGGSYMQIANPDLKAETSNSYEIGLRGKVDLADSRVRYSAAAFAGRYKNFIELVQIGGNFQVATPAINQYINSSRANIHGVEARVDWRWNDGWTLRGGFAYTQGDSINRNGVKTGLDSVAPLSVVTGLRYEPNQTWFVQGDLIYAAAKKRGDLANPNVGTQPAFTPSSFAILDIFSGYRVNKNVSFNAGVRNLFDRKYWVWNDIRGLGLASTATNLDAYTSPGRSFNVSMKIEY

SEQ ID NO: 17270 - protein, 453 aa, Burkholderia pseudomallei
MDNPHNSTGEKTYMNKSTLTLAVTAAILGQTLSQQAVAAGFIEDSKATLSFRNFYVNQDIRNQDASRSEEWGQAFFLDYKSGFTQGPVGFGLDVLAMHAIRLDGGGRSGKADIERTPGGMFPLESNGKGKTDFGRVGVTGKLRFSKTEARLGTLLPKMPVLTYNDGRLLPQMFHGAQITTNEIKDLTLTAGKIEHSTERNSSDSYGLSISGANSGSKAQFSNEFYFAGADYKATKDLLLQYYYGNLRDFYKQHFFGLVHDWKLPVGALKTDLRYFYSDSDGKNESASGRAEGYVSSGANGSSGEVDNNLWSAMFTYSLAGHALSAGYQKVTGNSDFPHIFLGNGRTLYLITDSQMGKFASAGENSWVAKYAYDFAQIGVPGLKASLAYVSGDDIDAAGSDTKEWERDFRVDYTIQSGILKGVSFMWRNAALRGNDTRDQDENRLMVSYSLPLF

SEQ ID NO: 17271 - protein, 737 aa, Burkholderia pseudomallei
MEWATSTRVRAIAAGVAFYAAAAGHAQAQAAQPGADARQPGGEAKADTAAGGTLPAISVSGAAERDASVGLVARRSMTGTKTDTPIIEIPQTINVVTAQQIEATGATDINQAFRYIPGFSSYGSDNRSDWYAALRGFTPTVFVDGLQVPNTINLSSWRVDPYMIDSIAVLRGPTSVLYGQGDPGAIVDVQSKLANGERIRELGVQVGNYARKQLMFDIGDTIGKDGTLSYRIVGVGRDGNAQTGPLADQRVSFAPSLKWQPNADTSLTLAATYLQDWGDTSSNFLPSRGTVLPNPNGTISDDLYTADANFDHYRKKQWSLGYQFEHKLNPVWTLRQNVRWMHLSLDDASVYGGGLDDADPTMATMTRYAGLFQFNYSRFDVDNQAQAKFTTGPLSHTLLFGFDYNRQTTTDSEWLAKGPSLNLYRPVYTPIPSDIFSGPNAYPRTDTKTTLNAFGLYVQDQIKWRRWVLTLGGRQDWTRTSQDDIANAASFRQNDHAFSGRVGLTYLGDYGLAPYLSYSTSFNPQIGLKLAGGGLATPTKGRQIEAGLRWQPPGKNLMLNAAVYQINQTNVAMSNPNDPTSSTFVQVGEVRSRGVELSAVGNLSRELSVIAAYVYQDVKNVRANDNTLNKWPVDVPRPRQIASLWADWTWRTGPLTGFGVGAGVRYMSAAAGAADNSLTVPSYTLFDAALHYELRNWRFALNATNLFNRRYVAGCQSDAVCMYGNQRTVIATAKYNW

SEQ ID NO: 17272 - protein, 683 aa, Burkholderia pseudomallei
MPASRCTARAVLPVLALFGLNPLSLAIAETLPAENSVLTLGAVNVTGTDSGPLATTSVLSSVDILGGDILEKMPVAYSWELFRRAPGVMLTEFNQGTTSGKLSFRGFNGEGEINAVKLLIDGIPSNTNDGNMPFIDSVFPMDIDSIEVVRGTSDPRYGLNNIAGNVNINTRTGGNYNKARMRYGSFNTREVQLAKGIETSNWTQNYFFARQQVDGYRDHADTERYSFGGKWFYTPDDGNYRVGLIARHYESEAQEAGYLTEDNARHHPRMSNDYNATDKGTRRMNQVSLHFDTELAQTLSWSARTYVNTFDDRRWTQYWSSSSQQERDTYETQYGAITSLTWRPQVDWLHAFALEGGSDIQKQENRSERYRTLNRVRQAQTRDQRYDFNTVGAYVQAEIEPVESLKIVPAYRVDRISGDFTNEMTGQDYDINDYGLIKQPKLSVVYSPWKVASVYANWGRTFQVGTGAAAYKVPPRNEDLSPSINEGWETGVKFTPAGWVDGRFAYWRQDATGEVSRRLNDPSGESDNVGETRRWGYDLQVNLHPDARTEMWMSYSWQYSKILEPSSALPASKGKEIDHVPHHLWNTGISYQATPALQLTAWMNGQTHYYLERENTQGRYGGYVLTNLGATYKVTEAMSVDLQLKNLTNRDYEYVWYDPDGAEASLHAPGDGRALYAGVTFDF

SEQ ID NO: 17273 - protein, 856 aa, Burkholderia pseudomallei
MAEKRFHELAALLAGAAMAALPMPALAQSDQTYQFDLQAQDLGDALRSVAAKAGWELYASAEDVNGVPAPRLEGELTARQAIERLLADTNLRARFRDGAVIIRGRTAAIVTAGDEAADSEIVVTGSLIRGADIPSARITVSRSDIENAGQSDLGEVVRNIPQNFSGGQNPGVGFGAGQLNSNLNSASHLNLRGLGSDATLTLLNGHRLPYDGAFGGVDISAIPVEAVERIEIVPDGSSAQYGSDAVAGVANIILRRDFTGLKTSARIGGSTDGGNFQQGADVVGGTSWTSGNLIAAYHFAHNSAIYARQRSYTDALAPGNSLYPSIRQHAVTMSGRQTLAPGIEFKVDGLYSNRRSIITSGSLGNAGLTESRYAPTTKAFSIIPAIDVDLGGQWMAKASLAYGKDNSRYNRLFSQPGIAGTVTSGCYCNTTLTTELVIDGPLVSLPAGDLRVAIGGGYRSSSLRYSRYENEGLVAAFDASRKSHYLFGEVQLPVIAPEQSVPLVRRLTITAAARYENYPGMASVTTPKLGAVLEPNRDLTIKASWGRSFKAPTLYQQHVGYEAYLLPANWYVPAASGTIFYASGGNPDLEPERARSWSAGFEFHPQALEGFHVGASYFNVRYRDRVARPIAGSIASAFSQPGYASLLNYAPSTELLDRLAAGSLYGLTNYTAGPFDPANVLVLVDNRNLNLARQDIEGVDINTSVRFSISPDQNIGLTGSATYLKSDQQLTPLLPRTQLAGVIFNPPHWRGRLGASWEARRFNVSMFANYTGSVTDNRYLPSSSVDSILTFDLAARLDIGNSSSRSPALTITIVANNMFNAKPDIIRVTGSTDTPYDSTNYSATGRFLGLTVSRSW

SEQ ID NO: 17274 - protein, 632 aa, Burkholderia pseudomallei
MATNRSRRGRVTLLAVAIAAGPIAFTTADRARAQTVFTTVQAFGDSYADNGNIFRLVGVPFPVEYPTGRFSGGTNFIDTTAELLGVPQFNYALGGAQTGTTNVGPGLPGFFQEWAGFVASGRRFSSSDLIEISIGGNDARDYYQNGGTLAGVPTAAATSAAQATAGINALVGAGARNIVFTVGDVSTLPEANGVPSAAIGSAFSQTYNALMQQSLAGVARSGVRVEWVDIALIGNRITANPAAYGLASAGACPLACIGNPTLQSQYLFYFDQVHLTSRGFEILGQYIVNRLFAPLSIAPQGDVSLNSAMGFATTLFGRLDSFRETSGAMATAMNSYAQVAKARPLYTKAPPPVMAAPNPWSFYIQANGGISDRHATVAANGFDLESVGGTVGAEYRIGGNAMIGGAFDYSNPKAKLYNNAGRIAADSYQLGLYGGWTDAHFFAQALGTIGWQKFHNTRNGIIDTVGFSPDGMTVVAAGKIGYLFDAGRTGIGPIAGLTYARAKVNSYTETGDAALTLSVGDQVAEALVGSAGGQIRFPFLINGRIISPYVNLTAEDDFIGDGRIIQYGATSAPLIVNNWSVPDGSHRVYGRVAAGVVAPVSDTVALTANLSSTFAREGGNDFYGNGGLKISF

SEQ ID NO: 17275 - protein, 744 aa, Pseudomonas fluorescens
MPIPFQSPNTLRRALHLTSALVRPSLAVLCMVPLFTSGARAQSAMELPTVVVRSETPSTTAGGAADGPFTPADTATISGAQAQGATLSTSDSGSLISRIPGGAAWGAGGVSSLPAVNGMGADRVQVSINGMLFGLACPNEMNPPLSFVNPAMIAGARVYMGTAPVSVGGDYTGAKVDVSVAPAQFTPGQALTTHGSVSGFYRSNGNGYGVDANVTVSNEDTSVTYTGGWARASDYTAGDGTTIKSTMYETQNHALSISKKIQDQLFTFQIGGQFIPSEGYVNQYMDLVENKSLFGNARYEGLFDWGKLEATVFANRVRHTMGFIEPDKSGDMPMDTRSTDLGYAVKGTFGVSAHDIIRLGNELYYNNLDDWWPPVEGSMMMGPDTFININNGQRLRLGTFGEWERHIDDKWTAVFGLRNDIVWMNTGDVQGYNEMMYGQNAALFNAQDHARTDFNVDASVILRYEANESSLYELGLARKTRSPNFYERYAWSTNAMAMSMIGWFGDGNGYVGNLDLEPEAAHTVSFTATWHDPAKKVWELRVSPYYSYVLDYIDADRCALSTCPNLPSNLITTNNFVYLQFANHDAWLYGVNIDGKLALWDDATYGKGAFRGSLNFVQGQRTDGVNLYHMMPLNGVVAIDHSIGHWSSSLELQLVSSKTLVSQVRNELETSAYALLNFRTSYELDMVKVDFGVDNIFDTNYDLPLGGANLVNYQVTSMMGSSAAWGYPVAGMGRSFNTRVTVKF

SEQ ID NO: 17276 - protein, 581 aa, Pseudomonas fluorescens
MPFPDRHGVGGRAFFLCPLIAVVSVLGPVTASAQERDDMIVITADEIAAMKANRMEELLNHVPGVSAGDSSISIHGSSKVRVFLDGRPINDPTSSTGGVTWYLVTPQDVERIEIIRDKGAMKYGQDASAGVILITTRTVQTLSGNVKAYGGNQETGYGQANLRYRRGGLGVGVNGGGETTGGYTVNNDKTRYQGGGRLSYDFTDSRSLALAGSYILDERGLAGQPAYPTPHSRKESRNLGLSLRGVYDRTTSTTYYNRGSQHNTDVSRNLDQKLRVAEMGEELSTTLKSGRFGEAQLGGAFKMFRASGSSFDATHEETYSLYAAQSLRCAELSDFSLYVGVRVNFNTAFDNSYNPEIKLVYTGNNWNASAGYGRANNTPSFYQRYNRTSSTIPNPSLDMEVSDNFNLSFFARPHEALSGSVSLFYNRLKDRITYVSLGGVGQYQNFGRVTYRGGDLALDWKPHQAVNLKASYIYMEAKDQESGKTVTCKPRHTVKADLYLKPFQALTAVISGKYTSMAYIDKNNTRSIPGYFLLDLRGEYSVSKTISLFAEIENLLDKDYLYVDGLQGPSRTWILGMNVKF

SEQ ID NO: 17277 - protein, 350 aa, Pseudomonas fluorescens
MNKSTLAIVVSIIASASVHAAEVYNKNGNKLDVYGKVKAMHYMSDYDSKDGDQSYVRFGFKGETQINDQLTGYGRWEAEFASNKAESDSSQQKTRLAFAGLKLKDIGSFDYGRNLGALYDVEAWTDMFPEFGGDSSAQTDNFMTKRASGLATYRNTDFFGIVDGLDLTLQYQGKNEDRDVKKQNGDGFGTSVSYDFGGSDFAVSGAYTLSDRTREQNLQRRGTGDKAEAWATGVKYDANDIYIATFYSETRNMTPVSGGFANKTQNFEAVIQYQFDFGLRPSLGYVLSKGKDIEGVGSEDLVNYIDVGATYYFNKNMSAFVDYKINQLDSDNTLGINDDDIVAIGLTYQF

SEQ ID NO: 17278 - protein, 811 aa, Pseudomonas fluorescens
MSRSLDTLLRPSLLAMAIALCTPLVSPLLMAAQQTSVVAYDLPAGALPTTLNQIASQSGLALSLDPALVAGKTSSPVKGSFDAPGALREALRGSGLQLVQSSVGTYTLMVMEQNALNLSDVNINASSAPLEGSEAAGYRSENISSVGALGGMKLQDAPYSISVTPRALLKNIQATSLDDVIKHNPFTQMYSPTSAGYASAVNIRGFSSSGSLNIANDGLRFTNGADGSNYIEEMEQLEVITGLTGFLYGPASPGGLVNYVIKRPTYERYNSVTLGNAGGENYYLHGDFGGPIDSEGKFAYRLNVLTQDGETAVDMNKRRREMISLALDWNVSDDLLVQFDASHKKTQIRGLTSYWYFNDQSLRPSAASLDNDKLYSQKWSFSDYESDKAGVRAKWRLNDTFTLRAAFAAQQYTSENTYTGPTVSSAGVHSQPLYAFAPIETEEKTGSLFLDAAFDTGFLGHKVTFGYQGNTSRQKQYEDHVPYTPAQPGPQYTSPVGTIPLDQTPQVGKPSYSIGHGNQRLANSTQSNNFLIGDVITFNEQWSAILGVTNTQIKTYANEFVYAKAFGSAETETKYDESKTSPNISLVYKPLPWLTTYATYIEGLQAGGIAPSGTANAGQAFAPEVSEQYEIGAKATLGETLFTLALFNIEKPNGYTTGGNIYVVDGRQENNGLEFSVTGKVIPELTLVGGFTLLDPKIKKTGVSEDEGNVPTNVAKQLAKVYAEYDINQMPGLAMTGGAFFTGKQYTDQSNENDLPSFTTFDAGARYRMRVSENDLTLRVNVSNLANKEYWLNSSYLGDPRTVAFSAQLEF

SEQ ID NO: 17279 - protein, 636 aa, Pseudomonas fluorescens
MIKQTLFVPLAGCLLAMACAQANAAPNPYSNFVVFGDSLSDAGTFSDPDGPAGSVKRFTNRTGPNYQDGSGEFYSLNATQLIGGRLGFTPNQTASADSAVRAGQGLPDGNNWAVGGYRTDQILDSITTTSASGERTRAGYLPSNGFRADPNALYYLTGGGNDFLQGRVTSLPQANAAADRLVDSVRTLQGAGARYIMVWLLPDIGLTPAINGSPLQGFTSQLSAQFNTELVSQLQTVNANVIPLNIPVLLKEAFANPAQFGLATDQNLVATCFSGDGCTENARYGINSATPDPTKLIYNDSVHPTEAGQRLIADYAYSLLAAPWELTLLPEMAQGTLRAHQDELRNQWLADWENWQGVGQWRAIVSAGGQHQDFDDQHAGASADGNGYNLNIGGSYRLDDAWRVGVAAGFYHQKIEAGDNDSEYKLNSYMGTAFAQYQQNRWWGDLAVTAGHLDYDSLKRKFQLGVNERGEKGDTDGYVLAIGGRVGYDIAPEASSPWHLSPFVSADFGKVEVDGYSEKGADATALTFDDQSRNSRRLGLGIQGKYQITAQTQVFGEFAHEREYNDDAQDLTMNLNSLPNNRYTLEGYTPQTNLNRLNLGVSHNLTKEVALRASYNIRKDDDFTQQGINVGVSLDF

SEQ ID NO: 17280 - protein, 227 aa, Pseudomonas fluorescens
MNKSLLGASLVALALAAPVAHAHQAGDVIVRAGAITTAPNESSGDLKFDGNKVSGTKATLDSDTQLGLTFAYMLTDHIGLELLAATPFKHTVGVKGLGGGLDGKLADIKQLPPTLSLQYYPMEPNSKFQPYAGVGINYTLFFDEDLSSARKQQGFSNLKLQDSIGIAGQLGMDYMITDNLLVNASVWYVDIDTKASVNGPTALGYSKTKVDVDVDPWVYMVGLGYKF

SEQ ID NO: 17281 - protein, 694 aa, Pseudomonas fluorescens
MNLRTSLLALAISQAIALPLLADDTAIERISITGDFKKESIQTLSASASVFSEAEISQRNASYLDELLAAAANVNFTAGASRGRFVQIRGVGLRSQFVDPINPSVGVIIDGINYSGLGGAALLFDSQQVEIYRGPQGTRFGADALAGMININTALPSQEQQLKIKLGAGTYNSSEAGLAFGQGLTDTTAFHGSVYQSNSDGFVNNPYLGIKDGQGRDEFVGRVKVSQQWSDEFSSLATVHYTDINNGYDGFTLDNSRTSVADEPGEDNQLSKAFALHNTYTGLTAANVEFNLTAMNSELLYSYDEDWVCNDVNEATLCEAGLHDWGYSSTDAYLRERADRTAELNVKGKEQNWVAGLYYQSRDVDLTRQYTWQSKDFTSSYQTQNVALFGQYEHNIDEKTRLITGLRLERYQGDYLDNNGFSKETDDTMLGGKLALEHDVKDRTMIYTSLSRGYKAGGINGEALAKAQDDGLEIDVNNHYFAPEYLWNAEFGVKGISLDNRTVLRLTAFYMYREDIQLKNWKVAGQKFSGYIDNASSGTNYGLEIDGSYQLTDRITLTGSVGYLETKINDFVTSSGLDKDGDEQAQAPKYQYAFNVNFAASEHVLINIGLEGKDDYYFSDSHYSKSNNYNLMNAKIAYQRDNWELSAWSRNVFDKDYAVRGFEFGNDPRDGYDTHTYVQYGEPRVAGVTFNYGF

SEQ ID NO: 17282 - protein, 411 aa, Pseudomonas fluorescens
TSATNTDIVLSYDADWGNSDSHMPYIYDYFSETLRNRETFGQELRLVSDSADFSSQNMTEWVVGLSFLDIKEENLKNDDGIYGDPSDPYSPYVSQSSSSSKFSSDNISIYANIDYLLNASTKISFGARWEDYESKYSDSFDENFSPSDRMSGGKISVSKNLNEQTNIFFNLAKGFNQGGFNLNLGLDPNSQNNNLYYDPEFLTNYEIGFNSEISNSKITISGIIFHSNREDQQVLISTQVDSSDPNTFTFLTQNAAEGINRGLELNMTMQVSNSLDVFFNLGLLKTEIKNWESRPDLEGRAQAHAPEKSYALGLKWNPFENSFLSINLVGKSDFYYSDSHNNKSKSYALTNINYSYISGQWTYSIWGRNIFDKYYSTRGFYFGNEAPNFTDTLYERHGDPRHIGVTVKYDF

SEQ ID NO: 17283 - protein, 457 aa, Pseudomonas fluorescens
MRYMAIGGLLAGGAIFLSAGDTLSSAFEETVFKGQLRSYMMKRGYDELVEDSMGIFKVRHSSHKASNAIGGYFTFETGSFYHLSAGATFYTSQPLFHNPPSEGGLQLLKDDQSGYSVLGEAFVKWAYGETVLKVGRQRLNEYQFLSDNDIRMTPYTYEAVILENRDYENITLRAAIVSGVKTLVSTTYIDFVNASKDLLKEETVDRNPIRGDYNPAHYDSNGNYIGPPKNLYLASIAYKEKQTDLELWNYYVSDFVNFVYAVGSYTFQAGRFINSLGVQFVKQDDVGAHVAGSIDTYSYGAKLTSVYDTFTFTYAFNKTKYDENSLDGGSIIDMWGANQLYSGLMYNGADQGGTISNVITVEYDFPFYGLNFSLYAGKFDLPNKLTDIFADQDNHEYDMIIKYRPEWNKKLQFKIEAAYIDFDTNYDFRAYEDLHGFNFLHVYDDITDMRFIVNYSF

SEQ ID NO: 17284 - protein, 521 aa, Pseudomonas fluorescens
MPDAGRWNPMIRTVFGAAVVLSISGLMLSDGSARAQSTQSDVVATTRPVVVGGYANRVPARLVPAPAPKQAVPATTSSKQAAAAHVYVPPSLLAGYFPPSYEEWIRGSTMTGDWGGLRTHLEDRGVHIQGHFLEDASGNPVGGKYAGVRYAHEFGLGADINFARLIHHDIGVLHILLTERAGLSLAAGPLGGAVDSVQQIFGSGETVRITRLSLEKQFNRYVSMEAGWINTENDFGQSTMHWGMSIYCQFQTNAICGMPQGLAMNGGYGWYPTAHPGAWLKLYPAGNDHYLVSAGIYNVDNTISNTHNGFKLGLDDTTGVYLPFQLGWHHGNDYTGDMDGNIRIGGYWDTSEVPIVTSKAGAYQPASVELIDLPTTQIRGRFGGWFEGDQMIQRDQSGSGRGTVIFGSFIWGDPRTALSPYFATWGIIRKGTLPNRPNDTISFGGKIAVLNPKMAQYAGMLQQQGQKAIRPSNEPAIELNYGWRPTPWATLRPGLQYVWHPGGTNRYANAFIIDMETGLTF

SEQ ID NO: 17285 - protein, 448 aa, Pseudomonas fluorescens
MRVMKWSAIALAVTAASTQLATAAPFVSDQAEAKGFVEGSTLDLKLRNYYYNRDRKNNPAPGGRSDKDWTQGIWANFSTGYTQGTIGVAAEAFGYGALRLWGPDKYSGSGNLVTDSNGDNEATQGKFGGAVKFRVSKTELKVGDMQPTSPVFAVGGSRILPQTASGLSLQSSEIAGLDLEAGHFYSGTSQDDTSHNGSIWATYANGFNGLKANSADFLGGKYAITDGLGVAFYAAKLEDIWDQYYGNVNYALPLGNDQSLAFDVNLYRTLDEGSSKADSINNTTYSASAAYSFLAAHTVTVAYQKVDGDTPFDYIGIGDNNRGGDSIFLANSVQYSDFNGPGEKSWQIRYDLNMTPYGVPGLSFMTRYLNGDNIDGTKVDASSLYANMYGADGKHHETNLEAKYVVQAGPAKDLSFRMRQAWHRGNDAQSDGDVNEFRLIVDYPISIL

SEQ ID NO: 17286 - protein, 784 aa, Pseudomonas fluorescens
MSSRLKTGLLLGTATLAVCSPGAPSARAQTALPEVTVTAPSPIQRRPHTETKPRPAPRVAASARQRGPAPAETPPVAQATPAPQPGILPIVTDQFATVTVVPNEEIRRSGGGTLGDLLANKPGITGSAYAPGGSSRPIIRGLDVNRVSIIENGTGSNGASDLGEDHFVPVDPLSTNQVEVIRGPATLRYGSTAIGGVVSATNNRIPDALPPCAQPFQSYGLAKPQTLFGGTGCMNGEVRSAVSSVDRGVEGAVLLDAGGNNVAVHADVYGRNAGDYNVPSYPYAAPGMPFNGRQPNSAATAAGASVGGSYLFDGGFIGASITQNNSLYHIPGVEGSQNGTRIDAKQTKFNVKGEYRPDAAAIDAIRFWVGATDYKHNEVGQATAGDPTTDGVRQTFTNREQEGRLEVQLAPFNAGFAAITTAVGVQASHQELTAPSPDDPGSPLNGLFDPNKNTKAAGYVFNELQFTRTTKAQVAGRIEHVELSGTTPAFVPEIFDLNNDPSAIGPATQRNLSFTPKSFSVGLIQALPWDLSASITGQYVERAPKPAELFSRGGHDATATFDIGNPNLKIETAKSVEVGLRRATGPFRFEITAYYTQFSGFIYRRLTGNTCEDGSCVDPGTGTLELNQAIYSQRDATFKGGEFQSQLDVAQIYGGTFGIENQFDIVRATFADGTNVPRIPPMRVGGGLFWRDANWLMKVNLLHAFAQNDVAPIAETTTPGYNLLKAEVSYRTKLDPNAWGAREMLVGIVGNNLLNEDIRIATSYSKDNVLMPGIGVRAFANLKF

SEQ ID NO: 17287 - protein, 360 aa, Pseudomonas fluorescens
MKKNNIALALALLATGCAAGPALAQSTSSVSLYGIIDVSVRAQSGLSGANAPAAGSMGSVNSGVGPTSRWGIRGSEDLGGGLRAIFNLESTLGADVGGIGGVAGTFDRAAIVGLAGHWGAVTAGRQNTLISDSVGLVDPIALRFAGLNPNIQVTSLTGHGLNNEWGATNTKVGSNRVNNSIKYSGSFGGLTARAMYSFGETGVSASRLDTRGLGLDWRQDDLVLTSAYTQFHDASGRTLDAANIGGAWSRGDLRLMLNYGRNKAETSDTAKTTNKILALGARYAVTPVIGLNGGYYKVDRERTGQGDDGFQRLIGFVDYQLSKRTSLFLELDTTKWKNGYQGAGNKTRASGISLGITHNF

SEQ ID NO: 17288 - protein, 876 aa, Pseudomonas fluorescens
MFSGDGGQLLSDKSLTGSAGGGNNRMRFNILPLAFFIGIIVSPARAELYFNPRFLSDDPDAVADLSAFTQGQELPPGVYRVDIYLNDTYISTRDVQFQMSQDGKQLAPCLSPEHMSAMGVNRYAVPGMERLPADTCTSLNSMIQGATFRFDVGQQRLYLTVPQIYMSNQARGYIAPEYWDNGITAALLNYDFSGNRVRDSYGGTSDYAYLNLKTGLNIGSWRLRDNTSWSYSAGKGYSQNNWQHINTWLERDIVPLRSRLTMGDSYTRGDIFDGVNFRGIQLASDDNMVPDSQRGYAPTIHGISRGTSRISIRQNGYEIYQSTLPPGPFEINDIYPAGSGGDLQVTLQEADGSVQRFNVPWSSVPVLQREGHLKYALSAGEFRSGGHQQDNPRFAEGTLKYGLPAGWTVYGGAWIAERYRAFNLGVGKNMGWLGAVSLDATRANARLPDESRYDGQSYRFLYNKSLTETGTNIQLIGYRYSTRGYFSFADTAWKKMSGYSVLTQDGVIQIQPKYTDYYNLAYNKRGRVQVSISQQTGESSTLYLSGSHQSYWGTDRTDRQLNAGFNSSVNDISWSLNYSLSRNAWQHETDRILSFDVSIPFSHWMRSDSTSAWRNASARYSQTLEAHGQAASTAGLYGTLLEDNNLGYSIQSGYTRGGYEGSSKTGYASLNYRGGYGNASAGYSHSGGYRQLYYGLSGGILAHANGLTLSQPLGDTLILVRAPGASDTRIENQTGVSTDWRGYAVLPYATDYRENRVALDTNTLADNVDIENTVVSVVPTHGAVVRADYKTRVGVKVLMTLMRNGKAVPFGSVVTARNGGSSIAGENGQVYLSGMPLSGQVSVKWGSQTTDQCTADYKLPKESAGQILSHVTVSCR

SEQ ID NO: 17289 - protein, 997 aa, Pseudomonas fluorescens
MTALSPTLRPSALALALLFASASPLAFAQSTTGSIAGQAPTSATRIAVRSDTGLTREVEVDARGRYALGQLPLGTYSVVAKDAAGNVLTSRQAVTLTVGTTTDVSFGAVTQLDGVSVTADRAAAAIDVTTVDSRTVITAEQLRRLPLGRSAEAIAQLAPGVVGNSGSGTYSGPSGEQLVSFGGSSAAENAYYINGFNTTDPLRGLGGLTLPYGSIDQQEIYTGGYSAKYGRSDGGVINAVGKRGTNEWHFGGQALWEPASTRADKDDVRYPANGALYRPDSQDRQWVSTQSVYAGGPLIQDKLFVFGSYELERRQGRELDSVEDTNADTGYQYDRPRWYGKLDWNITDNHLLELTGASSRNVYRGSIYNYDYAALTRGSLRGQDDTTKTGGNLWSAKYTGYLTDRLTVSALYGKMKTDDYVGNPAYDGSLTYLSNTSLQNPALNGGNPITNAQTTSLLVDPDRGNRTDNLRLDLNYVIGQHSITAGIDNQNARALNRGSVTSGDGYYWIYGQSNPNVPINTGLGVPATGGIVNGEDGYYVRRYISSALASVRSAQRAQYIEDNWQVSDRLLLNLGLRLDQFTNYNRDGDAYIKQSSGQWAPRLGFSWDVDGDGHFKVFGNAGRYYLALPLNPAFNAAGATLATSTYYTYGGIDANGYPTDLTQFTQAVSSNNNYGVLPDPKTVATSGIKPSFQDEFILGFSKTLGESWVYGAKGTYRLLRSGVDDYCDIDAVLAKSDALGYNVTKQSNPVSCWLINPGKANTFTLVDTGGNYVSVPLNNAELGMPAFKRNYYALNLSLEHPFDSRWYAKVDYTFSRSYGTTEGQLLSNIGQTAVATSQAWDYAQLMDHTNGPQSNDHTHQLKVYGYYQLSPQWLVSANLAVVTGAPFSPLGSYGPNFEDPAGYGIAYHYYQGQPAPPGSQGRLPTMTQLDLGLAYRPDIADGKLGFNLDVFNVFNTQTALWRYPYSELDPGQPDPLYGAANVRQAPRSLRVSVSFDY

SEQ ID NO: 17290 - protein, 675 aa, Pseudomonas fluorescens
MKNSSHRMLVRSLALFGTCGLAAASATAAESREGVQVLQPVVVTASGKGQDEATAPASVSVISGEELQAKPVHDLVDALGEIEGVTVSGATNRRTLQLRGLDRAYVLMLIDGRRVDSTSAVFRGNDFDTGWIPVEAIDRVEVIRGPMSSLYGSDAIGGVINIITKPVSEQWHGSVTVDTVVQEDSAAGDSRKLGFYVSGPLAEKSLGVKLFGSVDRREADGEVNPDPESGGEPLEGFAKNDNHALNGELTWAASDTQNVSLALESSSREHDEQDLDRLGVALTHKGKWSFGDTEIKVYGDRIENNTGNIGGQTNPNKAHNASIDGRVTLPIDAWAQTLTLGAEARYQKLKDPSTLTGRPGTDSFGESDSTDVRQQALFIEDEFMLRDDLLLTLGNRLDHHENFGNHNSPRAYLVYLLNDEISVKGGWGKAFRAPTLLQNSPNWGSASCGSATAGCYIVGSDELKPETSESKEIGVRFDYSEWGGSLTVFRNDIEDMIDISSRTRDPDLAPTFDNFVGFLPDGRPIFAYQNVSKVKTEGVEASFRYNLTADLDVRASYTYLDAKDISAGQDAKPLLYRPRHSGTVKLGWSVSDQWDLGLTGNYVGEQYAYISRDGSELIKLPEYATFDLQSLYAINEHFSVGAGVLNLADKQVDREQSYEINEDGRRYYLSLKAQF

SEQ ID NO: 17291 - protein, 1089 aa, Pseudomonas fluorescens
MHAENSSSQNVNVTIKRSNTELENVLNDIEKQTDYLFIYNKFVNVDRKVSVNLKKASLEEVLANLFAGTDVKYSVDGSYILLSAGGTTTTISLSAQQGKMVSGVITDINGEPIIGANVIEKDSESVGTVTDVDGKFTLALDKPAATLVVSYIGYLTKEVPVGSQSVLKIILSEDTQNLEEVVVIGYGSVKKSDLTGAVGSIQVDKVQGISVKSVDQMLQGRTSGLYMVQNSGMPGASSTVRIRGGNSISGGNEPLYIIDGMPVYPSADASQTALSPLNSIPTSDIESIEVLKDASSTAIYGSRGANGVIIVTTKKGKSGKTSVAFDAYWGIQNIYKKYDLLDSRSFEKLANEALVNSGGAAIYDESLTPATTDWQDLTSNKNALTQNYQLTVSGGNDKTTFLTSFNYFNQEGVIKASEMKKYAFRANIDHKISSTINLGLSLTMTKVDNNRVGNSVLQSRLTTPSNLPVMQDDGSYTFSDNNGVITFDNPVGVINEKVDWHTNFRSLNNAFVEWNIIKGLKFKSSFGIDIDYATNKSYNPRSVYSGSQKNGEAKKISNNTYTWINENILTYTNTWGVHSFTGMVGYTQQQSAYDGFNAGSYGFLNDNLQMNNLGSGTTYTAPGSEVKKWALNSYLARVNYTVNNKYLLTASIRADGSSRFGSDNRWGYFPSAALAWRASEESFIKDLNIFSNLKPRVSFGITGNQDGIGTYPAYALLGSNGYVAGGDKVTGYYPSQVANTNLKWETTAQFDAGIDFGFFNNRLTVVIDGYYKKTRDLLLKVKVPGSSGFSSGLKNIGEVENKGFELAINATPIEGDFTWNTSLNLTYNKNKVLDLGDVSFIYPSQPGQDETGIHLGRIIQVGQPLGTFYGYVYDGLFSTTDDIASSAQPTAKPGDIRYKDISGPDGVPDGVINDLDRTIIGCAQPKLFGGFNNTFSYKNFDLNVNTIFTIGNDVYNGTRVTMENMQGSTNMFASTMNYWTPDNQNAPLPRPLRSKAVMRVSNQYVENGSYLRFQNITLGYNVPTEFLSFTKYVSGLRVYASLQNFITITSYSGDNPEVSKYGQDNLGAGYDAFSYPFAKSVLFGLNVKF

SEQ ID NO: 17292 - protein, 485 aa, Pseudomonas fluorescens
MEAREGGLVSFVTHFPFVVLVLSLLKGAWSQRAAAALALALLGIGLAPAQAQNAGDSQPGSSATAVDTVPDPTEDRLAFHGQATYVWQRKPSFGAAYSGENSLGTERAKSYSFTSTLDLGLRLWHGAEFHFNPEVSQGVPFSGLHGLGGLPNGELAKSSGTSPTFYRARAFVRQTWGLGGGEETLEADFNQFARTVDKHRVVLTAGNFSVLDVFDLNPYGSDPRTQFLNWSSLTHGSFDYPADARGYNWGVSLEYVGDGWSVRFGHFLQPLESNGLKLDTRMFEHYGDIVELEKRYHLAGRPGAARLLLWRNKAKMGKFSDAIAFGQANNVTPDVADVRAEHAKVGVGMTLLQEINDSLGVFFRANMSDDKTETYAFTEIGKQVAGGGTLKGASWGRPNDELGVAMAVNMLRSPHRDYLAAGGLGAFLGDGALRYGPEQVLEVYYSLALLKYFSISPNFQYIRNPGYNRDRGPAKFYGVRFHAEF

SEQ ID NO: 17293 - protein, 824 aa, Pseudomonas fluorescens
MLMNEATGKKNISTKLTGSVMVRGSLLALAFSLGSAAHAQDQGSAAQAQDQGEGGDGAVGQARSGGLDEIIVTARKREENLQDTPISVTAFSSEALERRQADTVGDVGRFAPNVSLEPAANISGSSASITTFIRGVGQTDFNITVDPGVGLYYDGVYVARTAGALLDLGDVQSIQILRGPQGTLFGKNTIGGAIIVNSIPPSNDFDLEGEIATGSFNRLDARGMINVPVSDRVAVRAVVGLRTRDGYQERLSDGGRQGNVDTLGGRIAIRAELTDNFKATLSFDANRRREQSAASTLLQVSEGFDVIGEAGGFPVTNGGFQNFFWNKVLQAPNCGPEGTPAPATVNCFGPHWFTNNIDKTWGTNRNLSNFDLWGTNLTLDWKIGSVDFKSITAYRKTKAHFSFDFDGSPIPLGESFNNIDQKQFSQEFQLTGTLFDGVVDFTGGLYYLKEKATDNNLLTFAFADFVSGGDVDNDSYAAYLQATINVTDRFSITPGIRYTDETKRFDPSRQVIADDRIGGALLLMSRCFVRRAPIIPPDPAQCPTPDTTVNPQGNQLLPAVEVQTKATEWTPALSLDYQVTDQTLIYASYSKGFKSGGFTQRILPPEPAAPSFAPEFVESYEVGVKNELFDRRLRLNIAAFQADYTDIQLVVQQGLSPKVRNAGRARIRGIEVETQAKLADFLTIQGGFGYVDAYYREVSPTAAPVNVNSRFPMVPKWTASGSFDAELYKGGAGTLSLHGDWSYKGGHFKDSINSPALYQEGYSVFGANLSYELPGDNWDVSVGVTNLTDKRYLLGGYSELQQTGAATGAYSRPREWFLKLRYRY

SEQ ID NO: 17294 - protein, 2455 aa, Pseudomonas fluorescens
MVNNNLYKVENTLRSIAKRYKSVKYSLGLAILFLMMGVSAFSEEVVAQEAVAQQEVMTTEQIASSKENLRNSVGSLQSKIDAARAENEKGLAGLRLELIQLMEQGDQVVKSPWASWQFGANYMYSKWNGTYKGRGDKSEKYPFEGIFSRSTNVFGRVATARTADQKATLNSIIAANGGFNPNGNGLNYGLITRAAVLEDPMSIEVSAGIRPKNIQKGAITLNVPPVNVQPPTPSAAPGVPNTPSAPNINIPSFAPVAPKVEAPIIPAPPTFAVVLGADCNEGCGSGSGAQPTDRPRQNSIGSFVNSSDKSSQNTTTWLHYTWKRNRLAEKAYAFKMYVETDTSDINHPVTNTAPSGNDYYFNSYNMTGEFPSPVLSSQGTNLNNQHFFIGGSRFWEIDNYNSSWYPNPPGGVYEIPGNKNIYLGGILTLGMVSQENGATLLNSGLITDKAEKDDKWIKEMPTTPGKDYLEVKGPSYDPAKHDETVYKIKRSNDGYVGYKVGIAQVEENSIKGWGISGGNRWAMWENQKLYNNGTIDFRGERSIGMYIYLPKQTGNKDLTSYDTMVTYAKMVNKINGKILLSGKESYGMKIAAHSDPSAEMVNEGEITLRKNPNSTKGDLADRADNSAAMALMADATVSNKVSLASGKAVNKGKINLQDNISNALGMFVNIDSNMTNQNEINISALAQKDGNGKYKPNVGMRADQVESQYSTATSFDTTVINDKTTGVTGKISLTGQGNIGMLASGKNTTGPNGKGTATAINKGEINIDKGTGAGAVVAKDNYGMLSISEGSVINEVDGKITLGTAAGSVGMAALKETNKHSTAENKGIITVNGAKSTGVYNTGHFLMDNTKAEINVKGNQSIGLYAYGTDATHTKTELKQGKVTAANSGVGLYSDKATVNLDNSTGNLKLIANDGGLLFYNYDSGVSGTPVANGKFRLVGSRDIAATINNGGYAFYLKNTTIQTNGSITGLAAFFNSMFDNANSTKKIDITLNPGGTLMVLDKPTGGNIKLSSVATASSIASSLGNRVTINNASTKYKVYAVYRGKLEIDQNVNLNNDSTTTNPDAFYKVDFRSSTMTLNSGKTVTGTKGGQVALFQGNYDEGGTSKGKVGDISVTNLGTIKLSGNSITTGPAASRKTTTAMAGDFITLTNKGTIEVSGNNGVGIYGAGGSKVTNAQGATIAVGQEGVALYGANRLGSSTLGDRTISVTNAGTLKGINGKTKAFGIFAENTLAVNKSVLTNSGTIDFSNSQQSIGIHSINSTVSNTGKINMGLKGVAINAKNSNITSSGDITLAGNGIAFNFSGAFTGRTLNLTSKVILNGNGNSIFNLKDMTFSSSGSSLNENLNIVSNNKSFSYFSMDNSVLTYDKNKTFAGNKVTLVSAKNSTVDWRANLTLSGQESVAFYLNGRKAGTAPELKTAAGKTITLTGNKSVGAYGVNGARIENNSNITVGANGAAIYSTGAAGTLKNTGILTLGKNSVGMYMKDGASLSHTGQINSTQEGAKGLVVNSGTATTYTNNGKINLTGTSSIGIHAEGAAHTINNRNSITVGNTTGKDQSVAIHLKNGGTVRNFNAIKAGNKSIGIYGTTALASLESNSSLTVGDGAIGIYAKGGNVNLNTNSKLTIGKTLGTNQEAVGVYYVGNGGTVNNNLTSFTIGKGSIGIVDAGTGNSTINNNLASVALPGDAVYTYTSNANSNVVGNTKITSSGNGNYGYYVAGNLTNNAGASMNFSSGTGNVGIYSAYRAGGTGVARNAATITVGKTDLENELYSIGMAAGYTNTKNTTQNRVGHIVNTGTINVGYDNSIGMYASGVGSVAENDGTINITGKKAIGMYLENGATGINTVNGKITIEASAQNAIAAYSTGKNTIFKNYGTITLKAPNSKGIVTANGAKDNVVEGTIVAQNGSAEKTKNIEGTAGGDKKFGDKTLSVPKGGLRNSTITDANGKVLTPAEIDVTTGTNLSVTDPSKAAKNMKVSQEHKDFGSVSRIGMYVDTSGVNFTNPIQGLQHLRGLQKADLIIGAEATEYTNAKTIAVGPNILRRYNNAIDASGLEKFDVISGSLTWAAVPRRLYGTGKIQSVVMTKVDYKEYAKNSTTPYNFLDGLEQRYDMNTLDSKEKRVFNKLNGIGKNEAILLSQAFDEMLGQQYANVQQRVQATGDILDKEFNYLRDEWRTASKDSNKIKTFGTRGEYKTETAGIKDYKYNAYGVAYVHENEDIKLGRGTGWYTGIVHNTFKFKDIGNSKEQMLQAKVGLLKSVPFDENNSLNWTISGDVFVGRNRMDRRFLVVDEVFHAKSRYYTYGIGIKNEIGKEVRLSEGFSVRPYAALRLEYGRTSKIREKNGEVRLEVKQNDYFSVRPELGAELVFKHYFGMKALTTSAGVAYENELGRVANAKNKARVGYTSAGWYDLRGEKEDRRGNVKFDLNVGVDNTRVGVTANVGYDTKGENLRGGLGLRVIF

SEQ ID NO: 17295 - protein, 1103 aa, Pseudomonas fluorescens
MSACISVGAGFFTGTAWCQATNSADVTGSVTDPSGAIVPGVAVTVRDIDKNTEKVILTNSSGLYDTGPLVPSDRYLILFKKEGFAILQRGPMTLNAGVTGLNVEMTIGQASQSVLVQEAAAPLLETTTAEISQTISQETLKDLPQTGGIPDWQSFLTFLPGTRGNGTNNNNAGMGGVSVNGSMPFSNALLDGASTSSPMSNNVINTPIFDSVAEVKMSDSLFSAQYGTGGILYNQISKGGTNRFHGMGWDYFKNTALNATPFGFNGVSGRNSPIHFNDLGGNIGGPVIKNRVFFFFAVENVINHGTPAVSFISVPTAAMRAGNFAGMAPIYDPTSQTVDANGVVTRQPFANNQIPAAMFDPVAKAIQAYYPQPNLPGTVINGVTTNNYAYQFPSSSPKYKYFGRFDADITKNNRITGSAAWNDGPTIGVGPVCPLNCTNQDIFNTNNQLSDYWTISPSLINEFRIGFMGEYDLITPDTLGQGYPAKLGLNIGKADVFPAISITNAYGLGPGSPSFANYKENNFDISDQVTLIKGRHLLHFGGELVVFRADSTAWGAINSGNLGFTGVYTAGSNVGSLASSSGVAYADFLLGYAKSWSASVSPEYGGRLKNPGVFVQDDFKVNPKLTLNLGLRWEGNTGWSEVNGNERSFDPNVVNPATNAPGAMWYAITHANGRTTLQKPVWNMFLPRFGFAYQLGTKTTIRGGFGMYSYPWNVDTYASAGLGNAFTSSGNQSDSTNNVQPVVILSSDGNTNYQGAKGSAVNALYRRAPTTPDAYNGQAVGFNQYTSPVPLLKSWNLTVQRQLSGDLIADVGYIGSHGAHLPFVTDLNQVPENRLSPNDSAFRPYPVFQSLNGYKTDGISNYHAFQAQITRRFARGLMFNANYTWSHMLSNQDSSGWGSLQGATPYQRAYDPMANYGPSNFDVRHMFKGHFAYDIPFGLGRTFANRNKPLDAAIGGWTVFADFITQTGSPFTPSMATNNSYSLSTNNLWYPNVVGDPTAVAGGQNINSWFNVNAFAAPTPGTFGNMGRNIVYGPKLSAVNASLIKTFSITERVKLNFSANATNLLNHPSFALPDKLIGPGHTGQITGVSVGARQMELIAKIRF

SEQ ID NO: 17296 - protein, 493 aa, Pseudomonas fluorescens
MKQLSSVPRKLRVDALAALLLSLAAASAFAQASAPATEPAAGTNDAATPAQPAADAAAPAPTGLWERSNLLGNMGGLRDVLDEHGVTLSLQETSEYLYNTSGGTGRGGAYQGLTQFGFNVDTGKAIGLPGGTFNVSGLQIHGTNLTQRYLQTLQTATGIEANSTTRLWELWYQQSLLDGKVDVKVGQQSVDQEFMVSQNAATFMNATFGWPVLPSTDLPSGGPAYPLSSLGVRLRVKPADAWTAMVGVFDGNPAGRSDGDAQVLNAHGTNFNLRSGAFVIGEVQYALNAPPADPKAPQPAGLPGTYKLGFWYHSQHANDPRYGTDGLSLADPASNGTPATHRGNYGFYAVADQMVWRPSADSPRSVGVFARVMGSPGDRNLVDFAANAGVTLKAPFVGRDNDVAGIAIGYAKIGSHARGLDGDTGAYTTPGYPVRRAETVIEATYQYQVAPWWQVQADLQHFFRPGGGIPNPNAAGARIGDETVVGVRTTITF

SEQ ID NO: 17297 - protein, 801 aa, Pseudomonas fluorescens
MFSFFSINLYAQSDQYIITGKVVDEFNEPILGAVVAVVNSEIVTTTNENGIYVLTKVSLGLHTLQVSYTGYKSLQQEVDINDAIIEKKVQVNFSLQDDIENLQEVQLIGKSHKREIEEQGFAVNLIETKEASLRNIQTNELLNTTVGVKIRQNGGLGSDVNYSLNGLSGSSIRIFIDGIPISTFGSSFNLNSIPASLIKNIEVYKGVVPGHLSDDALGGAINIVLHKSAVNHFNASISYGSFNTIQSSINGLYRFENSGFTVKASGFHNYSDNDYKVSGRSVLVTGLGGEQTPITARRFNDAYRSTGGMFQIGYTDVKWADQFLIGITASDDYKEVQHGAFMTITPYKDRFLESDVVLANLIYQKKDAFIEGLDLSVNALYGERNRAVNDTVAWAYSWNGERAIDFRGDEYEYTWGSQQEGGPTLAKINRKVASVRTGLSYRINSHHKLLANHVYSGIDRKDSDALKSVLENTFQGSRDLTKNIYSLTYELSLFNDKLKTSLFGKHYQQKTVSVDPAIVQDSNGNDTIIDEIVSSENKFAGYGFALSYALTKDLTLLTSAEKAIRLPNETEVFGNDGDNVIANTSIRPEISNNFNVGFRFGKFKLNHHEFTISTNFFVRNIKDRIGLPIETSLNINDELILYVNQGNAKSKGIDAQIDYSFKKNLGINFNISRFDLTTETATGTEFDIPNTPFFTMNSGLRYSFKNLIQKKSQLNLFYTLYFTDDFSYLTSQGANTVGDEFFKVPQQLVQNIGLSYAFPNKSLVMSFDVKNIFDRPVYDNLSVQKPGRAFYLKLNYSINNL

SEQ ID NO: 17298 - protein, 720 aa, Pseudomonas fluorescens
MIHFFKKICWFLRLVLIMHVLYMVNWAYSNNKSVFHVLQPTGVSSLKSDYQEISSDIVADSTNCEIITVTADINNSLVSTSTSIDSLNTKYIIDAADLLKNISGFSVIRYGGANNDFVFRGIPGSKMHILVDTGEIIGACLFRMDPATSYIAPGNFDILNFVKGPQTVLWGPVTSGGTIQFQRYHPRFDLSDVKMRSNFTIGSFNSIKRNIDTIFGNKYGYIRLIGNCDYSGDYRDANNHRVHSAWYKWNFDSNLSFNLKSNTYLIVNLGQGNGRANYATKAMDGLCFSRESYGLKIITSDIDDIISEIEFQIWNHHIHHIMMNNTIPVSMTSVTSTYNKHCCSVVSNINNVDRVLWGSRGMITYQWKDFKCFSGIDIQLNQHKKQKDCMSNAFYVDVFSTDSGIFTELIFDALLNKKIIGGIRLEYSMIDFFNNYGMKRYKNNLLYPAGFIRYENNISSSCLYYCGIGMCCRFPDYWELMSFESNECSKQTDSIFKLKPEKTIQIDVGTYFKKSRVTGWISSYAGYIKDFIYCHHNDNKNEVRSKNSIDYIHNVYVKIYGTEMGLSYQFNDYWYGESNISYPWGWNMNDRCVLPTISPLEGRLTLQFKQKKYIVGASWRLVSSSQRIMGISSLILPNTMLPKKCLNTSCYTPSFEVISMYMSWKASQYYTCNIGVDNLFNQNYKEYINVSNHYSISKNSNKLSVYEPGRTWWMNVEVAF

SEQ ID NO: 17299 - protein, 720 aa, Pseudomonas fluorescens
MSVAFPLLSRCPLALALALCCAPALAQQQLGADAVELDAVNVRGERAQTSTALSGFGATRLLDAPASIAIIDRAQLLDRQARVLSEVLRADASAGDAYAPIGYYENFVVRGYSLNAANSYRINGMSAVGEQSIALENKQQVQLLKGLAGLQSGVNEPAGLIDYRTKRPEHVRSVTLGTDEQGSRYVAADLGDWFGAERTLGLRVNAAREDIDSYVDHADGYRNFLSLAGDWKITPQALLQLDVEYQHRQQRSVPGYQLLGGTQVPRDIDVHRLLGYQPWARPVEMDALNAQLRYAYQFNDDWRATAEASRSRSKINDFSAFAWGCYGAASCADIATPNFFSAQGEYDIYDYRSPDDTRIHDQLRATLEGHVATGALEQHLSMGGEWLRRTVDRFGSVNEFVGSGSIDRDPEVFAQTDVALDPKQRRLDSRQRALVMADRIGLGAQWELSLGARYVQLDERSFDRDGLLERRTRKDTVLPQAALLFKPQQNMSLYASYAKSLAAGGTAPWFADNADQILPPTNAYQLETGAKIDLQGLRLGAALFDIRQAYQFTQPQADGGLLYVQQGRLHNRGLELSADGAATRQLRLFASVAAIRARAEDTDIAEYEGHQAINVPKLRASVQADYSVPGIDGLALLGGVQYSGRKFADRLGNASVPAYTVANLGARYATALGGLATTWRVNVDNVFDKRYWRDSGEYQGDAYLFPGAPRTARLTVQVDF

SEQ ID NO: 17300 - protein, 369 aa, Pseudomonas fluorescens
MQRKGNKLLIQLCSVILLFFTTSWYALANECYIERNAEGDYHMKISSTQLSLASQMVEVPTEIAEATWDVNIQLRGDAIGCKSLGDSKAVHFLNTADPSLISTYTTTNGAALLKTTVPGIVYSVELLCLSCGAADELDLWLPAQSGADNFIPSTQTKWAYEYSDQSWYLRFRLFITPEFKPKNGVSSGTTIAGKIASWYIGTNDQPWINFYIDNDSLKFFVDEPTCATVALAQDQGNVSGNQVTLGNSYVSEVKNGLTREIPFSIRAEYCYASKITVKLKAANKPSDATLVGKTTGSASGVAVKVNSTYDNSKVLLKADGSNTVDYNFAAWSNNLLFLPFTAQLVPDGSGNAVGVGTFSGNATFSFTYE

SEQ ID NO: 17301 - protein, 304 aa, Pseudomonas fluorescens
MLFFTYFIILKLFIIFYKRFINMNYKKILVRSALISLMSFLPYQSFAEPVSSNNIGNENAKEGFYISAKYNPSIPHFRKFSAEETPVYGKDSPTKKVFGLKKEGSITKYSDFTRTDISFEGQNNFISGFSGSIGYIMDGPRVEIEAAYQKFNPKNPANETDTSDYYKHYGLSRAEAMADKKYVVLTNNGVTFSSLMFNACYDITAEGVPFIPYACAGIGADLISIFDDINLKFAYQGKIGISYPITPEISAFIGGYYHGVIGNKYNKVPVKLPVTLIDAPQSTSASVTLDAGYFGGELGVRFTF

SEQ ID NO: 17302 - protein, 610 aa, Pseudomonas fluorescens
MKGFFVVQTAMAFPSLYPYQHFESITPNAQGIRHMRARRLPPLLMAAGPALLQAPALAAMTMEERLQAMEQRMLQLEKKLDKSEQENADLRQKLAATQRVVAATASAGARPAKPAAEQADKSAQAKADKELESWVSSFQQWPTEGFDPNKVTELHERVTTLEKATEAQKAAAEEKAKKSTLMEIGDRGIAWSSADGNYKLALRGYLQTDFRAFFDGSNKTKNPGSNLTDSALIRRARLTLEGQLFKWVDWRVSPDFANSQLQLFDAFIDAHYIPEAALQVGKMRVPMSLERYKTATNLDFVERGYPAQIAPNRDVGAMLHGQIGYPGYKPQYSIQPVFRDWISYEFGWFNGTGDSTPVSQSDVEVDQEKDIAARIFSHPFLKSGIEPLEGLGIGVAGTWGNPINQTLNKLISVGQQTIFNYGGSGTNTSSVVANGNAYRYYPQAYWYYGPFGLLGEYIWTNHEVLATSTSGTKSTTYETSMNNRAWNLEASYVLTGERDGFFGIKPQNNFDPLAGNWGAFVLAGRWTGLTMDSRAFEPFKGANGKDATLANPLTSVSGANTFTTALNWYLNPFMKFQTDYSNTWFTGGGGLKGENRRQEQAWFTRFQIAF

SEQ ID NO: 17303 - protein, 1225 aa, Pseudomonas fluorescens
MKNNLSISLVLSSILCSCLDAQVMDIGTNFYRDYLDLAQNKGIFKATDAPLEFTQRNGTKFTFDKIPNNNARNNKGNFTALGRSFVVTATHVEKGANAVDYNEKRGFFGNTKYEYLTRYSSTSTSKVYNTETTYLRTTKFIVEGSVDPIDIPDLEISPASYNDQDIAEIEVRKIENYFKSIKNSGGANGNDIFAYQAGIGLLSLEKPRIDPITGNPTGGYDTIVDKDDTNNQTLGASLNNINIINSVAYKKKIPLLGDGNEVNGIYVLPFTNDNFRNKLYIGDSGSGFFAYDTLNNKWVLVGVTSVANGTQNYASIVTARDFNDYKKGYENLVSGVNVLGSALVQNKDNIFSSANGSNITLSTNLDLGHGGIVVNSGDFTLNSTNGSKIAKFAGFDIARGASLNLNVTSDTSVHKLGKGSLIVSSSGNKPLRLGEGVVELRALNAFDKIYLTSGRGLLRLGVNENLNDKIFFGNGGGALDLNGFDQTFDNISANSSDAKITNANSQRATLTINGESGKDTIFHASIDKNIELRHSGQGKELVFDGGFDIDGALSLENAKVTLQGHPKTHAIGDASVLTPLAKSKIAAAGLIEPDYMDLARPSTLSQPDWDERKFSAKDGIKLKSSELTIGKDAKLNGDITAKNSVINLSGELTHYIDKFDGSNTYDDGLKYRQDIESKNLLVKDVKFDNKIVMDSDSLLKAGGGATKLKELVINGKDTPLAKDVLLGDGKFEVENLEVSGAQKLGFEPDSFIKKSLKIKSFGSENEPVLDFKKVLILGAGMKFDVDFTAALKGGMVLDKTYTLVSAQSIINEGAIFNNEQKLGDLFMTYTISDGKIVMKLSDKKGENPAVSSNVVQERVSKFSQRENKILSMLKGTPEFVQAISSGDDEALRKLAQKADKDMREISTSSLKMSIKALQNSNELMNSRLFQVTQLRAKADISQFKLAGLESDIMPSAKMAYEAAEASRERNNFWANVNGAYFKDKKSDGDLKFYGTNIGYDRGYDEFILGVSAGVSKAKFSSNVLKDDAKIYSFGAYGLFERGAHEIQSNLNFAFINSKRSLDEAQKASAKGRGILSSNYYKYKISLSKSGEYEQSIKPLLALELGANGIDGFKNDRYDQKSINDFNVAVAAGVEYALNSDKNVFGVQFLVKQSVYNSEDKSYVSLNNSNEYVDYKLDNNKLSYKLTLNSDTKLSENLVLSSQLSGMLDNDKNYGISGGLKIEYKF

SEQ ID NO: 17304 - protein, 999 aa, Pseudomonas fluorescens
MDVRCDQLKRLTGTLCLAFATGLPLPAAATYQETGRPGDPASWRSTEYQQDWGLERMQASQAYAAGITGAGVRIGALDSGFDAAHPEASPGRFHAVTATGQYLDGTPFSVSGVLNGANDNHGTHVTGTMGAARDGAGMQGVAFNAQVYVGNTNKNDSFLFGPGPDPKYFKAVYDALVDAGARAINNSWGSQPKDVSYQTLGGLRAAYAQHFQQGTWLDAAGDVARRGVINVFSAGNSGYANASVRSALPYFQPELEGHWLAVSGLDKNNQQKYNQCGIAKYWCLATPGAAITSTIAGGGYATYNGTSMAAPHATGALALVMERYPYLSNQQALQVLLTTSRQLDGSPTQGPSDRVGWGVPDLGRALHGPGQLLGEFDVNLGRGQGDSWSNGISDQALVQRQAEDAAERQAWQQTLKDRGWEHGLAPGASQQDRSDYAVGMARDAAAAQRVYQGSLVKSGAGWLELTGDSSYRGPTRVDGGLLVVNGSLQSAVTVNTDATLGGNGHIGALTANAGGVVAPGNSIGTLNVAGNLDLQPGSTYRVELSPSASDRLVVGGQASVGGANLSLEPQARPNLLAGGPVASLVGRQFDILQAAGGVNGRFAQVQPAYLFLGTVLDYSANAIELDIMRSGTTFDAVAATANQRASGGAVERLGPGNPVYESLLLSTSADQARDGLRQLAGEIYPALDSMLLSQGSVLRDAFGERVQGAALNANASETTAGEPGSTQLWLKGLGSWGRIEGVQGTESYTSSLGGMLLGLDRDFDEQTRAGLAAGYSDSSLGMGGSHSRATVDSYHLGAYARHDLDQLRLSLGASYSWHRAEVRRDLAYGEVSGRQRARVDARSQQLFAEAAYRLPVSALQLEPFANLTYQHLDRDGFHEKGDAAALHAGDEQRDAWLSTLGLRGRQQWQLGPQQDLQLAASLGWQHRLSGTQDHEHLAFAGSDQAFRVETAPALRDAALVGLQARVGLTRDLDLSLDYQGRLASREQQHGAGLNLQWRF

SEQ ID NO: 17305 - protein, 344 aa, Pseudomonas fluorescens
MRPLVSAALFACLVAARPAAAEPPAITVYGKMDVGYAHVQGANGAVPHQTPTDLVESGQLSGSRLGFKATEDLGNGISALFLVETGVSLDTGSSTSAQFWGRQAYAGLTGAWGKVTVGRHQTPGYYVQCDVDPFEIGTVGNIENLLKRQSRTDNSVQYVTPTFAGLELTALWAQNRAGPETEGNGDDTPGFSGGLRWKYGPVFAAVAYYQDKSKVTDVITRIGNAGATWDLGVVKLHASGGFYRLSDDTAQQTSALAGVTVPLPVVGGSVRASYSQMWEDAAEDAGASKYALGYVRPLAKKTDVYLVFAHIENERNGTKTFDITDAIAKAGGVDGVSAGLRYAF

SEQ ID NO: 17306 - protein, 741 aa, Pseudomonas fluorescens
MFAPISRSMTLTLGLCATVIGPFAQAEETDPKSTDGVLELGSTEILAQGLGSTTEHTGSYTTGSMSAATRLNLSIKETPQSVSVLTRQQLDDFRLDSLSEAMAHVTGVTVQRNDSERPTYFSRGYAINNFQIDGMLNTFSGLKSDSDTIIYDRIEVVRGATGLTTGAGDPSGTIAMVRKRPTTQLDVRTGLSAGSYDNYRGYVDVGGPLGWEGRLRGRTVLAYRDSKSYMDKYASQREVAYGILEADLTDSTVLAVGYDYQNKHVQGASWGTVPYWNAEGGKAHMARSTNLAAPWSSWPLKDQTVFATLDQHLGNDWLLKAAYTHRQSDSDGKVYYGGNGFPAADRSGMNAWSSHFAGVEKMDALDLNLAGPYQLLGRSHDFMVGYGVSELRSTAPAFVGRVDPKDYAKIPDWKYMGAIPKFSDRDSGLDSSRSYTRQKAGYIATRLNPTDRLHVVLGSRYGSWESESKSWTYDANLALTRSSVSKQTQNDQWTPYAGVLYDLTEQYTVYASYTDIFNPQTRKDVSDKFLEPIVGKVYEIGLKGSLFDDRANLSTAVYRSKQDNVPELDDSVPLGPNGQQYYKSGGKGVVVEGFEAELAGEVMPGWQMSLGYSYSHAANGDKTRKNTEQPMNLVRFSSTYQLLAQLTVGGTLDWQSDIYGNGRRPIGRDSNGNIVTTPDRMTQDAYALVGLMGRYQFDEHLSASVNVKNLFDQHYYNNVGFYNGVYMGEPRTVMVSLDWKL

SEQ ID NO: 17307 - protein, 570 aa, Pseudomonas fluorescens
MKTSLSLWKSLSIASAAVGVSVATAGTAQAQANNSELLNQINTYSQGDIAQVNSVFQLSDVSPSDWAFDALRNLVENYNCIVGYPDGTFRGNRPLSRYEFAAGLNACLQQIERMIQSGGSEVTPEDLAALRRLINEFEAELATLGARVDDLEGRVEFLEDNQFSTTTKLKGEVVFAIGDSFGDVNALDFRIAEDTTIDDVVFTPDFLRDGVASGFGGATIVANDDDDTQTTFTDRVRLTLETSFTGKDTLITRLTAGNSSSFSPTAGAVVDDGPDLGSGVGFQTFNLDTGNDVVIDWLAYYFPLRRANVYLAAFGGLHSDYTSTTFGATGLEDFTGGSGSLTQLAASSPIYTIGGGSGLGFNMPLGPVDISLGYLADEAADSTESNGLFNGEYGALAQIAFNLGDRAELGVTYVNSYHDSGAIYDFGGGSAVNGTAWANALGLFGTEANSYGVQGKFDITDRISLAAYGMYTDAKVSGSSDEFDIWSYGLGVAFNDLGKEGNVLGLFAGAPPYLAEGDLKTPLQVEGFYKYQLTDGISITPGVIWLKDAAQGVLGEEDAIIGTLRTTFTF

SEQ ID NO: 17308 - protein, 524 aa, Pseudomonas fluorescens
MKKIMLIASAMSALSLPFSASAIELGEEGGLECGPYGKVGIVGGMITGAESTRLDSTDSEGKKHLSLTTGLPFGGTLAAGMTIAPGFRAELGVMYLRNISAEVEVGKGKVDSKGEIKADSGGGTDTPIRKRFKLTPPQPTIMPISIADRDVGVDTDILAQAAAGQPRLTVEQRAADRIAWLKNYAGIDYMVPDPQNPNARVINPVLLNITQGPPNVQPRPRQNLDILDHGQWRHLVVGVTALSHANKPSVTPVKVLSDKITKIYSDIKPFADIAGIDVPDTGLPNSASVEQIQSKMQELNDVLEDLRDSFDGYMGNAFANQIQLNFVMPQQAQQQQGQGQQQQAQATAQEAVAAAAVRLLNGNDQIAQLYKDLVKLQRHAGVKKAMEKLAAQQEEDAKNQCEGDCKQQQGASEKSKEGKGKETEFDLSMIVGQVKLYADLFTTESFSIYAGVGAGLAHTYGKIDDKDIKGHTGMVASGALGVAINAAEGVYVDLEGSYMHSFSKIEEKYSINPLMASVGVRYNF

SEQ ID NO: 17309 - protein, 110 aa, Pseudomonas fluorescens
MSRPSLPYNSRNAYNISPYYEQGKWSARVNLGWRSEYLTQIGRLNGQQMTDAFTQVDASFGYQATERLRVALEATNLLDETYFSYIGNKNQPYYIYKNGRSFMLSLNFKL

SEQ ID NO: 17310 - protein, 807 aa, Pseudomonas fluorescens
MFPQNASKKVLYFLILQLSFFSITNAQTSVTVSGIIKDKNSKAVLPFVNVLIKTEKDNSFISGTVTNEEGRFSLSKIKSGNYYLEVSFIGYKTSKQSLYVGNLTEFLDINTIELEEETTTLQEVVVTGKTSELSAAMDKKTFSLKDNISQSGGSVLQAMQNLPSVTVQDGKVQLRGNDKVTVLIDGKQTALTGFGNQTGLDNIPASAIEKIEIINNPSAKYDVNGNAGIINIIYKKNKKDGFNGKIGFTTGVGSLWVRKENLPSIRQQYTFTPKINPSVSLNYRKNKVNVFFQGDYLYTETLNKNEFVTRNYDNGDVINSQLKRNRNTHFTTLKSGFDYAINDQNSLTVSGLFGSEKIIDKGDQPFFNGDFSQRNRLWQFLEDELKTTIMATAIYQHKFKEAGHLLNIGFNYTFHREDEKYFYDNYLPTSTGTDAFKLLSDEQVYDFNFDYIKPLKYGRIETGIKLRNRNIPTNMQFIPGVNSVLDTNAGGWATYKELIPAVYGNYIFENKKWEAELGLRIEYVKIQYDVNPNHIVYQSDGYNYTQPFPNLRLAYKINDNNKVSIFYNRRVDRPNEVDIRIFPKYDDAEIIKVGNPALRPQFTNSIELGYKKNWEKGSLYNAIYHRFADGTITRISSTVPPSNLIYATFQNVNKSYNTGIEMVLAQEISKLYAFNINLNAYRNQIDAFTVENKYPTTHTFSADKQEIYSGNIKLNNTFHFPKNIDVQLTGIYLAPDIIPQGKIKSRFSLDLGLKKAIQKGKGELFFNASDLLNTMIIKKEINGQGFNYNSNDYYETQVIRLGYSYKF

SEQ ID NO: 17311 - protein, 286 aa, Pseudomonas fluorescens
MIHQQHMRNIAQWLQENGITRATVAPDWMSIPCGFMACDAQRVICRIDECRGWSAGLALAPVMFRAQLNEQDLPLSLTVVGIAPEKLSAWAGADAERLTVTALPAITTYGEPEGNLLTGPWQPRVSYRKQWARWRVMILPILLILVALAVERGVTLWSVSEQVAQSRTQAEEQFLTLFPEQKRIVNLRSQVTMALKKYRPQADDTRLLAELSAIASTLKSASLSDIEMRGFTFDQKRQILHLQLRAANFASFDKLRSVLATDYVVQQDALQKEGDAVSGGVTLRRK

SEQ ID NO: 17312 - protein, 751 aa, Pseudomonas fluorescens
MPAFAAALPWLRGARSGCRPADRQVRATPLVCPPIRSQEESCMIQRNDTPVLLMTGMILGLLSGTASGQGVEEPAVLEAIAIDADQESASGPVRGYRARRSASATKTDAAIEEIPQSISVIPARVLEDLHSPRIERALDFAGGVARQNDFGGLTLYEYSVRGLTTAEFYKDGFSVNRGYMNSPDAANIERVEVLKGPASSLYGRGDPGGTVNLVSKRPQRERFARLDLGAGRWDRYRGSLDLNTPLDEREDMLLRMNLAIEDNQSFRDYRAGERQFFAPAFAWSIDPDTRLLVQAEVIRNRQVFDRGVVAPGGRLSRISRSAFFGEPDDGRIRNNNETLQAELEHDLAPDWTLRLAGHYKQGRMNGYATEPSSLAADGRTLNRDLRYRDYDWLDGIAQLELRGRLRTGGIEHDLLIGSEYERYAKDERLLRSRPTATLDLYAPLYGQPRPPFSTGVGGRSTHTNELVHSRSLNLQDRMRLGERLFVLLGARYDHYRQRLDNEVNGSRARQTQEELTPRLGLLYRLTPEVGLFANASRSFKPNGGADAGGSPFEPEKGVGYEAGVKLDLLDGRLGMTVAAFHLTKENVLTSDPNDTSYQIATGEVRSRGVDLQLSGRLGESLRIIGAYAYVDAEVTEDNTLETGSRLRNVPRHSASLMGVREFHGGPLHGLELGGALNYVGERSGDAEDSGFELPSYTTVDLLARYRVSDRLSLGLNLNNVFDRTYYERSYSSLWVMPGEPRNLNLSLAWSL

SEQ ID NO: 17313 - protein, 628 aa, Pseudomonas fluorescens
MRRTGREQRHVHSIVRNRTCAMRARRLRPPRRFSHRTARPCARPPARLRTRVRRRAAPRRLPARRRDGGRRRTRRAALQRRAAHRLRAGIAHRRLAAVTAVVARRPRIARRFAASATSRFFFLTVTNSNHRTENHMKNHLEPIRRKPRVPAFATLLLSIAAAPAFAQSPASPAAAQSAADGAAPSAPAPAAAAPAPTGIQERSNLLGSIGGLRDALDDLGVTLNLQETSEYLYNAAGGTARGGAYQGLTQFGLSVDTEKAVGLPGGTFNVSGLQIHGTSLTQRYLQTLQTATGIEANSTTRLWELWYQQAFADGSADVKIGQQSVDQEFMVSQYAATFMNATFGWPVLPSTDLPAGGAAYPLSSLGVRLRVKPADAWTAMVGVFDGNPAGRADGDAQTLNAHGTNFNLRSGAFVIGEVQYALNAPSADPKAPQPAGLPGTYKLGVWYQSQHADDPRVGTDGLSLANPASNGIPATHGGNYGFYAVADQMVWRQSPDSPRSLGVFARVMGAPGDRNVVDFAANAGVALKAPFAGRDNDTVGVAIGYAKIGSHARALDGDTGAYTTPGYPVRRAETVIEATYQYQVTPWWQLQADLQHFFRPGGGIPNPHAAGARIGDETVIGVRTTIAF

SEQ ID NO: 17314 - protein, 632 aa, Pseudomonas fluorescens
MSAIEIVNPLAQIENTFNTTRVSKIAATLGLDYTFWNNFKFSSKFQINHANVRDDIFRPEVDYGPGKTLNQTGNEIVDNGADFDDYTWDNYLTYTNTFNEKHNLTVLLGTSIFRTKGLFYGRTGTTDTNTNRFGDAISDLDGTVTLTPRFNDAAIAVGNNIFDDRLGSVFGRVQYNYNGKYLISVALRRDGSSKFAEDNRYGYFPTGSIGWNISDEPFLEDSSWLNSLKLRASYGVIGNDRIPSFGFVSLLTGEATYAPGNEVTQDDLLNGTAIGLIGNPSLKWEEQVAQNIGFDARLFDSKVSLSLDLFSRKTEDLLLSPQASGLIGSAAPGSALPFVNAGTVENKGIEISVGYNNRIGDDFEFNLGFNITTLDNKVVSLNGNIPPVGGEFGVGISQTGISRMIPGQPLGHFYGYKTDGIYQTQAEINALNASSPEGTYHEGAAPGDLKFVDVNGDGEITADDRTNIGDPIAEVTMGFNLGFQYKNIDFSATAFASIGNDMVRDYERKNLYANRGTYMLERWQGSGTSNSVPRAVGGASINTDLFSDFYVEDASFLRLQNVQVGYTFNEKQLEGLGVDKLRIYVSGNNLFTLSDYFGYDPSASNGAPIGSGIDKGFYPVAKSYLLGVNLNF

SEQ ID NO: 17315 - protein, 322 aa, Pseudomonas fluorescens
MKLKNTLGIAVGTLVAATSFGVLAQGQGAVEGELFYGKKYNDSVNHVEDGYQPGASIGYFLTDDVSVNLTYGKDNHTRSNDGTGNQKIRGDQFGLNSQYHFGSVGDAIRPYVQGGVKYGTLTNVAATGHTGRDQSTFLTAGAGAKWYITDNLYARAGVEADYKLDNGQWDYIPSIGLGVNFGGSGGKVAAAPAPAPVAEEPAPVAEAPVAEMVKVQLDVKFDFDKSVVKPNSYADIKNLADFMKQYPQTSTVVKGYTDNVGTDAYNQKLSERRAHAVAQVLTNQYGVEQSRVSSLGYGKNNPAASNATKEGQAINRRVEASV

SEQ ID NO: 17316 - protein, 785 aa, Pseudomonas fluorescens
MIRTFSLRSAAALAIVAVLATAPAVAQPTSADTAPIQRDEGDITTSQDIVVLGSVGYRGRSDEAEPVLSYDSEFFQRFEPLTAGDALKRVPSVTFLSDVIESDGARLRGLPPGYTQILINGERVPGNGDDRSFFMDRIPAELIDRVEILRSSSARRTGDAVAGTINIELRDGFELDGGYVRAGALYFDDEELEPSLGLVYGGKVGPGRLLVGLNFQGRHNPKRKRSLRYGDSPENDPDFRVNEFDNREDQSDTRDGKDYSANASYEIDGETTGFRISGFYVRTDRTETERSFEYDDPTAISGPLPSGNLLTDNRNVNNIDQENYSIDARLSHDWSLGKTTLRLGHARFDDKQRESENEIDFDVDYDDGEVPVFEQAFTATDIVDKEYTAKLDHEFDLGHDIQLVVGGFYQKKKRNTAILDADGEEDFPGLETSYDQFADSPDDLLSPFDPLEPTDGGVSRIEERRLDGFALVQGKSGGLTWEAGIRYETTRFDITDFTEAAAIPTQRNEYEKWLPSASVKFDLTSRDRITASVARTNRRPDFNFISPALLEEEVGDSDLLGNPQLGPETAWGFDLGYERRIGRTGIVGINAFYRDVTDLIELTNTGEEGSEGEGTFVYQPQNVGDGKVWGVEFDLSTDLGFLGLPDTGLFGNVSWLDSEITDFAGKRRFNGQSDYVYNIGFVQDIPRWGVAFGATHRKQGAAYDRVISEEVRTTYGADLEIFVEKRIGSNFTIRAVGSNLLNGAKREVFNKFDNLEDQQTRDFDEYELESEKAGPVFQLMARYAF

SEQ ID NO: 17317 - protein, 821 aa, Pseudomonas fluorescens
MKRLYFTTIFGLFFSVLSFSQSAIIRGVILDESNKPIENVNIKASTGEGTATNENGFYEIKVPSGIEVTIIFTHVSHKRVEQKFNLKNGQELEYNPVMKIEVEQIATVVINTNTRQSVDGVTSISPQMIRTIKGAQPGVENILKTLPGVNISNELSTQYSVRGGNFDENLVYVNEIEVYRPFLIRSGNQEGLSFVNTDLVQNVDFSAGGFQAKYGDKLSSVLDITYRNPVGFGIRTDLSLLGGSVAAETVSKDGKFSGIAGVRYRDNSLILNNLETEGNVEPVFADAQTYLTYRFSSKFHLNFLGNISLNKYNFQPENRQTNFGTLQEPVALLVFYEGQEKDQYQTYFGAFKANYFVNDDLTLKLITSAYHTVEQEYFDIFAQYRLGEVNTNIGDENLGEVEFSEGIGSQLTHARNDLDAFIVNAEHRGDYKIDDESTFEWSVKYTHEDIRDRLVEYEVIDSAGFSIRPPNFSQPNLQPYESFSGPLRAFENIRALNKVKINRIQAFAQYSKNTTWGTNDVFYNVGVRAHSWTVNGDNIESNSQTVFSPRAQFAIKPDWDKDMLFRVAGGLYYQPPFYRELRDSSGVVQPNVKAQKSFHIVLGNEYSFEIWDRPFKLVTEAYYKGLSDVNPYTLENVRIRYRAQNNAEAYAYGVDMRLNGEFVPGTESWFSFGYLKTEENIDNRGYIARPTDQRLKFGALFQDYVPNMPDLKMYLNLVYNTGVPGGSPSYADPYDFQIRLRDYRRADLGVSLELVNPEKTYDSKWKKAFRELAIGFEIYNMFNNQNSITNTWVRDVYTKRQFAIPNFLTPRVFNVRLSARF

SEQ ID NO: 17318 - protein, 421 aa, Pseudomonas fluorescens
MKKVMLKTSLGVAVALASSQLLASGFALNEQSISSMGTGFAGRSSSADDASTVFGNPAGMSRLKREQFTVGGAAVIAKSDISGPGSNLGGETDGDMVPFVGVPMGYYVKPIDDHWSVGFGVYVPFGLVTDYGSDDAARYWGKKSHVEVVTFQPTVSYAFNDKVSIGFGPTINRIKGELGSSLINPFTPGRNDGEVKIKGDDTAVGYNIGVLVQATDRTRVGLTYHSMVDYKLEGKTRVSTPLIGPFNGNKFDASLKIKTPESVDLSVTHELDDQWTLYAGSTWTRWSRLKDITVQNDVPAPLAGSAFQTITEEQNWHDTWAHAIGASYKVNKEWVLRTGFTVDQSPTNNHDRSPRIPTGDRKVFSVGAGWSPSDDMTIDVAYSYLWEEDTKVNQVSATKGSYQAKYENSAHGIGASLTYRF

SEQ ID NO: 17319 - protein, 731 aa, Pseudomonas fluorescens
MTTSNKLRSRLHRGAALTVLALAVGVAVPAFAQDTGNVTLDDVIVTAQKRSENVQEIPVSVATMSGEKLGDVLAAGEDIVGLSSRVPGLYIESSNGRAAPRFYIRGLGNVDFDLAASQPVSVIIDDVVMENVVLKSTPIFDVQQVEILRGPQGTLFGRNTTAGIVKFDSVKPSQDFSATGTATYGTYGTATFDGGVGGALVKDVLSGRLSVLAQHRNDYIDNGFNGEKDALGGYDEYAIRGQLLYTPTDKFSALLNLHNRSLDGTAAIFRANILTTGSNKINGNFKRDKVFYNGGNNNPQKFDGNGASLKMDYDLGGAKLTSISAYETTNGYSRGDIDGGVAGVGPGFIPFDSASADAIDLDQYTQEIRLASDDASPLTWQVGAYYFKSKFSVASDPGFAPPSTIEHKNTAWAVFGQASYKISDDLKITGGLRYTSDDKDMSVLSSPFGIPAPVSVSDEKVSWDLSAFYDVAPDVSLYAKVASGFRGPSIQGRDIAFGSASSIAQSETIMSYEAGLKSELLDRRVRLNGAVFAYEVKDLQLSAIGGGSNSNRLINADKGQAYGFELDGEWAVNENLLVTAGYSYNHTEIKDSGLTTAACGSGQCTVTDPTTTGGLALINGNPFPNAPKSILTFTARYSYPIGDGELFAYTDWFRQGYTNIFLYESKEYHTNGDFEGGLKLGYAKSDGAYEVALFARNITNEVNLRGGIDFDNNTGFVNEPRIVGISISAKR

SEQ ID NO: 17320 - protein, 363 aa, Pseudomonas fluorescens
MKSRAERSLRTAIVTGSAAVAGLAAGAAHAQSSVTMYGIMDAGIEYANHAAPDGGNSFKLKSGNKNTSRWGLRGTEDLGGGLKAVFRLESGIDLANGASDDGPDSIFARRATVGLKGKWGEVSLGRNFTVTYDYMLPFDPMGYAQNYSWATSSMATGGRKDGLFTRSSNAVRYDGEFGGFKFGALYGFGNVPGSVKTSSKYDFALGYEAGPFAAVLTFDRQNGAADSVTPADTVNYIQGIHAGLSYDFGNLKTMAGYRNYRRTYHTSAANQLSDMYWLGGSYQFTPTFSLVAAVYHQNIKGGSDADPTLVSVRAQYALSKRTVLYAAGAFAIAQHGQKVGVSRDFAGYGTTQVGVTAGIQQRF

SEQ ID NO: 17321 - protein, 607 aa, Pseudomonas fluorescens
MQPSGPASAQTAFTRIQAFGDSYADTGNLWTFTGGIGKLPLYPTGRFSGGTNFVDTTSALLGIPQLNYAIGGATSGTTNVAGPGIPGFFQEWSGLTGFSGKISSTDLVEISIGGNDARAYYRAGGSLAGAPVAAAVTAQQAMAGINALVGSGARNIVFTAGDVSTLPEAVGNANAPAGAAYSRTYNSLMQASLAGVARSGVRVEYVDTGLIGTLIQANPQRYGFSNVGACPVACIGNPALQNQYLFYVDGVHLTSHGFEVLGQYIVNRLNAPLTFAPQGDVASITAMGFAATLFGKLDQFRETAGFAPSTMNSFAAVTKAPYTKAPPLAAISPWSFYMQGNGGISDRQGNVAANGFNLDSVGGTIGVEYRLSANALIGTAFDYSNPKARLFNNAGTTDANSYQFGLYGAWASSNLFAEGLATIGHQDYRNTRPGVVDTITSNPGGTTFVAAGKAGYLFDAGAAKIGPIGGLTYARARVDGFTEAGDPALTLTVGSQTAETLIGSFGVQLRTPFQMQGATIHPYLNLTLDDDIIGNGRLIQYSATSAPVIVNNWTVPNGTSHNVYGRVSAGVVAPFWSNVALTANVSRTIGRSGGDDFFGSGGLKISF

SEQ ID NO: 17322 - protein, 829 aa, Pseudomonas fluorescens
MSSRIPAPSDPVRPCRLPAFSFLAGRGKTILAAATILSSATVLAANAAWAEDTTKTRHARKATHHAAPTSTEVKGGQESISVLGQRSQAPGGGMMRAETAARSVQSVTQAYIEMQSPTSSPLDLIKNLPSVNISTPDPSGNEGGSISSRGLYDNDIGFLLNGMPIANGSSTAASNFIQNYIDSNNIASESMTPGSISVEDPLTSAAAGALSITTRAPSQKFGGFISGSYGSFNTSREFIRLDSGEIGHSGITSYASFSNMHSDAWRGSGTSERKHMDFRMTKTIGERSSIDLFVGYNHSFYYQNRYPTMANFYADKNGLPVTTPISYNATFSATSPSSYYGVHGSDKDQFYASLPMKFALNHLFSVTITPYYQRGAITLNSASRLQEGHTYAGTALQKVDLNGDGKISTATRAAVSTNAMSLNQQGGVVASLHWHGENNDGQIGYWHEENSYSLKTPLSRMNQVTGAQPSDTDTAAYYRTTSGNIYYSTNYVGSYSLNSGFMEDTQFFLNHKMSLTGGIKVVSETLRGQDFLASTASSSNHTFVSPMPRMSWSWDFAPHHQVYINAEGDFRAPSPVNLITRYSTSTGAMTTSGANAKPQYSIKEELGYRYTGDVFLADVSVYNFNVTNRLLSLNTYSNDVPVSETLNTGGETIRGVDLMLSTKPLFHRFRPYLSFEYLHATMDNNLPIAADNGSIDYLKTRGKTPIMTPKFMGSIGLTYTEGPFFLNASIRYTDKQYSTFMNDQAMPSYFSDSLSLGYHLPKFFIAQSPVFKLNFTNLTGQYKLGGVYYFAENAKATTGVYGNKISADSAPSYYIQPPFSMMGSLSTSF

SEQ ID NO: 17323 - protein, 732 aa, Pseudomonas fluorescens
MKLSNSAAKGGAIETTRAHFFAHGAMMALAVASAGFWNAAAHAQVDMAAQAEAAGADEIVVTARKRQEASQNVPLSVAAFNGEMLQSRSVTTVSDIQGLVPGLHYQERGNLQTELTIRGVGGDARNPGIDAGVGMYIDGAYIPRTSGYNADLSDIAQVEVLRGPQGTLFGKNTIGGVINIVTKKPTEELTGFVYGSYGNYDAVRTQAAISGGLAPALSAKVTVASWNRQGYIRSRVRNERLNNEDRLGGRLQLRYNPDTQLDVNFSVDGTRDRRRGVLNQIGSPAGAAAPYFTGNRFVMDADQRNSDARDMWGMTLGIDYVLANDMTITSVTAYRDIDILVYSDIDQTPLDLFHSGPFTDDTTMISQELRLVSPGNKPFRYVLGLFGYKQDIDSDRDIFINGARSIVLDTAANTDSYAAFGNFDYDLTSQLTATVGLRYSIDKKDGKFNQQRTGLDYAIPLKRTDKNLSWTGSLLYKITPRLSTYATVSRGFKAGGFNLDTAGAVGLTASDLNFLPERVTNYEVGLKGRATDWMRFSLAVFQMDYKNKQVSQFVNPPVGNVPVVLVTNAGQARIKGVEFDTTLTPVHGLSLSGNVSYLDAKYRSFPNAAVVGGVLVSYTGNRVERTPKWTAGGSIDYRHPIGSGDLVMGANVSYNGAVDLQPDNLPRNYEGSYTLVDARFGYEMADGKWGLYLWGKNLTKENFATFKRQFAGLDQVAYGAPRTYGVEARFKF

SEQ ID NO: 17324 - protein, 679 aa, Pseudomonas fluorescens
MARPWNSVSRSLLLTALAGVWVDASWADDETVYFSELPVVASVSRLPQRIADAPTSVTVIDRELIKASGARDLSDVFRLVPGFQTFPNNTEAAQVTYHGMSDGEYSPRLQVLVDGRSLHSPLFSNGVNWATIPVALEDIERIEVVRGTNAVSYGSNAFLGVVNIITVDPALAHGFSMSTSYGSQNVRDYAVRAGGRIGDVGDFRFTYKQQNDDGLNNRWDWIDSFRSRLFDFRSDFSLSDRDSLQFSIGQVEGVTQRGRLNTTTWQQKPEDPIRDMRQTDVYVQFLWRRVLSPTSDLQLRYSYVVDRSSDEFSVPFGGRIYRVNQSGDEGARHELEIQNTLKLVDTSRLVWGASWRTDSLRSDWTLPGQGAVQRDLARIFGNLEWKPAHWFTGNAGISGENDSMAGFHTAPRVSGSFHLSPENTIRTGYSRAYRTGSILNYRGDWWTVSGGLPKYQFAANPNMPPERMDTLEIGYLGDWRERRMSLDLRVFNETIRDRLLSIDQNIGNNLIPDTIMPIQKVWIRGFEYQYKWQAFDSTRIVLNQTFANIGSSYLQSALLNPNNTLGSADKSVAIREQTEYSMPHRSSSLLLMQKLPWNLDFSVAGYWQDRMKWSTNSWSQKYRRFDARLAYPFRWSGQGGEVAYTVQSLNGAHNEYKWNAEPSDRIVDRRQWVSLRLDF

SEQ ID NO: 17325 - protein, 791 aa, Pseudomonas fluorescens
MEIVMSDSRARLPRVFNKTAPLALAMHCTFVLPVLFTPALAAAVSQNAVANYRIAPGDLDSALNQFATASGIALSVDASVTQGKTSPGLNGNYPIDQGLNALLSGSGLQAKSLGNNAFTLEKLPAATDTDTLTVVGDWLADARENDVFEHAGARDVLRREDFIKTGATNAREALNRIPGVNAPENNGTGSHDMAMNFGIRGLNPRLASRSTVLMDGIPVPFAPYGQPQLSLAPVSLGNMEAIDVVRGGGAVRYGPQSVGGVVNFVTRAIPKDFAIEAGMEGLLSPPSSQNDPKGSGNLLIGGTADNGLGAALLYSGTRGSDWREHSSTKIDDVMLKTRYAPNEVHTFSSLLQYYEGRAQMPGGLSRAKYDADRFQSTRPYDEFWGRRQLASFGYQFQPDTQHKFNILTFYTNTLRSGYLDQGKNLTLSPREYWVRGVEPRYSQSFTWGETAHEVGVGYRYVSESTHELRYTSKASSGRLPTGNSPYDRDTQSGTEAHAWYIDDRIDVGNWTLTPGMRYEHIQSYQNNFIKGEKQEIGYNAPLPALNVLYHLNDEWNLYANTEGSFGTVQYSQIGKAVSSGSVEPEKARTWELGTRFDNQVLQAEAGLFLINFSNQYDSNQVTDSVTARGKTRHTGLESKVRYDLGDFSPALENLSVSASYAYVNAVIREQGDYHGNQVPFSPKHKGTVGMDYRTGSWTLNLNGEYQSSQFADNANTVKESADGSTGRIPGFMLWGARANYDFGPQYANLNMAVGVKNLFDHEYFTRAYDDNNKGIYAGQPRTVYLQGSLKF

SEQ ID NO: 17326 - protein, 709 aa, Pseudomonas fluorescens
MNKYLLPSLCLMALTSPAQADGSALTLPTGTISAAASEADDSIRLATPTSAGSRLGLSALETPASTDSLSGERIRARGDRSIQDAVSRSAGISRTGTPGDGGTSLSARGFTGQSSVMQLYDGNRMYTGMGTVTFPVDTWAVERVDVLRGPASVLYGEGATGAVINTVAKKPFSGEIENYLRLGYGSFDRQQQALDSGGSLSDTLSYRLNLNRERSNGWIDRGDSSGDFVSAALRWQARDDLAFTLAHDYGDQNPMNYFGTPLIDGRLHKSLRDKNYNVRNDKQHYNDQWTRLTSQWQISDNLSASNELYYLKAQRRWQNAENYNYDPANRQLTRSGNFGIGHQQEQVGDRQTFTFKHSLLGLDSQTLTGVDYNRIRFHMKSNSPFTDSFTHGQPVDLYHPAPGDFASDSPYRDQFKTTTRQMSVFAENRLQLSERWSLVSGVRRDYVHIDRDDLKDDSRSDKTLTGNNWKAGLVFAVTPDTSLYGQYSTSTDGVGGLISLSKSQQQFDLSSARQTEIGLKQMFWDQRGEWTLAAYHIVKKKLLTDVPGDPDLKQQVGQQSSNGLEASLDLQLPRAWQLQANAAIVRARYDDFQQDVDGVQVSRDGKRPVDVPRRTANLWLSKALDDDLRAGAGVRYVDARYADMANRNQLPGYTVVDAALSWKALPSTTLGLQLNNLFDRQYAQSQYNDGQQWILGEPRSFFVTADYTF

SEQ ID NO: 17327 - protein, 705 aa, Pseudomonas fluorescens
MLNKNKLSVLSLLVVSPFASATDVLVVTTPSSNDSYTATTTSSATKNETEIMKIPQTVNVVTKTQIENRAAETVVDALRYTPGVVTEYRGDSNRNDEVFSRGFDYANKILDGIPFGGNASSSMGTTEPWFLDRVEMIKGPASVQYGQISPGGVIAMTSKKPTAQSINKIQLRLGNRNKTEGFFDLGGKLTDDGNILYRLNGLAKKKDTQVRDYEEEKYAIAPAISFLNEDTTFTLLAYLQNSPKNGYRNFLPKVGTLESTPEGKIPQDFNISNPDYNISKQKQHSIGYEFEHNFSDQISLVQKARYAEIDEKYNYLVFNTLASEAKNYPYVLKRMAQHEKTKLNTFGVDTHLNFDIDNGGLYQTLLVGVDYKWTKEDKQFWRDRSGNYDIDWRNPQYQKIDESKQTLFTDQLQKSDQIGIYIQDQIEWNSWNLLASTRYDWIEVKTLDRTNSDKSQQNDGKLTGLVGVLYSFDNGISPYISYSTSFEPNLATNRKPESQPFDPKTAKQTEIGIKYLTPDQKTLATLSLYHIEQKNIPKYDSELGYMTLIGKGESKGVEAQINSKLTDKFAVTGAYSYTRTKVLETSNSAEKGKEFPRIPKNMVSVWGQYEENSGMLNGLKAGAGVRYIGSSQAGADNSFSVPGVTLYDAMVGYELANISPSLKGATIQLNVNNLMDKHYVSSCGMSDACFYGIGRTGTVTFDYAW

SEQ ID NO: 17328 - protein, 922 aa, Pseudomonas fluorescens
MRFSLCGFPLVFSFTLLSVFDTSLSATTISLTPEDSFHGDSQNAERSYNVQAGDVYSLTGDVSISNVDNSALNKACFNVTSGSVTFAGNHHGLYFNNISSGTTKEGAVLCCQDPQATARFSGFSTLSFIQSPGDIKEQGCLYSKNALMLLNNYVVRFEQNQSKTKGGAISGANVTIVGNYDSVSFYQNAATFGGAIHSSGPLQIAVNQAEIRFAQNTAKNGSGGALYSDGDIDIDQNAYVLFRENEALTTAIGKGGAVCCLPTSGSSTPVPIVTFSDNKQLVFERNHSIMGGGAIYARKLSISSGGPTLFINNISYANSQNLGGAIAIDTGGEISLSAEKGTITFQGNRTSLPFLNGIHLLQNAKFLKLQARNGYSIEFYDPITSEADGSTQLNINGDPKNKEYTGTILFSGEKSLANDPRDFKSTIPQNVNLSAGYLVIKEGAEVTVSKFTQSPGSHLVLDLGTKLIASKEDIAITGLAIDIDSLSSSSTAAVIKANTANKQISVTDSIELISPTGNAYEDLRMRNSQTFPLLSLEPGAGGSVTVTAGDFLPVSPHYGFQGNWKLAWTGTGNKVGEFFWDKINYKPRPEKEGNLVPNILWGNAVDVRSLMQVQETHASSLQTDRGLWIDGIGNFFHVSASEDNIRYRHNSGGYVLSVNNEITPKHYTSMAFSQLFSRDKDYAVSNNEYRMYLGSYLYQYTTSLGNIFRYASRNPNVNVGILSRRFLQNPLMIFHFLCAYGHATNDMKTDYANFPMVKNSWRNNCWAIECGGSMPLLVFENGRLFQGAIPFMKLQLVYAYQGDFKETTADGRRFSNGSLTSISVPLGIRFEKLALSQDVLYDFSFSYIPDIFRKDPSCEAALVISGDSWLVPAAHVSRHAFVGSGTGRYHFNDYTELLCRGSIECRPHARNYNINCGSKFRF

SEQ ID NO: 17329 - protein, 391 aa, Pseudomonas fluorescens
MHNGGLMAGWHLDTKMAQDIVARTMRIIDTNINVMDARGRIIGSGDRERIGELHEGALLVLSQGRVVDIDDAVARHLHGVRQGINLPLRLEGEIVGVIGLTGEPENLRKYGELVCMTAEMMLEQSRLMHLLAQDSRLREELVMNLIQAEENTPALTEWAQRLGIDLNQPRVVAIVEVDSGQLGVDSAMAELQQLQNALTTPERNNLVAIVSLTEMVVLKPALNSFGRWDAEDHRKRVEQLITRMKEYGQLRFRVSLGNYFTGPGSIARSYRTAKTTMVVGKQRMPESRCYFYQDLMLPVLLDSLRGDWQANELARPLARLKTMDNNGLLRRTLAAWFRHNVQPLATSKALFIHRNTLEYRLNRISELTGLDLGNFDDRLLLYVALQLDEER

SEQ ID NO: 17330 - protein, 704 aa, Pseudomonas fluorescens
MSPLLTRLLASASALGVSTLPSHALDPTAVELEELQVTAQGGSANPVAAVAGPAANLKTQISSSVVALPGNSTVIDAAEIARLPVQSYGDLFRPVAGFDVSNYGQGGVGFGIALRGFSDAEHGRDVAVFIDGVPINEVSSIHTPNYVDLNPLIPETIRSISIVRGPFSVEAGDANLGGSIFIETKRAEPFSTVGASGGSFGTGRGLATFSQIGPGIQPFLAYEGYGTGGYRENGDLGRYNAFNKVTIPLDLGSSLSLRVQMYGTGFGQPGYLERDRVRAGLVSPRAATNITDGGGKTLQTFVANYVNGGPDDELSALLYASHDVFSRFSDFGAGQRGQVEERETVGGRIRKVWTTSLFDGLPTQFLVGGDWRSDALDVNTGPSVARTFTARTLDLDLSQHNLAAYAQVQVKPAPWLKLTGGARFDQFFYDVRNNLDPALSPKVSPNVVSPKGGAALTPFDWLELFANHGQGFRSPSASSELTNNPRLTPLTIESTEGGGRLVFDRFSLLGTVFFTDIANEVFQPAPGLPVQNLGKSRRDGFEVEAKVLAYREGLDRVALFANYSGVSARLLNGAPSIFIPNVPAYLATVGAEFDVAAPAALLPGGRLTGAAYLSYIGAKPLTEDGVLHSSPYPRVSGRIAYVHQSGWTTYGQATWYPGDRTSESIFNFGSSVSASAAEIVTSPQPRLTLLAGITSSFATGAPLR

SEQ ID NO: 17331 - protein, 368 aa, Pseudomonas fluorescens
MLPGIATAQSSVTLYGVIDEGIDYVNNSGGQHLWRMRDGTYDGMYGSRWGLKGSEDLGGGLSALFKLEAGFSLENGQMRQGGREFGRQAYVGLSKTDLGTVTFGRQYDSVVDFVQPVTAVGQFGGPFVRGGDIDNTDNSFRVDNSVKYASPSFGGFTFGGMYSFTNSNAPGLGTTGMWSLGAAYSHGGFNAGAAYFYAKNPAARFTDGNFIGNTTGAAIGASGPFSYVGAPRNERIMGIGADYAFGSATAGIDYTNTKFDDANGTTSSVTFSNYEVWGQYKVTPAATLGAAYVYTDGKVNYNGARPKYHQVSLMGSYSVSKRTSFYAMAGFQQAAGDAKQADIFDFSIADASTTNRQLMFRLGMLHQF

SEQ ID NO: 17332 - protein, 878 aa, Chlamydia trachomatis
MRPDHMNFCCLCAAILSSTAVLFGQDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFAHNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTIHAPNLSIQKIFLSNSGDENFYENVELLSKKQNNIPLLTLPKEQSHVHLPDGNLSSHFGYQGDWTFSWKDSDEGHSLIANWTPKNYVPHPERQSTLVANTLWNTYSDMQAVQSMINTIAHGGAYLFGTWGSAVSNLFYAHDSSGKPIDNWHHRSLGYLFGISTHSLDDHSFCLAAGQLLGKSSDSFITSTETTSYIATVQAQLATPLMKISAQACYNESIHELKTKYRSFSKEGFGSWHSVAVSGEVCASIPIVSNGSGLFSSFSIFSKLQGFSGTQDGFEESSGEIRSFSASSFRNISLPMGITFEKKSQKTRNYYYFLGAYIQDLKRDVESGPVVLLKNAVSWDAPMANLDSRAYMFRLTNQRALHRLQTLLNVSYVLRGQSHSYSLDLGTTYRF

SEQ ID NO: 17333 - protein, 1013 aa, Chlamydia trachomatis
MQTSFHKFFLSMILAYSCCSLNGGGYAAEIMVPQGIYDGETLTVSFPYTVIGDPSGTTVFSAGELTLKNLDNSIAALPLSCFGNLLGSFTVLGRGHSLTFENIRTSTNGAALSDSANSGLFTIEGFKELSFSNCNSLLAVLPAATTNNGSQTPTTTSTPSNGTIYSKTDLLLLNNEKFSFYSNLVSGDGGAIDAKSLTVQGISKLCVFQENTAQADGGACQVVTSFSAMANEAPIAFVANVAGVRGGGIAAVQDGQQGVSSSTSTEDPVVSFSRNTAVEFDGNVARVGGGIYSYGNVAFLNNGKTLFLNNVASPVYIAAEQPTNGQASNTSDNYGDGGAIFCKNGAQAAGSNNSGSVSFDGEGVVFFSSNVAAGKGGAIYAKKLSVANCGPVQFLGNIANDGGAIYLGESGELSLSADYGDIIFDGNLKRTAKENAADVNGVTVSSQAISMGSGGKITTLRAKAGHQILFNDPIEMANGNNQPAQSSEPLKINDGEGYTGDIVFANGNSTLYQNVTIEQGRIVLREKAKLSVNSLSQTGGSLYMEAGSTLDFVTPQPPQQPPAANQLITLSNLHLSLSSLLANNAVTNPPTNPPAQDSHPAVIGSTTAGSVTISGPIFFEDLDDTAYDRYDWLGSNQKIDVLKLQLGTQPPANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTKQALCGSYVFGDAFIRASYGFGNQHMKTSYTFAEESDVRWDNNCLVGEIGVGLPIVITPSKLYLNELRPFVQAEFSYADHESFTEEGDQARAFRSGHLMNLSVPVGVKFDRCSSTHPNKYSFMGAYICDAYRTISGTQTTLLSHQETWTTDAFHLARHGVIVRGSMYASLTSNIEVYGHGRYEYRDTSRGYGLSAGSKVRF

SEQ ID NO: 17334 - protein, 1033 aa, Chlamydia trachomatis
MIKRTSLSFVCLSFFYLSTISNSQANETDTLQFRRFTFSDRDIEFVLDPFSLITAQNITLSNITSWGEGACTISGNTQTQIFSNSINTTSAAGGAFDMVTTSFTASDNANLLFCNNYCTHNKGGGAIRSGGSIRFLNNQDVLFYNNTSAGAKYVGTGDPNEKNRGGALYATTITLTGNRTLTFINNMSGDCGGAISADTQISITDTVKGILFENNHTLNHIPDTQAENMARGGAICSRRDLCSISNNSGPIVFNYNQGGKGGAISATRCVIDNNKERIIFSNNSSLGWRQSSPASNGGAIQTTQGFTLRNNKGSIYFDNNTATHAGGAIDCGYIDIRDNGPVYFLNNSAAWGAAFNLSKQRSATNYIHTGTGDIVFNNNVVFTLNGNLLGIRQLFHINNNEITPYTLSLGAKKDTRIYFYDLFQWERVKENTSNNPPSPTSRNTITVNPETEFSGAVVFSYNQMSSDIRTLMGKEHNYIKEAPTTLKFGTLAIEDDAELEIFNIPFTQNPTSLLALGSGATLTVGKHGKLNITNLGVILPIILKEGKSPPCIRVNPQDMTQNTGTGQTPSSTSSISTPMIIFNGRLSIVDENYESVYDSMDLSRGKAEQLILSIETTNDGQLDSNWQSSLNTSLLSPPHYGYQGLWTPNWITTTYTITLNNNSSAPTSANSIAEQKKTSETFTPNNTTTASIHSIQASSGSSRAAPNTTEVSVTRHTLTVNWAPVGYIVDPIRRGDLIANSLVHSGRNMTMGLRSLLPDNSWFALQGAATTLFTKQQKRLSYHGYSSASKGYTVSSQASGAHGHKFLLSFSQSSDKMKEKETNNRISSRYYLSALCFEHPMFDRIALIGAAACNYGTHNMRSFYGTKKSSKGKFHSTTLGASLRCELRDSMPLRSIMLTPFAQALFSRTEPASIRESGDLARLFTLEQAHTAVVSPIGIKGAYSSDTWPTLSWEMELAYQPTLYWKRPLLNTLLIQNNGSWVTTNTPLAKHSFYGRGSHSLKFSHLKLFANYQAEVATSTVSHYINAGGALVF

SEQ ID NO: 17335 - protein, 962 aa, Chlamydia trachomatis
MKKAFFFFLIGNSLSGLAREVPSRIFLTPNSVPDPTKESLSNKISLTGDTHNLTNCYLNNLRYILAILQKTPNEGAAVTITDYLSFFDTQKEGIYFAKNLTPESGGAIGYASPNSPTVEIRDTIGPVIFENNTCCRPFIWSNPYAAANKIREGGAIHAQNLYINHNHDVVGFMKNFSYVQGGAISTANTFVVSENQSCFLFMDNICIQTNTGGKGGAIYAGTSNSFESNNCDLFFINNACCAGGAIFSPICSLTGNRGNIVFYNNRCFKNVETASSEASDGGAIKVTTRLDVTGNRGRIFFSDNITKNCGGAIYAPVVTLVDNGPTYFINNIANNKGGAIYIDGTSNSKISADRHAIIFNENIVTNVTSNNGISTNPPRRNAITVTSSSGEIILGAGEGQNLIFYDPIEVNAGVSVFFNKEADQTGSVVFSGATVNSADFHQRNLQTKTPATLTLNHGFLCIEDRAQLAVNRFTQTKGVVALGNGAVLSCYKNNSTNASVTLKHIGLNLPSILKSGAEIPLLWVEPTATTSNRTTTYSADTAAGFSLRDVKLSLIDDYGDSPYESTDLTHAVSSQPILAISEASDNQLQSESMDFSGLNVPHYGWQGLWTWGWAKTQDPEPANSSAITDPQKANRFHRTLLLTWLPAGYVPSPKHRSPLIANTLWGNMLLATESLKNSAELTPSDHPFWGITGGGLGMMVYQDPRENHPGFHMRSSGYSAGMIAGQTHTFSLKFSQTYTKLNERYAKNNVSSKNYSCQGEMLFSLQEGFLLAKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATQRPQAWTVELAYQPVLYRQELGIATQLLASKGIWFGSGSPSSRHAMSYKISQQTQPLSWLTLHFQYHGFYSSSTFCNYLNGEIALRF

SEQ ID NO: 17336 - protein, 1531 aa, Chlamydia trachomatis
MSSEKDIKSTCSKFSLSVVAAILASVSGLASCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACGSFSSAGGASVLGTIDISKNLGAISFSRTLCTTSDLGQMEYQGGGALFGENISLSENAGVLTFKDNIVKTFASNGKILGGGAILATGKVEITNNSEGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGRAEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLAAGAKLKILDSGTPVQQGHAISKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASGDEASAEISNLSVSDLQIHVVTPEIEEDTYGHMGDWSEAKIQDGTLVISWNPTGYRLDPQKAGALVFNALWEEGAVLSALKNARFAHNLTAQRMEFDYSTNVWGFAFGGFRTLSAENLVAIDGYKGAYGGASAGVDIQLMEDFVLGVSGAAFLGKMDSQKFDAEVSRKGVVGSVYTGFLAGSWFFKGQYSLGETQNDMKTRYGVLGESSASWTSRGVLADALVEYRSLVGPVRPTFYALHFNPYVEVSYASMKFPGFTEQGREARSFEDASLTNITIPLGMKFELAFIKGQFSEVNSLGISYAWEAYRKVEGGAVQLLEAGFDWEGAPMDLPRQELRVALENNTEWSSYFSTVLGLTAFCGGFTSTDSKLGYEANTGLRLIF

SEQ ID NO: 17337 - protein, 1784 aa, Chlamydia trachomatis
MKFMSATAVFAAALSSVTEASSIQDQIKNTDCNVSKVGYSTSQAFTDMMLADNTEYRAADSVSFYDFSTSSGLPRKHLSSSSEASPTTEGVSSSSSGENTENSQDSAPSSGETDEKTEEELDNGGIIYAREKLTISESQDSLSNQSIELHDNSIFFGEGEVIFDHRVALKNGGAIYGEKEVVFENIKSLLVEVNIAVEKGGSVYAKERVSLENVTEATFSSNGGEQGGGGIYSEQDMLISDCNNVHFQGNAAGATAVKQCLDEEMIVLLAECVDSLSEDTLDSTPETEQTESNGNQDGSSETEDTQVSESPESTPSPDDVLGKGGGIYTEKSLTITGITGTIDFVSNIATDSGAGVFTKENLSCTNTNSLQVLKNSAGQHGGGAYVTQTMSVTNTTSESITTPPLVGEVIFSENTAKGHGGGICTNKLSLSNLKTVTLTRNSAKESGGAIFTDPTSIPITDTPESSTPSSSSPASTPEVVASAKINRFFASTAEPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGAIHSKTVTLSNLKSTFTFADNTVKAIVESTPEAPEEIPPVEGEESTATEDPNSNTEGSSANTNLEGSQGDTADTGTGDVNNESQDTSDTGNAESGEQLQDSTQSNEENALPNSNIDQSNENTDESSDSYTEEITDESVSSSSESGSSTPQDGGAASSGAPSGDQSISANACLAKSYAASTDSSPVSNSSGSEEPVTSSSDSDVTASSDNPDSSSSGDSAGNSEEPTEPEAGSTTETPTLIGGGAIYGETVKIENFSGQGIFSGNKAIDNTTEGSSSKSDVLGGAVYAKTLFNLDSGSSRRTVTFSGNTVSSQSTTGQVAGGAIYSPTVTIATPVVFSKNSATNNANNATDTQRKDTFGGAIGATSTVSLSGGAHFLENVADLGSAIGLVPGTQNTETVKLESGSYYFEKNKALKRATIYAPVVSIKAYTATFNQNRSLEEGSAIYFTKEASIESLGSVLFTGNLVTLTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTSGSGGTPSTDSESNQNSDDTEEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISVLWKFDSYRQWAYVPRDNHFYANSILGSQMSMVTVKQGLLNDKMNLARFEEVSYNNLWISGLGTMLSQVGTPTSEEFTYYSRGASVALDAKPAHDVIVGAAFSKMIGKTKSLKRENNYTHKGFEYSYQASVYGGKPFHFVINKKTEKSLPLLLQGVISYGYIKHDTVTHYPTIRERNKGEWEDLGWLTALRVSSVLKTPAQGDTKRITVYGELEYSSIRQKQFTETEYDPRYFDNCTYRNLAIPMGLAFEGELSGNDILMYNRFSVAYMPSIYRNSPTCKYQVLSSGEGGEIICGVPTRNSARGEYSTQLYLGPLWTLYGSYTIEADAHTLAHMMNCGARMTF

SEQ ID NO: 17338 - protein, 1751 aa, Chlamydia trachomatis
MKWLSATAVFAAVLPSVSGFCFPEPKELNFSRVGTSSSTTFTETVGEAGAEYIVSGNASFTKFTNIPTTDTTTPTNSNSSSSNGETASVSEDSDSTTTTPDPKGGGAFYNAHSGVLSFMTRSGTEGSLTLSEIKMTGEGGAIFSQGELLFTDLTGLTIQNNLSQLSGGAIFGGSTISLSGITKATFSSNSAEVPAPVKKPTEPKAQTASETSGSSSSSGNDSVSSPSSSRAEPAAANLQSHFICATATPAAQTDTETSTPSHKPGSGGAIYAKGDLTIADSQEVLFSINKATKDGGAIFAEKDVSFENITSLKVQTNGAEEKGGAIYAKGDLSIQSSKQSLFNSNYSKQGGGALYVEGDINFQDLEEIRIKYNKAGTFETKKITLPKAQASAGNADAWASSSPQSGSGATTVSNSGDSSSGSDSDTSETVPATAKGGGLYTDKNLSITNITGIIEIANNKATDVGGGAYVKGTLTCENSHRLQFLKNSSDKQGGGIYGEDNITLSNLTGKTLFQENTAKEEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAHTCPDSFPTADTAEQPAAASAATSTPKSAPVVSTALSTPSSSTVSSLTLLAASSQASPATSNKETQDPNADTDLLIDYVVDTTISKNTAKKGGGIYAKKAKMSRIDQLNISENSATEIGGGICCKESLELDTLVSLSVTENLVGKEGGGLHAKTVNISNLKSGFSFSNNKANSSSTGVATTASAPAAAAASLQAAAAAAPSSPATPTYSGVVGGAIYGEKVTFSQCSGTCQFSGNQAIDNNPSQSSLNVQGGAIYAKTSLSIGSSDAGTSYIFSGNSVSTGKSQTTGQIAGGAIYSPTVTLNCPATFSNNTASMATPKTSSEDGSSGNSIKDTIGGAIAGTAITLSGVSRFSGNTADLGAAIGTLANANTPSATSGSQNSITEKITLENGSFIFERNQANKRGAIYSPSVSIKGNNITFNQNTSTHDGSAIYFTKDATIESLGSVLFTGNNVTATQASSATSGQNTNTANYGAAIFGDPGTTQSSQTDAILTLLASSGNITFSNNSLQNNQGDTPASKFCSIAGYVKLSLQAAKGKTISFFDCVHTSTKKTGSTQKVYETLDINKEEKSNPYTGTIVFSSELHENKSYIPQNAILHNGTLVLKEKTELHVVSFEQKEGSKLIMEPGAVLSNQNIANGALAINGLTIDLSSMGTPQAGEIFSPPELRIVATTSSASGGSGVSSSIPTNPKRISAAAPSGSAATTPTMSENKVFLTGDLTLIDPNRNFYQNPILGSDLDVPLIKLPTDTSDVQVYDLTLSGDLFPQKGYMGTWTLDSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKMVGKTKAIKKMHNYFHKGSEYSYQASVYGGKFLYFLLNKQHGWALPFLIQGVVSYGHIKHDTTTLYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 17339 - protein, 83 aa, Helicobacter pylori
MKKMKFTKNFFTPTLIASALALSTTYANAAAFQLAEVSSSGLGRAYAGEAAIADNAAVVATNPALMSLFNTKQFSMGGGLCAV

SEQ ID NO: 17340 - protein, 640 aa, Helicobacter pylori
MKKMKKTILLSLTLAASLLHAEDNGVFLSVGYQIGEAVQKVKNADKVQKLSDSYEKLSRLLTNDNGSGSKTSAQAINQAVNNLNERAKTLAGGTTNSPAYQATLLALRSVLGLWNSMGYAVICGGYTKSPGENNQKNFHYTDENGNGTTINCGGSTNSNGTHSSNGTNTLKADKNVSLSIEQYEAIHEAYQILSKALKQAGLAPLNSKGEKLEAHVTTSKYQQNNQTKTTTSVIDTTNGAQNLLTYAQTIVNTLKDYCPMLIAKSSSNGMANNANTPSWQTAGGGKNSCETFGKEFSAASDMLNNAQEIVKKTQQLSANQPKNITQPHNLNLNSPSSLTALAQKMLKNAQSQAEILKLANQVESDFGKLSSGHLKDYIGKCDASAISSANMTMRNQKNNWGNGCAGVEETLSSLKTSNASFDSQMPQINEAQTLASTLIQELGNNPFGNVGMIVSSATNNGALNGFGVAAGYKQFFGKKKRWGLRYYGFFDYNHAYIKSNFFNSASDVWTYGVGSDLLFNFINDKKTNFLGKNNHFSMGLFGGIALAGTSWLNSQFVNLKTISNVYSAKVNTANFQFLFNLGLRTNLARPKKKDSHHAAQHGMELGVKIPTINTNYYSFLDTKLEYRRLYSVYLNYVFAY

SEQ ID NO: 17341 - protein, 640 aa, Helicobacter pylori
MKKMKKTILLSLTLAASLLHAEDNGVFLSVGYQIGEAVQKVKNADKVQKLSDSYEKLSRLLTNDNGTNSKTSTQAINQAVNNLNERAKTLAGGTTNSPAYQATLLALRSVLGLWNSMGYAVICGGYTKSPGENNQKNFHYTDENGNGTTINCGGGTNSDGTHSSHGTNTLKADKNVSLSIEQYEKIHEAYQILSKALKQAGLAPLNSKGEKLEAQVTTSKYQEGNQTKTTTSVIDTTNDAQNLLTQAQTIVNTLKDYCPMLIAKSSSNGMANNANTPSWQTAGGGKNSCETFGKEFSAASDMLNNAQKIVQETQQLSANQPKNITQPHNLNLNSPSSLTALAQKMLKNAQSQAEILKLANQVESDFNKLSSGHLKDYIRKCDASAISSTNMTMQNQKNNWGNGCAGVEETLKSLERSNASFDSQTPQINEAQTLASTLIQELGNNPFRNMGMIASSTTNNGAMNGFGVQAGYKQFFGKKKRWGLRYYGFFDYNHAYIKSNFFNSASDVWTYGVGSDLLFNFINDKKTNFLGKNNHFSMGLFGGIQLAGTSWLNSQFVNLKTISNVYSAKVNMANFQFLFNLGLRTNLARPKKKDSHHAAQHGMELGVKIPTINTNYYSFLDTKLEYRRLYSVYLNYVFAY

SEQ ID NO: 17342 - protein, 641 aa, Helicobacter pylori
MKKTKKTILLSLTLAASLLHAEDNGVFLSVGYQIGEAVQKVKNADKVQKLSDAYEQLSRLLTNDNGTNSKTSVQAINQAVNNLNERAKTLAGGTTNSPAYQATLLALRSVLGLWNSMGYAVICGGYTKSPGENNQKNFHYTDENGSGTTINCGGSTNSNGTHSSNGTNTLKADKNVSLSIDQYEAIHEAYHILSKALKQAGLAPLNSKGEKLEAHVTTSKYQQDNQTKTTTSVIDTTNDAQNLLTQAQTIVNTLKDYCPMLIAKSSSGSSGTATTNTPSWQTAGGGKNSCETFGAEFSAASDMINNAQKIVQETQQLSANQPKNITQPHNLNLNTPSSLTALAQKMLKNAQSQAEILKLANQVESDFNKLSSGHLKDYIRKCDASAISSANMTMQNQKNNWGNGCAGVEETLSSLKTSAADFNNQTPQINQAQNLANTLIQELGNNPFRNMGMIASSATNNGAMNGLGVQVGYKQFFGEKKRWGLRYYGFFDYNHAYIKSNFFNSASDVWTYGVGSDLLFNFINDKNTNFLGKNNQISFGLFGGIALAGTSWLNSQFVNLKTVSNVYSAKVNTANFQFLFNLGLRTNLARPKKKDSHHAAQHGMELGVKIPTINTNYYSYLGTKLEYRRLYSVYLNYVFAY

SEQ ID NO: 17343 - protein, 641 aa, Helicobacter pylori
MKKMKKTILLSLTLAASLLHAEDNGVFLSVGYQIGEAVQKVKNADKVQKLSDAYENLNKLLTNNDGSGSKTSAQAINQAVNNLNERAKKLTSGTTQSPAYQATLLALKSVLGLWNSIGYAVVCGGYVNKPGEAHKNFHYTDENGNGTKINCGGFIGANGQVQSNGGTSTLPAAKNSSLSIKQYEAIHEAYQILSKALKESGLAPLTSKGGKLEAHVTTSVDQQGSNNETKTTTSVIDTTNGAQNLLTYAQTIVNTLKDYCPMLIAKSSNGMSSSTNAPSWQTAGGGKNACATFGTEFSAISDMINNAQNIVKETQQLSANQPKNITQPHNFNLNTPSSLTALAQKMLKNAQSQAEILKLANQVESDFSKLSSGHLKDYIRKCDASGISGANMTAQNQKSNWGNGCAGVEETLASLKESNASFDSQTPQINQEQNLANTLIQELGNNPFRSAGMIASSATNNGAMNGLGVQVGYKQFFGEKKRWGLRYYGFFDYNHAYIKSNFFNSASDVWTYGVGSDLLFNFINDKKTNFLGKNNHFSMGLFGGIALAGTSWLNSQFVNLKTISNVYSAKVNTANFQFLFNLGLRTNLARPKKKDSHHAAQHGMELGVKIPTINTNYYSFLDTKLEYRRLYSVYLNYVFAY

SEQ ID NO: 17344 - protein, 639 aa, Helicobacter pylori
MKKMKKTILLSLTLAASLLHAEDNGVFLSVGYQIGEAVQKVKNADKVQKLSDTYEQLSRLLTNNDGTGSKTSAQAINQAVNNLNERAKTLAGGTTNSPAYQATLLALRSVLGLWNSMGYAVICGGYTKSPGENNQKNFHYTDENGNGTTINCGGSTNSNGTHSSNGTNTLKADKNVSLSIEQYEAIHEAYQILSKALKQAGLAPLNSKGEKLEAHVTTSKYQQNDQTKTTTSVIDTTNDAQNLLTQAQTIVNTLKDYCPMLIAKSSSNGANGTNTPSWQTAGGGKNSCETFGAEFSAASDMINNAQKIVQETQQLSANQPKNITQPHNLNLNSPSSLTALAQKMLKNAQSQAEILKLANQVESDFNKLSSGHLKDYIGKCDASAISSTNMTMRNQKNNWGNGCAGVEETLASLKTSAADFNNQTPQINQAQTLANTLIQELGNNPFRNMGMIASSTTNNGAMNGFGVAAGYKQFFGKKKRWGLRYYGFFDYNHAYIKSNFFNSTSDVWTYGVGSDLLFNFINDKKTNFLGKNNHFSMGLFGGIALAGTSWLNSQFVNLKTVSNVYSAKVNTANFQFLFNLGLRTNLARPKKKDSHHAAQHGMELGVKIPTINTNYYSFLDTKLEYRRLYSVYLNYVFAY

SEQ ID NO: 17345 - protein, 640 aa, Helicobacter pylori
MKKMKKTILLSLTLAASLLHAEDNGVFLSVGYQIGEAVQKVKNADKVQKLSDSYEKLSRLLTNDNGSGSKTSAQAINQAVNNLNERAKTLAGGTTNSPAYQATLLALRSVLGLWNSMGYAVICGGYTKSPGENNQKDFHYTDENGNGTTINCGGSTNSNGTHSSNGTNTLKADKNVSLSIEQYEAIHEAYQILSKALKQAGLAPLNSKGEKLEAHVTTSKYQQGNQTKTTTSVIDTTNDAQNLLTQAQTIVNTLKDYCPMLIAKSSSNGMTNSTNAPSWQTAGGSKNSCETFGAEFSAASDMLNNAQEIVKKTQQLSANQPKNITQPHNFNLNSPSSLTALAQKMLKNAQSQAEILKLANQVESDFNKLSSGHLKNYIGKCDMSAISSTNMTMQDQKNNWGNGCAGVVETLASLKSSNASFDSQTPQINEAQTLASTLIQELGNNPFRNMGMIASSTTNNGALNGFGVQAGYKQFFGKKKRWGLRYYGFFDYNHAYIKSNFFNSASDVWTYGVGSDLLFNFINDKKTNFLGKNNHFSMGLFGGIALAGTSWLNSQFVNLKTISNVYSAKVNTANFQFLFNLGLRTNLARPKKKDSHHAAQHGMELGVKIPTINTNYYSFLDTKLEYRRLYSVYLNYVFAY

SEQ ID NO: 17346 - protein, 639 aa, Helicobacter pylori
MKKMKKTILLSLTLAASLLHAEDNGVFLSVGYQIGEAVQKVKNADKVQKLSDTYEQLSRLLTNDNGTNSKTSAQAINQAVNNLNERAKTLAGGTTNSPAYQATLLALRSVLGLWNSMGYAVICGGYTKSPSENNQKDFHYTDENGNGTIINCGGSTNSNGTHSSNGTNTLPAAKNSSLSIKQYEEIHEAYQILSKALKQAGLAPLNSKGEKLEAHVTTSKHQQGQTKTTTSVIDTTNDAQNLLTQAQTIVNTLKDYCPILIAKSSSNGMANNANTPSWQTAGGGKSACATFGKEFSAASDMLNNAQKIVQETQQLSANQPKNITQPHNLNLNSPSSLTALAQKMLKNAQSQAEILKLANQMESDFNKLSSGHLKDYIRKCDASAISSANMTMRNQKNNWGNGCAGVEETLSSLKTSAADFNNQTPQINQAQTLANTLIQELGNNPFRNMGMIASSTTNNGALNGFGVQAGYKQFFGKKKRWGLRYYGFFDYNHAYIKSNFFNSASDVWTYGVGSDLLFNFINDKKTNFLGKNNHFSMGLFGGIALAGTSWLNSQFVNLKTASNVYSAKVNTANFQFLFNLGLRTNLARPKKKDSHHAAQHGMELGVKIPTINTNYYSFLDTKLEYRRLYSVYLNYVFAY

SEQ ID NO: 17347 - protein, 640 aa, Helicobacter pylori
MKKTKKTILLSLTLAASLLHAEDNGAFLSVGYQIGEAVQKVKNADKVQKLSDSYEQLSRLLTNDNGSGSKTSAQAINQAVNNLNERAKTLAGGTTNSPAYQATLLALRSVLGLWNSMGYAVICGGYTKSPGENNQKNFHYTDENGNGTTINCGGSTNSDGTHSSNGTNTLKADKNVSLSIKQYEEIHEAYQILSKALKQAGLAPLNSKGEKLEAHVTTSKYQGDQTKTTTSVIDTTNDAQNLLTQAQTIVNTLKDYCPMLIAKSSNNNSMANNANTPSWQTAGGSKNSCETFGAEFSAASDMINNAQKIVQETQQLSANQPKNITQPHNLNLNTPSSLTALAQKMLKNAQSQAEILKLAIKVESDFNKLSSGHLKDYIGKCDASAISSTNMTMQNQKNNWGNGCAGVEETLSSLKTSAADFNNQTPQINQAQTLANTLIQELGNNPFRNMGMIASSATNNGALNGFGVQAGYKQFFGKKKRWGLRYYGFFDYNHAYIKSNFFNSASDVWTYGVGSDLLFNFINDKKTNFLGKNNHFSMGLFGGVAIGGTSWLNSQFVNLKTISNVYSAKVNTANFQFLFNLGLRTNLARPKKKDSHHAAQHGMELGVKIPTINTNYYSFLDTKLEYRRLYSVYLNYVFAY

SEQ ID NO: 17348 - protein, 1041 aa, Helicobacter pylori
MKKNINLILWVTILLTSLQFQAQNTTPLIQSKLDGTVVDDITNQPIIGASVNIKGTTHGVQTDTEGKFYFQTGQKFPYTLIISYIGYKKLEIVVEKNPVIIHLKEERQELDELVVVGYGTQKRKDITGSVASVPKANLSQVTSSADNLLRGAVSGVVVTQSSGRPGASSSVRIRGGNSITAGNEPLYVVDGILIYNDNNNSSAGVSNAGASLNVMSTINPGDIESIEVLKDASATAIYGSRGANGVVIITTKKGTKGQDNISYQGYFGVQNISKKLHIMNASQWASLRNDVQASIGQAPSFTDAQIEAFKNSGSYDWQSAAFRKATPVQNHQLSFSGGDERSRYSISAGYFDQEGIVLASDFKRISLRANYEKNYSQNFKFGVNANYSNSVSNGVGTNSSGGRNPNPLVSVLLTAPVVPIRNPDGSYNVTNNPYATSVNGFVPNPINDLENTINETKINRILTSLFGEYKITKKLTAKVAVSGDVISTKQNYYAPSNTSNGAGTKGLASIGDRLVSSVLNENTLNYNTNFGENHKFSALGGYTLQYTKGEVVTAGSNTFVNDANTYNALQDGVAVKPYSDAFESVLKSWLARVNYSYRGKYNFTLSARADGSSRFGSESRWGYFPSAGFSWNITDEEFANNIKGVTEAKLRITAGTTGNQEIGNYLALAQMGSVNYSFGGTLYTGLAPTRLANPDLKWEKTDQYNVGLDLSLLDRKINFVFDVYYKKTNDLLISVPVPLTSGYATVLQNIGGVENKGIEIGLNTENLKTEKFSWNSNIVFSANRNKVTSIGNGVDQFFPVVPNGSLLQQQPVTVKVGLPLGTFWGYKTNGIFQTQEEVNTQPKINSLANTKVGDRKYVDTNGDGVITALDKGDLGSSQPKFVGSFSNTISYNDFDLNFSFQGSYGGKIFNALNQQLEISTLGTNANVTLEDRWTPTNPSNEIPRATSSPLGIVSERYVEDASFLRLKLITLGYTLPKSASKKLGAKSVKFYVSAENLVTWTKYTGYDPEVSSYEQNNLYPGIDFGSYPNAKTFISGLNVTF

SEQ ID NO: 17349 - protein, 639 aa, Helicobacter pylori
MKKTKKTILLSLTLASSLLHAEDNGVFLSVGYQIGEAVQKVKNADKVQKLSDTYEQLSRLLTNDNGTNSKTSAQAINQAVNNLNERAKTLAGGTTNSPAYQATLLALRSVLGLWNSMGYAVICGGYTKSPGENNQKNFHYTDENGNGTTINCGGSTNSNGTHSSNGTNTLKADKNVSLSIKQYEEIHEAYQILSKALKQAGLAPLNSQGDKLEAHVTTSKYQSDNQTKTTTSVIDTTNTAHNLLTYAQTIVNTLKDYCPMLIAKTSDSNGMNTNAPSWQIAGGGKNACATFGAEFSAASDMINNAQKIVQETQQLSANQPKNITQPHNLNLNSPSSLTALAQKMLKNAQSQAEILKLANQVESDFNKLSSGHLKDYIGKCDTSAISSANMTMQNQKNNWGNGCAGVEETLSSLKTSAADFNNQTPQINQAQTLANTLIQELGNNPFRNMGMIASSTTNNGALNGLGVQVGYKQFFGKKKRWGLRYYGFFDYNHAYIKSNFFNSASDVWTYGVGSDLLFNFINDKNTNFLGKNNQISFGLFGGIALAGTSWLNSQFVNLKTISNVYSAKVNTANFQFLFNLGLRTNLARPKKKDSHHAAQHGMELGVKIPTINTNYYSFLDTKLEYRRLYSVYLNYVFAY

SEQ ID NO: 17350 - protein, 638 aa, Helicobacter pylori
MKKMKKTILLSLTLAASLLHAEDNGVFLSVGYQIGEAVQKVKNADKVQKLSDTYEQLSRLLTNDNGTNSKTSAQAINQAVNNLNERAKTLAGGTTNSPAYQATLLALRSVLGLWNSMGYAVICGGYTKSPGENNQKNFHYTDENGNGTTINCGGSTNSDGTHSLNGTNTLKADKNVSLSIEQYEAIHEAYQILSKALKQAGLAPLNSKGEKLEAHVTTSKDQQGSETKTTTSVIDTTNGAQNLLTYAQTIVNTLKDYCPMLIAKSSSNGGNTNTPSWQTAGGGKNSCKTFGAEFSAASNMLNNAQKIVQETQQLSANQPKNITQPHNFNLNSPSSLTALAQKMLKNAQSQAEILKLANQVESDFNKLSSGHLQDYIGKCDASAISSTNMTMQNQKNNWGNGCAGVEETLASLKSSNASFDSQTPQINEAQTLASTLIQELGNNPFRNMGMIASSATNNGAMNGFGVAAGYKQFFGKKKRWGLRYYGFFDYNHAYIKSNFFNSASDVWTYGVGSDLLFNFINDKKTNFLGKNNHFSMGLFGGIALAGTSWLNSQFVNLKTVSNVYSAKVNTANFQFLFNLGLRTNLARPKKKDSHHAAQHGMELGVKIPTINTNYYSFLDTKLEYRRLYSVYLNYVFAY

SEQ ID NO: 17351 - protein, 460 aa, Helicobacter pylori
MKKTIYSLSACGILTCLYCGIASATDAFNLVGVGPVSQGMGGIGAAFNIGAQGMMLNPATLTQMQEGMHLGLGMDIITAELEVKNTATGEKADSHSRGRNNGPYVAPELSLVWRGERYALGVGAFASDGVGTQFGDTSFLSRTTTNNLNTGLENYSRLIVLRIPFSAAYQVNEKLSVGASLDAVWTSVNLGLLLDTTQIGTLVGQGQVSGSLMPALLSVPELSAGYLSADNHRASGGGVDSWGIGGRLGLTYQLTPKTRVGIVYNFKTHVGDLSGNADLTAVSAVAGNIPLSGELKLHNFEMPASLVAGISHEFSDQFAVAFDYKRVYWSDVMDDIEVNFKQKATGDTINLKLPFNYRDTNVYSLGAQYRYGANWVFRAGVHYAQLANPSSGTMPIIPSTPTTSLSGGFSYAFSPEDVVDFSLAYGFKKKVSNDSLPITDKPIEVSHSQIVTSISYTKSF

SEQ ID NO: 17352 - protein, 641 aa, Helicobacter pylori
MKKTKKTILLSLTLASSLLHAEDNGVFLSVGYQIGEAVQKVKNADKVQKTSDTYEQLSRLLTNDNGTNSKTSAQAINQAVNNLNERAKTLAGGTTNSPAYQATLLALRSVLGLWNSMGYAVICGGYTKSPGENNQKNFHYTDENGNGTTINCGGSTNSNGTHRSSGVNTLKAGKNVSLSIEQYEKIHEAYQILSKALKQAGLAPLNSKGEKLEAHVTTSKYQQDDQIKTTTSVIDTTNDAQNLLTQAQTIVNTLKDYCPILIAKSSSGSSGTATTNTPSWQTAGGGKNSCQTFGAEFSAASDMINNAQKIVQETQQLSANQPKNITQPHNLNLNTPSSLTALAQKMLKNAQSQAEILKLANQVESDFNKLSSGHLKAYIGKCDASAISSANMTIQSQKNNWGNGCAGVEETLTSLKTSAADFNNQTPQINQAQNLANTLIQELGNNPFRNMGMIASSTTNNGALNGLGVQVGYKQFFGEKKRWGLRYYGFFDYNHAYIKSNFFNSASDVWTYGVGSDLLFNFINDKNTNFLGKNNQISFGLFGGIALAGTSWLNSQFVNLKTISNVYSAKVNTANFQFLFNLGLRTNLARPKKKDSHHAAQHGMELGVKIPTINTNYYSFLDTKLEYRRLYSVYLNYVFAY

SEQ ID NO: 17353 - protein, 632 aa, Helicobacter pylori
MKKTKKTILLSLTLASSLLHAEDNGVFLSVGYQIGEAVQKVKNADKVQKLSDAYENLNKLLANHSHSNPEAINTNSATAINQAIGNLNKSAQSLIDKTDNSPAYQATLLALKSTVGLWNSIAYAVICGGYTDKPNHNTTETFYNQPGQNSNSITCGSNRLGTLPAGKNSHLSIEQFATLNKAYQIIQAALKKGLPALSNTKTTVEVTIKTATNAQNINVNNNNNNAADATIETKNTYINDAQNLLTQAQTIINTLQDNCPQLKGKSSNGGTNNANTPSWQTNAIQNSCSVFGTEFSAISDMISNAQNIVQETQQLNTAPLKSIAQPNNFNLNSPNSIALAQSMLKNAQSQAAVLKLANQVGSDFNRISTGVLKNYIEECSTNASSESVSNSTWGKGCAGVKQTLTSLENSNASFSSQTPQINQAQTLANTIVQELGHNPFKRVGIISSQTNNGAMNGLGVQVGYKQFFGEKKRWGLRYYGFFDYNHAYIKSNFFNSASDVWTYGVGSDLLFNFINDKNTNFLGKNNQISVGLFGGIALAGTSWLNSQFVNLKTISNVYSAKVNTANFQFLFNLGLRTNLARPKKKDSHHAGQHGMELGVKIPTINTNYYSFLDTKLEYRRLYSVYLNYVFAY

SEQ ID NO: 17354 - protein, 634 aa, Helicobacter pylori
MKKTKKTILLSLTLAASLLHAEDNGVFLSVGYQIGEAVQKVKNADKVQKLSDAYENLNKLLANHSHSNPEAINANSATAINQAIGNLNANTQNLIDKTDNSPAYQATLLALKSTVGLWNSIAYAVICGGYTDKPNHNITETFYNQPGQNSNSITCGSNGLGTLPAGKNNSLSIEQFATLNKAYQIIQAALKQGLPALSNTTTTVEVTIKTATNARNINVNNDNNNAADATIETKNTYINDAQNLLTQAQTIINTLQDNCPQLKGKSSSNGGTNGANTPSWQTSAIQNSCSVFGTEFSAISDMISNAQNIVKETQQLNTTPLKSIAQPHNFNLNSPNSIALAQSMLKKAQSQEAVLKLANQVGSDFNRISTGVLKNYIEECSANASSESVSNTTWGKGCAGVKQTLTSLESSNASFSSQTPQINQAQNLANTIVQELGNNPFRNMGMIASSTTNNGALNGLGVQVGYKQFFGEKKRWGLRYYGFFDYNHAYIKSNFFNSASDVWTYGVGSDLLFNFINDKNTNFLGKNNQISVGLFGGIALAGTSWLNSQFVNLKTISNVYSAKVNTANFQFLFNLGLRTNLARPKKKDSHHAAQHGMELGVKIPTINTNYYSFLDTKLEYRRLYSVYLNYVFAY

SEQ ID NO: 17355 - protein, 641 aa, Helicobacter pylori
MKKTKKTILLSLTLASSLLHAEDNGVFLSVGYQIGEAVQKVKNADKVQKLSDTYEQLSRLLTNDNGTNSKTSTQAINQAVNNLNERAKTLAGGTTNSPAYQATLLALRSVLGLWNSMGYAVICGGYTKSPTENDQKKFHYTDENGNGTTINCGGSTNSDGTYNPNGTNTLKADKNVSLSIKQYEEIHEAYQILSKALKQAGLAPLNSKGEKLEAHVTTSKYQKDGQTKTTTSVIDTTNDAQNLLTQAQTIINTLKDYCPMLIAKSSSGSSGGAATSTPSWQTAGGGKNSCETFGAEFSAASDMLNNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETLTSLKSSNASFDSQTPQINQAQTLASTLIQELGNNPFRNMGMIASSTTNNGALNGFGVQAGYKQFFGKKKRWGLRYYGFFDYNHAYIKSNFFNSASDVWTYGVGSDLLFNFINDKKTNFLGKNNHFSMGLFGGIALAGTSWLNSQFVNLKTISNVYSAKVNTANFQFLFNLGLRTNLARPKKKDSHHAAQHGMELGVKIPTINTNYYSFLGTKLEYRRLYSVYLNYVFAY

SEQ ID NO: 17356 - protein, 642 aa, Helicobacter pylori
MKKTKKTILLSLTLASSLLHAEDNGVFLSVGYQIGEAVQKVKNADKVQKLSDTYEQLSRLLTNDNGTNSKTSAQAINQAVNNLNERAKTLAGGTTNSPAYQATLLALRSVLGLWNSMGYAVICGGYTKSPGENNQKNFHYTDENGNGTTINCGGSTNSNGTHSSNGTNTLKADKNVSLSIEQYEKIHESYQILSKALKQAGLAPLNSKGEKLEAHVTTSKYQQDSQTKTTTSVIDTTNDAQNLLTQAQTIVNTLKDYCPMLIAKSSSGSGGGAATNTPSWQTAGGGKNSCETFGAEFSAASDMINNAQKIVQETQQLSANQPKNITQPHNLNLNTPSSLTALAQKMLKNAQSQAEILKLANQVESDFNKLSSGHLKDYIGEMRYECYKQYEYDNAKVKRTIGGNGCAGVEETLTSLKTSAADFNNQTPQINQAQNLANTLIQELGNNPFRNMGMIASSTTNNGALNGLGVQVGYKQFFGEKKRWGLRYYGFFDYNHAYIKSNFFNSASDVWTYGVGSDLLFNFINDKNTNFLGKNNQISFGLFGGIALAGTSWLNSQFVNLKTISNVYSAKVNTANFQFLFNLGLRTNLARPKKKDSHHAAQHGIELGVKIPTINTNYYSFLDTKLEYRRLYSVYLNYVFAY

SEQ ID NO: 17357 - protein, 733 aa, Escherichia coli
MMISKKYTLWALNPLLLTMMAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNIDHIEVISGATSLYGGGSTGGLINIVTKKGQPETMMEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAAFLQSGYDINNLFTLNGGVRYQYTENKIDDFIGYAQQRQIAAGKATSADAIPGGSVDYDNFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTADLLGSYQLPVGTLSFSIENLFDRDYTTVWGQRAPLYYSPGYGPASLYGYKGRGRTFGLSYSVLF

SEQ ID NO: 17358 - protein, 256 aa, Rickettsia heilongjiangensis
PQKTFSSLLFSSLLFSSAAQAASEDSGHGPYYVQADLAYAAERITHDYPKATGANNTSTVSDYFRNIRAHSIHPRVSVGYDFGGWRIAADYASYRKWKESNSSTKKVTEDIADNYKETKTEHQGNGSFHAASSLGLSAIYDFKLNDKFKPYIGARVAYGHVKHQVHSVETKTTTVTSKPTATSPQGGPIIQTDPSKPPYHESHSISSLGLGVIAGVGFDITPKLTLDTGYRYHNWGRLENTRFKTHEVSLGMRYRF

SEQ ID NO: 17359 - protein, 625 aa, Israeli tick typhus rickettsia
TEMEYLPDLSTPIAPSGGAYERFLGYDNLTKEENLNNLLNGYLSMRYIKNRFHVNVGVLLDYNTNVRHVFWPSTLMESVSFVSDYSGYNRRLIGNASAGYLFDLTPAHALDLRWDGSIQSDYYHYNYSKGYDGEDDTKTTSNSGGFTRVYRFADRLETRLVSTSFALDYNFKKLLYASALIRYDGASNVQLDKRWLFSPAFSLGWDLRKQFFNNSTLFSKLSLKASWARLGHLVQSDRFTLGPNYVSSELGWSGQSMISSSNGFATVTRPYSIGWVDYGMGWPYSDKLGIDLNASFLNNRVNIGLSFYENREKDIILQMPVYQEFGYKYRFVNGMEISNRGAEMNVSVSPLAINDPNRLSWDISLNMSFNQNELKKLPSGLNEVVTNSRKFEVGKSVDAFWIYQNNGIYADNSEVPVKDGKPLSINGVPFQKGDPKWTDVNGDNIIDDNDRVLKGHALPRFTGGLTNQFKYKQFDFSFHCFFALGHSALNVRDQQRYDFMTLDRTKSIRSVKEIFFWQELPNQKDDYPIYNPLSKVHPYRAEQDLFLEKLSYLKLRNVTVGYTLPLKGEKNRIVKSLYFYLTANNLFTITGFSGNDPELVGFNGNYDGYSMPIPRSASLGLRFKF

SEQ ID NO: 17360 - protein, 1245 aa, Rickettsia sp. Bar29
SKLLDRFRYFKQKGETFADGHGQVMHSNRDWEDSYRQRWQFDKIVRSTHGVNCTGSCSWKIYVKNGLVTWEIQQTDYPRTRPDLPNHEPRGCPRGASYSWYLYSANRLKYPLIRKRLIELWREALKQHSDPVLAWASIMNDPQKCLSYKQVRGRGGFIRSNWQELNQLIAAANVWTIKTYGPDRVAGFSPIPAMSMVSYAAGTRYLSLLGGTCLSFYDWYCDLPPASPMTWGEQTDVPESADWYNSSYIIAWGSNVPQTRTPDAHFFTEVRYKGTKTIAITPDYSEVAKLCDQWLAPKQGTDSALAMAMGHVILKEFHLDNPSDYFINYCRRYSDMPMLVMLEPRDDGSYVPGRMIRASDLVDGLGESNNPQWKTVAVNTAGELVVPNGSIGFRWGEKGKWNLESIAAGTETELSLTLLGQHDAVAGVAFPYFGGIENPHFRSVKHNPVLVRQLPVKNLTLVDGNTCPVVSVYDLVLANYGLDRGLEDENSAKDYAEIKPYTPAWGEQITGVPRQYIETIAREFADTAHKTHGRSMIILGAGVNHWYHMDMNYRGMINMLIFCGCVGQSGGGWAHYVGQEKLRPQTGWLPLAFALDWNRPPRQMNSTSFFYNHSSQWRYEKVSAQELLSPLADASKYSGHLIDFNVRAERMGWLPSAPQLGRNPLGIKAEADKAGLSPTEFTAQALKSGDLRMACEQPDSSSNHPRNLFVWRSNLLGSSGKGHEYMQKYLLGTESGIQGEELGASDGIKPEEVEWQTAAIEGKLDLLVTLDFRMSSTCLFSDIVLPTATWYEKDDMNTSDMHPFIHPLSAAVDPAWESRSDWEIYKGIAKAFSQVCVGHLGKETDVVLQPLLHDSPAELSQPCEVLDWRKGECDLIPGKTAPNIVAVERDYPATYERFTSLGPLMDKLGNGGKGISWNTQDEIDFLGKLNYTKRDGPAQGRPLIDTAIDASEVILALAPETNGHVAVKAWQALGEITGREHTHLALHKEDEKIRFRDIQAQPRKIISSPTWSGLESDHVSYNAGYTNVHELIPWRTLSGRQQLYQDHPWMRAFGESLVAYRPPIDTRSVSEMRQIPPNGFPEKALNFLTPHQKWGIHSTYSENLLMLTLSRGGPIVWISETDARELTIVDNDWVEVFNANGALTARAVVSQRVPPGMTMMYHAQERIMNIPGSEVTGMRGGIHNSVTRVCPKPTHMIGGYAQLAWGFNYYGTVGSNRDEFIMIRKMKNVNWLDDEGRDQVQEAKK

SEQ ID NO: 17361 - protein, 1866 aa, Astrakhan rickettsia
MNKLTEQHLLKKSRFLKYSLLASIAVGAAIPFEGMAMSKEAFRIDLSNKLLNHVSQLKGHKDTTNTPQQIGTVIVPEPEINTYTPSEIREMKISNKPKASNPLKDVPIEDHYKVVARSKSDVGKARKVRPITRRKTFAGIEKTKQSQNTYTPESTEQMPQKPEIIITASSPTVSPASNSFITAPNTPNTTLISPEHYTTAPGTPSSTPVTPYQPTSDSKPNDSLGANTPPNTNSKAARRLSFSSSDPQQQAVQSSSQVKSEVPPKPTFVPLPIKKGSTEIVAGMVSNISRVNEMIGIKLAEVTQAIKDTTGKKDKERLQKLYRQLTSTQKTTEVLKSRAEEIETKIKIGKNKDKIKKLEKELTSKNNKADRLFQKIEKIDIPANKVSIKSQETVPVTTASTEVSAFQAQQARINEARQSIFNKNKSSGDNARKSNAGTKREKKKQEAQKQLSEIKKQEKAVKTASDKAKEVAASAKEETSRTALRAMQDKMNGDSEQLNKIEENLKLLTPVVYNSSTGPTYKQSPKAKPTIPLSHGVQRILGEQPEDEEGYLVPIKVQQQPYTVMLPNQEIEDPIPSHSKDIYEAKVSQYINYLNRIQPNQSNQAQIDSVIDSLATEMRKFSADQFSQKLDEIAHLAGIKAYEGLFEKLYEIQQARIPETQKVYEQAEISQSYAEYEENSRKSSTPVLSPSSSAKSVISSNFEEKSALLQTTTTDESLRSDNNWKNSAPYSSSPTLNKRGLEYLDLAGDAFVQNLKQSDTLTIETLDLITPTQNTTVAKSDSSRKNNVSGSIPEIQQLQSEKMRTETLGVQDDLGLDLHYAPQETLTEESTYLVSSKKKQGNIIKRAVSKVESILHTNYSENRKRKRNGETSKQRTVDQEGEFGHAWGNENHKESSLSVVSGFTKKATQLISLLDAKRTAILQTTSPSQRKSLSLVLQEIENDYREAIKISQELQQVLIRKPEDIKAYNAKAEKKLDAIKSRADKHFDNIETDVDIGFNPNGGNSHSMPTANMDSLPKNLAVTPPINVGSLYNSPQAQQFREDHKNIIINDRSQGRLNLVDSTITKGTQPLSNLSTIYESVSDENLASETIYKTEQPKPSISYTNTSKRKLPIPLFRSAELDKKLEYLDLEDKLLEVEEARIVKEKQAIAKLNQYQDPENLEFKRLAMEALDLSLKESQLKAKRKAIGAEFSLNEKSSSTDVSIRSYSIDDISSVLSGAESNLSRSPSVSGLEDLNNMQLGELKSKKELELDTLNKEKIWLDLDTESKPKVTESKPVFSCSSSVGSINSFSNDDLSSRDVVAPVDTLNIEINKDYVDTYIRVLSNKIQEIEELSGSSSRSEELNHIKEAMAYISNRIQDVEELDEKMLLVINSQLQEHDEKISSLLREEATDILAQLLLQEMLVSDGKSESTLPAGDEEQEDTEVSRQLSSLPADGKSESTLPAGDEEQEDTEVSRQLSSLPALASSNESALALSDDREKECLALGDGSEDEESYDSGFEEEEETIGQLSDSDGGNLKITEVDKVIPLEQEAKKEMQMQISENAPTLNQAKVVNTIVNNMIRNRLDVNMSNNMAVGAGDEEESHIKRGLWMRGMYGTNNHGRVENMTGYRGTNKGATIGFDAEIDNNIVGIAYSNVHSVFKFKNSKNNDKELINSHVVSIYGQKELPKNFALQALVSASKNFIKDKTTYSYGDTKIKSNVKHRNHSYNAEALLHYNYLLQGKLVITPNIGLRYGKSRDGVYNETGVNVQEIALTMKENNILSGIVGTKVTVPLKDALKFNNLGLTFQGAVEHNFKEKTQRINRVVKIFDNTFKHNYLIPKQPKTSYNLGTGIIGSIKNTTISLDYNYYLNKHYRSHQGSVKLKVNL

SEQ ID NO: 17362 - protein, 696 aa, Rickettsia amblyommii
MATSGAMAAEAAAPAPDERHALPAINVSAHAAPVDPLMQPLETGSRLGLASLDTPASVETVTADTIDARGDRTVLDAVTRTAGFSSAMAPGTGGTALSVRGFSGQESVMTLLDGVRLMPAAGTITFPFDTWSVERIEVLRGPASALYGEGAIGGVVNVVPKRPQRTRETTLQIGVGPDGAKRAAFDTTGALGPQLSYRFYASDARANGLAERADTHTTAVGGALKFDVSPKLTLTLDFDYGRQMPATYYGVPAPNGVLDPSLRKLNYNVGDATISYYDQWTRLSASYRPTAGVTIDNQLYYLTSNRHWRNAESYALDAATGLVTRSDYLDIGHHQRQIGDRLSARFDGTLFGRANRFVVGTEFSQITFSGTNNSPYGGESTVPAHGFDPGVFTSPDPTVPQFSTRARQAAVFAENRLEVLPRLAWVSGLRYDHIAFSREQAATGAGFDKRFANVGWRTGFVFEVAPTLSAYAQYTTGAEGLGSLVTLSASQANYRLATGEQWEAGVKQTLLDGRAYWTFAVYDITKRNLLSTDPFNPALRQQVGRQSSRGIELTGGARLPHGWTVDANVALLRARYDEFNQKVGSATVSRAGNAPANVPQQTANLWLGWAFAERWQANAGVRYVGATYGDDANRVQVPSYTVFDASLRWQPTSRTELALYLRNLANRTYAVTTSNGGEQWLLGPSRSAELVATMRF

SEQ ID NO: 17363 - protein, 206 aa, Rickettsia slovaca
EFSGFSGSVQFVPAQNSKSAYKPAYYTKDTNNNNNLTLVPAVVGKPGSDVYYAGLNYKNGGFAGNYAFKYARHANVGRNAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNT

SEQ ID NO: 17364 - protein, 1813 aa, Rickettsia rickettsii
LQNSHSKKYVLTFFMSTCLLTSSFLSTSARAASFKDLVSKIPAWEKHNSTQQQNIWKDLTPNEKIKKWQEADLVPSFTQAQDDLGIKYKETDLSSFLYNTRHKARQARAEILLYIERVKQQDFDTKKQEYINQGVVPTDIEAATNLGISYDPNKIDNNVEHNQKVRRAEKDKKAIIELYVSSINRAIKYKHYVDNDIIPEMQEVRTALNMNKDDAESFVASIRTEIMENAKGQYIADSHIPTEKELKKRFGIFRDDNRDGYIKSIRLKVMDKEKPQYIADSHIPTEKELEQQFGADKGEATNYIASIATQMMLGKKSYYIDNNIIPNADELMNEFKIGIVKANSYIDQIRAGIAANQLLNNNDTTNPSAGRSQKKSGSQNDHKYRPNQDINNTGTSSGIFTGRKKKQQYFFDPISTFKKYFNTKASKGNLTQSQHNLNRIIQQEENIEDFKNLIKTDPIAALTLQVDSIYKQEAVTTILSDFNDDTIQRVLFSNDKGQLDFNTNIDVKNRPILKELLENSSSEEKTKFAERIQDYATRNISNSQFEEKARLDLIKLAASKDKSSVENFLTLQLELKNRMQPYIVKSVYILTPEIVKEINIELKNKGLIRDSLTKDDMIKLAKEVNNYTLNSVIKVILSDSTILSNETNKILGLAVGNNANNLEQTQSGIPNPPPLPLNGSIPNPPPLPLNGSIPNPPPLPLNGSMPPLPPPFNSQGFSSNSNHFDLNQLQAEYPHIHSLYIQFTSNTTVQSKAPLQPTASSATSTDRSTPETAYAKLYAEYRTETGGTKANDLQDQLIKRQADLTNVIRQILTESYANQGADEKTLVNLFSISTPEIAEKAKEAFNTLVQDQYIKDITVNGKKTITSEEIIKNLFNEDTDDAEKRFLLSSCKISEELKRPIKLEFNKSELLRELQSKQNLFEQLAFAYTNEKHFNQDVFGTRVDELITNPNILTIVQQANFLITEDTNLRKIINSDQAQDKLDKLRTAILNTIKFEELITANLPHNEFIAIVKEKDPELLKELLKASTIKLTGNNNLDQLRSALPSFTDMSNEQISILASKLKGPIILKAIKECSQEKAKKPIHTGNMPPPPPPLPDSQDWELAYLKSLGITQFNTNTSTFKTTPKIYHFSSDIALRYKEFTLSGQKSAGHKAKYSDADLLKKAIVESVAFEHSKNLSKAHQNNKYFEKIQEAVDTMHSSFIGPRTEIGQKIHNIYTSKLLELTKDKEFIKYVEDTIILSKKLTEAFTSAHSDFIGPRTEIGQEVHNIYTQQLTKYPEEAVKEAFNTASLDFIGPRTEIGQEVHNIYTSQLSKLAKDKELFLFVQQILVESTELEQKYGSDIQSENSNNEKKIGRLNSKKLRLFPQENKATNDESSTKDDTQPEDSNKKSEQSDSKSEQSDSKSEQSDSTTALSPRLLSSNDSKNDKSSDDKKSLLALRSSDEDDEGYATDEGELEESNSTTDEELKKDIVLESEDEAIDVSFKTEAITEQDEATQRQQVSGDTSGKVAILVKATSTLHKPVHYNISDRLKVTAIGAGDEETSINRGVWISGLYGINKQSTWKNIPKYQNRTTGITIGTDAEFINSHDVIGIAYSRLESQIKYNKKLGKTVVNGHLLSIYGLKELIKGFSLQAITSYGHNYIKNRSKSINNIIGKYQNNNLSFQTLLNYQYRTKYDLHFIPNIGFQYDYSRASNYKEYNVDIENLMIQKKSNQLFESSLGGKIVFKPIVTKNNIVLTPSLYGNIEYHFNNKNTKVNAKATFKGQTLQETIITLKQPKLGYNIGSNILMSRKNINVLLEYNYYTHRKYQSHQGL

SEQ ID NO: 17365 - protein, 904 aa, Rickettsia rhipicephali
MNLPGCTLKPLALAVRRHPRALLCALAMGMSGAQAADAVDADTSGSAVSTSAAVVPATTQLQRVEVTGSAIRRVDAETAVPITILRADDLKKQGVTTTQEMVQRITGSQSINNSAGSVGAGTGGASFADMRGIGANKTLVLLNGRRLANNALSGVGTPNGSAIDLNMIPFAAIDRVEVLRDGASALYGTDAIGGVINFITKKSLTDGSLTLGGETPTASGGGATNDMSASWGFGDLEEDRFNVMGVFNYNKQQNLDANDRSFAKDYVPGRGLNQTSGTAYPGNYFQGDNSANPLGRNCSGPNLIASNGICRFSTREYIDLIPQTEKTSFFGKATGKLADDHNVSLEYFWARNNNHTDIGPAPLTGLSLDSSSPFYPGNGITPAPTDFTLDPTQPVSTAWRETAAGPRGSSDQNTSQRFLLNFDGLVGGWDYNVGASYNQNKVLSSLTDGYISDAAMLNGLANGTLNPFGPQTAAGQALIDANQYHGQYSSAVGRVAGLDARISREIGDWFGAGPAGIALGGEYRKEKMHQEYEAFVNDVSSLGADAAGSVEGDRSVKAEYAELNVPVLDSLELTAAVRHDKYSDFGSTTNPKYSFRYQPFKQLVVRGAYSEGFRAPSLYELYAPRSTTFTQGYYNDPVLCAGGVVQPGGNAGRDCQQQFLNNGGGNTELAPEKARNMTLGFVYQPVNNLSMGLDFWWIHISNQIQAFPESTVFDDPNTYADRYVRAADGSIANIVTGNANLGIVKTSGVDVTLDYRFPNTPYGQFGLGMTGTYVTRYDFQNIIDGPYTDKVGDFQGDGVISRWKHVLTGTWALGDTRASITNRFTSGYNDYDRTTNARVASYALWDMSVGHTFDKVLDIDAGVRNMFDRNPPFSNQAYNFQSGYDPRYADPLGRTLFARATYHF

SEQ ID NO: 17366 - protein, 1795 aa, Rickettsia parkeri
MNLQNSHSKKYVLTFFMSTCLLTSSFLSTSARAASFKDLVSKTPAWEKHNSTQQQNIWKDLTPNEKIKKWQEAALVPSFTQAQNDLGIKYKETDLSSFLDNTRHKARQARAEILLYIERVKQQDFDTKKQAYINQGVVPTDIEAATNLGISYDPSKIDNNVEHDQKVRRAEKDKKAVIELYVSSINRGIKYKHYVDNDIIPEIQEVRTALNMNKDDAQSFVASIRTEIMENAKGQYIADSHIPTEKELKKKFGISRDDNRDGYIKSIRLKVMDKEKPQYIADSHIPTEKELEQKFGADKGEATNYIASIATQMMLDKKSYYIDNNIIPNADELMNEFKIGPVKATSYINQIRAGIEANQFLNNNDTTKPSTGRSQKKSGSKNDHWYMSNQSINNTGTSARIVTGREKKQRYFFDPISTFKTYFNTKASKGNLTQSQHNINRIIQQEENIEEFKNLIKTDPIAALTLQVDSSYKQEAVTTILSDFNDDTIQRVLFSNDKGKLDFNTNIDVKNRPILQELLENSSSEEKTKFAERIQDYATRNISNSQFEEKARLDLIKLAASKDKSSVENFLTLQLELKNRMQPYVVNSVYILTPEIVKEINIELKNKGLIRDSLTKDYMIKLAKEVNNHTLNSVIKVILSDSKILSNETNKILGLAVSNNANNLEQTQSGIPNPPPLPLNGGIPNPPPLPLNGSMPPPPLHSQGFSSNSKHFDLNQLQTEYPHIHSLYVQFTHNTTVQSKAPLQPTASSATSTGRSTPETAYAKLYAEYRTETGGTKANDLQDQLIKRQADLTNVIRQILTESYANQGADEKTLLNLFSISTPEIAEKAKEAFNTLAQDQYIKDITVNGKKTITSEEIIKNLFNEDTDDAIKRILLSSCKISEELKRPIKLEFNKSELIRELQGKQNPFKQLEFAYINTKNFDQDIFGNRIDELINNPNILTIVQQATFLTKEDTNLRKTINSDQAQAKLDDLRTAILSTIKIEELITANLPQHDFIAIVKEKDPELLKEFLKATTLTVTGNNNLDQLRLALPSFTGMSNEQIRILSNKLKMSIILKALKECSQEKATQYIHTGNMPPPPPPPPPLPDSQDLELAYLKSLGITKANTSTFKTTPKTYHFSSDIALRYKEFTLSGQKSAGYKAKYSDADLLKKAIVESVAFEHSKNLSKAHQNNKYFEQIQKAVNTMYSSFIGHRTELEQKIHNIYTSKLLELTKDKEFIKYVEDNIILNKKLTKAFTSADSDFIDSRTELEQKIHNIYIQQLTKYPEEEVKEAFNTASLDFIGPRTEIGQEVHNIYKSQLLELTKDTELCLFTQQVLAEATELEQKYGSDIQSENSNNEKKVERLDQEKLQLFKQENEATNDESSTKDDTQPEDSNKKSEQSDSKTALSPRLLSSNDSKNDKSSDDKKSLLALRSSDEDDTGYATDEEELEESNSTTDEELKKDVVLESEDEAIDVSFKTEAITEQDEVTQRQQVSDDTSGKVAILVQATSTLHKPVHYNINDRLTVAAIGAGDEETSINRGVWISGLYGINKQRIWKNIPKYQNRTTGITIGTDAEFINSHDVIGIAYSRLESQIKYNKKLGKTTVNGHLLSIYSLKELIKGFSLQTITSYGHNYIKNRSKNINNIIGKYQNNSLSFQTLLNYKYRTKYDLHFIPNIGFQYDYSRASNYKEYNVDIENLMIQKKSNQLFESSLGGKIVFKPIVTTNNIVLTPSLYGNIEHHFNNKNTKVNAKATFKGQTLQETIITLKQPKLGYNIGSNILMSRKNINVLLEYNYYTHRKYQSHQGLIKLKVNL

SEQ ID NO: 17367 - protein, 157 aa, Rickettsia montana
QNSGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPFEPAVNDQKSKFGFAGQVKAGVSYDVTPEVKLYAGARYFGSYGA

SEQ ID NO: 17368 - protein, 123 aa, Rickettsia typhi
EAHQGEELYFRRDTKLAFGPFQNIYGASISNDGEFWVGAGHAWTQPYFDRRAYIQLHAMTGLYAKGDGVDLGGPIEFRSGIEVGYQARNGLRMGLGFDHRSNAGLYSDNPGLETIHFRVSIPT

SEQ ID NO: 17369 - protein, 149 aa, Rickettsia aeschlimannii
WNVYTRLGGMVYRADATQTNPTYGRISNHDTGVSPLAAVGVEYAVTKNWATRLDYQWVNNIGDAGTVGARPDNSMLSVGVSYRLGPDRAAPVVAPAPAPAPVVETKRFTLKSDVLFTFNKSTLKPKGQQALDQLYTQLSNLDPKDGSVV

SEQ ID NO: 17370 - protein, 245 aa, Rickettsia massiliae
SGWLVGHDAQLASGDIVGVAFGQADSSPSGSASGLRGIDRQVQGRVYLQRTQGPLYVLGQLGFGSFQRRLDRQLQLGDWNDWTSSRYSGQFWSGSVEAGYHWRQGSLALTPYLGLDQTQLRTDGFREQSGSGFGLQVQSAQATRSQLLAGVRTEWRWGGVQWRGYGEWQQTLRQSGLNPQASFTATSSWTPLVASSWPGRSGGVLGLSMVLPVGVTAGLWTMGLEHYFGTRSRGESLGLRYQLGF

SEQ ID NO: 17371 - protein, 689 aa, Rickettsia japonica
  misc_feature (5)..(5): Xaa can be any naturally occurring amino acid
  misc_feature (7)..(7): Xaa can be any naturally occurring amino acid
  misc_feature (10)..(10): Xaa can be any naturally occurring amino acid
  misc_feature (12)..(12): Xaa can be any naturally occurring amino acid
  misc_feature (14)..(15): Xaa can be any naturally occurring amino acid
  misc_feature (18)..(18): Xaa can be any naturally occurring amino acid
LQIFXSXCNXLXLXXAGXRLSHKGTAVLDEVSVVSSGSMYKMGEVPVHQAKSAVAISREDLDKQDVKKADEIGRYQAGFANQVFGNDTNTNWFRVRGAEVSQAVDGLPTFSYGFFTPYVETFGLEAVEVTKGADSMTFGAANSGGLINYVTKRAHRDQIGRGEFKTNFGSNNLYGFGADYTGKITDDENVRYRVVASLNHADGEWKDTDNKTVYIAPSLEWDISERTRLSILTSYQKDSGTPSSNFYPQEGTLRALPDGSYYSRNLNFGDPLNDHEENKQYGIGYELSHDFGNGLRANSSYRYNHVENNHRGGYIYPSAYAADWSAVAPSANGYNVSGQTVFNQGKAISHSTDNRISWDFKNDWLKNTVVVGTDYRHNKVDAQYSLYALGYTANLRDYRATWNQTGTPVGTDTHIKSRQLGFYLQNQARIADKYLLGFGIRHDRARQNEYTSDQTIKNNHTSYSGSLMYEGAYGLNPYFSYSESFRLPVGLSGNQSLYDPNITRQYELGVKYLPTWLDGVITLAGFRAKDTGALVNNGTGATISSADPIYRKGFELQADVNLTENWNATLAYTYTKAESEAATGEKTRQSLIPTNTLAARTAYNFTDGVLNGLTVGAGVRYLGHSVTSKGSLYSHARAPSATVVDLMARYNINQNWSAQLNVDNVGNRKYVAACDYYCYYVRQGIVGIR

SEQ ID NO: 17372 - protein, 722 aa, Rickettsia bellii
MSLGTVLISSLVNQVSAQEVPDIGYESDTIEHIAVSGRPMSDIEKPSTAATKMDVSIKDTGRSMMELDADDLKMRALQDVREAFNYVAGFRANGPADRTYIARGFSTSIDNVMVDGLRSLQGGEGGTGSKLPSTFNAENTTFLRGPEAILYGAGVAGGLINITSKKPQTTAKTSIGLNNRSYASSDTGNFKRNDTSFNLDSTGPITDESVLYRVLAQYTPSGDHFQDGREIEELLLDAALSFELGENTTILPRFERTDRKRTGGSGYADGVFESTFASGEVTTYGKPINRGKYYGSPIDVGENESTSASVLIKHQIAEDWKLAANFRHNETTSNALDLYISDSSALENEVGKDLVNRKWVYSAGDDSYNLFDINFEGKVETGSIKHHLLAGYNYRDMDIKFARSFQDSADAVGKNPISASNPDQQVTGPIPDGLVDSPAKPRTQTDTNIYLKDRISIGNTTIAAGLAYVKQDQEELSSGETIASSFDDTLWDLGVVQKINRDINVFATYSRAYEPVKGRYIIEYGNGKTDYKPVEGNNYELGIKGDLLNNNLTAAVTLFALDRSNSTKFNRGDDGWELLQLDGKSFESKGVEVDAAMYFSPKFNSSLSYAYTDAHDTVGDDKGVQSNNTPKHAVSLWNNYTFDKNISFALGLRYESERNDGDYKIKSYFEADVGAYYKTDDWDAALVVNNVLDKNRVEAGANWVTVQPNTPRAVNLSLNYHF

SEQ ID NO: 17373 - protein, 236 aa, Rickettsia australis
MDLPMRIGVLIGVFTVACGGAHAADDALPRLGRSGDFSLALPTLDDDGPATAGTTAGQWYLRTNFGVGGVQGSVAGATRANSGTDTARTFGVGVGYRFLPWLRGDITADYMLALTADRPLGVNSLHTGAVMANLYWDMFTIANITPYVGGGVGFGMANVRFKPFFAPAGWGQTDVGFAWNATAGVAWSFAQDWSLDVSYRYAAMGTQEFTTYTGVPYSIDDMATHQLRIGLRRTFN

SEQ ID NO: 17374 - protein, 148 aa, Rickettsia akari
QGDATRAMNVGVMVPSGLFKGISRDAGPLTLHWDLWGGHWRSHHADGTTGGYSQLGALMAWRYQPAGPKSPWFFEAGLGGSVLDGLYNSGQRRFSTAFQFTEVLAIGYRFGPEKAYEVSLRVQHFSNAGIKKPNPGENFMSLRFSLPW

SEQ ID NO: 17375 - protein, 470 aa, Rickettsia africae
ELLVTGEQDRYRVPSASTGTRTDTLIRDIPQTIQVVPEQVIKDQRVTRLRDALLNIGGVVQDGGFGGTSDQIGIRGFFAGGTLGGSILTDGFKDGRRGIRETANVERIEVLKGPASILYGGVEPGGVINLITKQPLKDPYYNAELSVSSFSTFRPSIDISGPLNSDKTLLYRLNSVYETSDGFRDFDQDIQRFFISPTLKWEIGQATNLTVQFDYLNDERPFDRGFLAFGEGILDIPLERILGEPDDVSKIEEIGLSYRLEHNFNDNWKVRNAFRYQSSDTSDYRAEPVRLNETTGILTRNFRSNDDYQENYTLQTDVVGKFATGSINHTLLFGVDLARSTSGGTQSRAPGGITPSIDVFNPVYNAAPRPGLDELTNVVRNSQGSTDGLGIFLQNQIAFADNLKLLVGGRFDTVDQNSTDLRDGSEFGRYDSAFTPRLGIVYQPIEPISLYASYSQSFQPNFGTRPDGSF

SEQ ID NO: 17376 - protein, 119 aa, Rickettsia honei
ADYASYRKWNNNKYSVNTKEVLRHSNGNWQELKTENQENGSFHATSSLGLSAIYDFKLNDKFDKFKPYIGVRVAYGHVKHQVHSVESKTTIVTSKPTKGATQPGKLVSGPTPKPAYHES

SEQ ID NO: 17377 - protein, 807 aa, Pseudomonas fluorescens
MRNLSFSRGSENLKWGVLFILLGACVLSLSAQGRSLLSGRVLSSDKSVIDFATVYLKGTQYGCTTNEKGLYHLKAPAGKYTLTVSAIGFETVEKEVEILADGRSKQNVILKPSVTELDEVVVVSNGVGRIKRSAFNAVAVDTRELQNSTKNLSEALQKLPGMKLRESGGVGSDMQLMLDGFSGKHVKVFIDGVPQEGAGTAFDLNNIPVNFAERIEVYKGVVPVGFGTDALGGVINIVTNKQKRNWFLDASYSYGSFNTHKSYVNFGQSFRNGLTYEINAYQNYSDNNYYINNWVEEFNHENNTSVSDESNIQRVKRFNDTFHNEAVIGKIGVTGKSWADRLMFNVAYSHFYKEIQNGVYQEIVFGKKHRHGYSIVPSVEYRKQNLFTKGLDVTVTANYNHNLTTNVDTAMYKYNWLGDRIPRSTAGEQNHQFSEQINTNWNTTLTAVYRLGRMHSFTFNNVFSTFRRTGRSLIEKNSVLEDYDEPTKSRKNIAGLSYRLMPSEKWNLSVFGKHYNSYSEGTVQLSDNNVGSDTRVSQSVSSFGYGAAGTYFLGKAIQLKLSYEKALRMPSTQELFGDGDLEAGKADLKPERSDNVNLSASYNKQLGKHGLYVEGGVIYRNTQDYIKRDLSTVGGTSYGSYTNHGRVETKGFNVSLRYSYSNWFNMGGTFNNLDTRDKEKKRAASSGQNALTYGQRIPNIPYQYANVDMNFYWHNLFAKGNTLTFGWDCFYQHDFPLYWENFGDPSTKIRVPQQISHNLSLGYSIRNGRYNISFECRNLTDEKLYDNFSLQKAGRAFYGKFRVYFGK

SEQ ID NO: 17378 - protein, 122 aa, Pseudomonas fluorescens
ARAQGSKAEAWATGLKYDANNIYLATMYSETRKMTPISGGFANKAQNFEAVAQYQFDFGLRPSLGYVLSKGKDIEGVGSEDLVNYIDVGLTYYFNKNMNAFVDYKINQLKSDNKLGINDDDI

SEQ ID NO: 17379 - protein, 448 aa, Pseudomonas fluorescens
MRVMKWSMIALAVAAAASTQMATAAPFVSDQAEAKGFVEGAKADLLIRNYYFNRDNKDGARDVKDWTQGIWGNFSSGYTQGTVGVGVDAFGYLAIKLDGGAGTSGSGNMSRSNEFNANGSRDPDDSQGKAGAAIKFRVSKTELKIGDMQPSTAPVFAVGGSRILPQTASGFQLQSSEIKDLDLEAGHFYSATSQDRNAREGGLYATYAGVEANTIDYFGGKYGITENLSASLYGAKLEDIWNQYYANVNLTTPFGGDTSLNTDFNIYRTTDTGSAKAGDISNTAFSLATALSFLKAHTITLAFQKVNGDTPFDYIGVGKNNRGGDSIFLANSIQYSDFNAPGEKSAQIRYDIKMAEYGVPGLSFMTRYVKGWDIDGTHTPAGSAYAGLYGEDGKHNETNFEAKYVVQSGPAKDLSFRIRQAWHFANADEGEGDTKEFRLIVDYPLSLL

SEQ ID NO: 17380 - protein, 1820 aa, Pseudomonas fluorescens
QNSHSKKYVLTFFMSTCLLTSSFLSTSARAASFKDLVSKNPAWEKHNEIQQQNIWKDLTPNEKIKKWQAADLVPSFTQAQDDLGIKYKETDLSSFLDNTRHKARQARAEILLYIERIKQQDFDTKKQEYINQGVVPTDIEAATNLGISYDPSKIDNNVENDQKVRRAEKDKKAVIGLYVSSINRGIKYKHYVDNDIIPAMKEVRTALNMNKDDAESFVASIRTEIMENAKRQYIADSHIPTEQEFKNRFGISRDDNRDGYIKSIRLKVMDKEKPQYIAGNSIPTEKELEQKFGADKGEATNYIASIATQMMLGKKSYYIDNTIIPNADELMNEFKIGKIKANSYIDQIRAGMKANQFLNNNDTTKPSTGRSQKRAEAKTTIGICQIKVQIIQEHLQGFPPGRKKKQPYFFDPISTFKTHFNNKESKGNLTQSQRNINRIIQQEENIEEFKNLIKTDPIAALNLEVGSSYKQEAVTTILSDFNDDTIQRVLFSNDKEQLDFNTNIDVKNRPILKELLENSSSEEKTKFAERIQDYATRNIFNSQFEEKARLDLIKLAASKDKSSVENFLALQLELKNRMQPYIVKSVYILTPEIVKEINIELKNKGLIIDSLTKDDMIKLAKAVNKQTLNSVIKVILSDSNMLSNETNKILGLAAGNNANNLEQTQSGIPNPPPLPLNGGIPNPPPLPLNGSMPPPPPPLNSQGFSSNSNNFDLNKLQAEYPHIHSLYIQFTRNTVQPKVPSQPTTSSATSTDRSTPETAYAKLYTEYRTETGGKKADDLQDQLIKRQADLDKCLRQILTESYANQGADEKTLVNLFSISTPEIAEKAKEAFNTLVQDPYIQDITVNGKKTITSEEIIKNLFNEDNDDAVKRILLSSCKISEELKKPIKLEFNKSELIRELQGKQNPFEQLEFAYTNAKNFDQDIFGNRVKELINNPNILTIGQQATFLITEDTNLRKTINSDQAQAKLDDLRTAILSTIKFEELITANLPQHEFIAIVKEKKPELLKEFLKATTIKLTGNNNLDQLRLALPSFTDMSNEQVRILASKLNMPIILKALKEHSQEKAKKHIHTGSMPPPPPPLPDSQDLELAYLTSLGITKFNANTSTFKTTPKIYNFSSDIAVRYKEFTLSGQKSAGHKAKYSDANLFKKAIVESVAFEHSKNLSKAHQNNKYFAKIQEAVDTMHSSFIGPRTEIGQKIHNIYTSKLLELTKDKEFIKYVEDDIILSKKLTEAFTSADSDFIGPRTEIGQKIHNIYTQQLTKYPEEAVKEAFNTANSDFIGPRTEIGQAVHNIYKSQLLELAKDKELFLFVEQLLVESTELEQKYGSDIHSGTIVNNEKKIGRLDPKKLRLFQQKNEATNDESSTKDDTQSENSNKKSEQSEENEATNDESLTKDDTQPEDSNKKSEQSDSKTALSPRLLSSNDSKNDKSSDDKKSLLALRSSDEDDKGYETNEEELEESNSTTDEKLTDEELKKDIVLESEDEAIDVSFKTEAITEQNEATQRQQVSDDTSRKVAILVKATSTLHKPVHYNILSDRLKVAAIGAGDEEASINRGVWISGLYDINKQGTWKNIPKYQSRTTGITIGTDAEFINSHDVIGIAYSRLESQIKYNKKLGKTAVNGHLLSIYGLKELIKGFSLQAITSYGHNYIKNRSKSINNIIGKYQNNNLSFQTLLNYKYRTKYDLHFIPNIGFKYDYSRASNYKEYNVDIENLLIQKKSNQLFESSIGSKIVFKPIVTTNNIVLTPSLYGNIEHHFNNKNTKVNAKATFKGQTLHEKIIIPKQPKLGYNIGSNILMSRKNINVLLEYNYYTHRKYQSHQGL

SEQ ID NO: 17381 - protein, 384 aa, Pseudomonas fluorescens
  misc_feature (231)..(231): Xaa can be any naturally occurring amino acid
QQPVLKWLRPHRFVSDQSEAKGFVEDAKLTETLKNYYFNRDNKNGGRDQKDWTQGFLGNFTSGYTQGTVGVGIDAYGYLALKLDGGDGTSGSGNMSRSDTVNPNNGARDVNDSQGKAGASVKFRVSKTELKFGDMQPSTAPVFAVGGSRILPQTATGFQLQSSEVKDLDLEAGHFYSASSQDKNARNGGLYANQAGVEADSIDYFGGKYSIPENLSASLYGAKLEDIWNQXYANVNLTTPFCGDTSLNTDFNIYRTTDTGDKLAGDISNTAFSLATALSFLKAHTFTLAFQKVNGDTPFDYIGVGKNNRGGDSIFLANSIQYSDFNGPGEKSVQARYDLKMAEYGVPGLSFMVRYVKGWDIDGTSTPAGSPYTGLYGEDGKHHE

SEQ ID NO: 17382 - protein, 382 aa, Pseudomonas fluorescens
QPVPKWLRPPPFVSDQAEAKGIVEDAKLLNLLVRNYYFNRDNKDGARDQKDWTQGIWGNFSSGYTQGLIGVRVDAFGYLGVKLDGGEGTSGSGNMSRSDTVNADGSRDVNESQGKAGGAVKVRISKTDLKFGEMQPSTAPVFAVGGSRILPQTATGFQLQSSEVKDLDLEAGHFYSASSQDKNASDGGQFATYAGVEANSIDYFGGKYAIIENLSASLYGAKLQDIWNQYYAYLNYTIPFGGDESLNLDGNIYNTQDNGDAKAGEISNTAYCLAAAISIMQAHTISPAFQRVNGDTPFDYIGVGKNNRGRDSIFLANSNQYSDFYAPGEKSAQVRYDLKMAEYGVPGLSFMTRYVKGWDIDGTKTPVGSPYAGLYGEDGKHN

SEQ ID NO: 17383 - protein, 398 aa, Pseudomonas fluorescens
GTSQFALASAQDYSKGFVEDSTFSINTRALYFSRDFRNNPSGPGSKSRAEETGLGFNALYESGFTQGTKGVGVDVIGLMGVKLDSGKGRAGTGLFPTGSDGRSQDDYSKGGGAVKFRISNTVLKVGDQYTTAPVFASDDSRLLPELPQGISITSNEIRGLKLEGGHFTSSVAQNQTYHDSLGLTKTDFVGGVYAFTPEVSGSLYYAKTADYFRKYYSNLNSTHALSNDQSFALDFNIYDTKSDGAGLQRAEKDGVTMLDNRAFSLQGAYTIGAHTFTLAAQKVTGDRDYGYGVVGGGTVSLANSIARSDFNAEGEKSYQARYDINMATFGMPGLSFMTRHVTGSGANTGTTSNGEEWERDIEAKYVIQSGPAQDLSLRVRQATIRSSDQVYWGSLDAL

SEQ ID NO: 17384 - protein, 353 aa, Pseudomonas fluorescens
SAGTTQFAMASSQDDSKGFIEDSTLTSKTRMLYMNRDFRNGAGNIAKPGGGYKNGYREDWGLSELLNYNSGFTQGTIGVGVDAFAMGTLRLDGGAGRQGNGLFASKSDGSPEDSQSKAGGAIKFRLSDTVLKYGNQFVASPVLSTDDSRLLPEVATGTLITSHEIKGLELSAGRFTAMSSQTGMYHDSLHLPVANIAGATYQFTENFVGGLAASDIDDYFKKQYINLNYTYPIDDAQAVNFDFDGYTSQGPELAGNVDNKIWSLAAAYSIGAHKFTLAHQRSTGDRGYYYGVDGGGTIFLPNSVQNSDFNGKDERSWQARYDLNMATYGVPGLSFMARYVKGDNISTDTGESK

SEQ ID NO: 17385 - protein, 335 aa, Pseudomonas putida
LAALPVAATADVTLYGAIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAKRGHLYLSVRYDSPEFAGFSGSVQYAPKDNSGSNGESYHVGLNYQNSGFFAQYAGLFQRYGEGTKKKIEYEHQVYSIPSLFVEKLQVHRLVGGYDNNALYVSVAAQQQDAKLYGARRANSHNSQTEVAATAAFRFGNVTPRVSYAHGFKGTVDSADHDNTYDQVVVGAEYDFSKRTSALVSAGWLQEGKGADKIVSTASAVV

SEQ ID NO: 17386 - protein, 124 aa, Pseudomonas fluorescens
QEESIGGEIFADYATGEARGPFQPVVGFSYSSENSAWLGFGLRTAMPLFDTGLVAEGALMPGFHATGDGPYLGGSLQFRSSLGMSYEFINEARVGVYYDHRSNADINRVNPGLETFGFRLSVPL

SEQ ID NO: 17387 - protein, 1539 aa, Pseudomonas fluorescens
SAGLVTASTATIVAGFSGVAMGAAMQYNRTTNAAATTFDGIGFDQAAGANIPVAPNSVITANANNPITFNTPNGHLNSLFLDTANDLAVTINEDTTLGFITNIAQQAKFFNFTVAAGKILNITGQGITVQEASNTINAQNALTKVHGGAAINANDLSGLGSITFAAAPSVLEFNLINPTTQEAPLTLGANSKIVNGGNGILNITNGFIQVSDNTFAGIKTINIDDCQGLMFNSTPDAANTLNLQVGGNTINFNGIDGTGKLVLVSKNGAATEFNVTGTLGGNLKGIIELNTAAVAGKLISQGGAANAVIGTDNGAGRAAGFIVSVDNGNAATISGQVYAKNMVIQSANAGGQVTFEHIVDVGLGGTTNFKTADSKVIITENSNFGSTNFGNLDTQIVVPDTKILKGNFIGDVKNNGNTAGVITFNANGALVSASTDPNIAVTNINAIEAEGAGVVELSGIHIAELRLGNGGSIFKLADGTVINGPVNQNALMNNNALAAGSIQLDGSAIITGDIGNGGVNAALQHITLANDASKILALDGANIIGANVGGAIHFQANGGTIKLTNTQNNIVVNFDLDITTDKPGVVDASSLTNNQTLTINGSIGTVVANTKTLAQLNIGSSKTILNAGDVAINELVIENNGSVQLNHNTYLITKTINAANQGQIIVAADPLNTNTTLADGTNLGSAENPLSTIHFATKAANADSILNVGKGVNLYANNITTNDANVGSLHFRSGGTSIVSGTVGGQQGHKLNNLILDNGTTVKFLGDTTFNGGTKIEGKSILQISNNYTTDHVESADNTGTLEFVNTDPITVTLNKQGAYFGVLKQVIISGPGNIVFNEIGNVGIVHGIAANSISFENASLGTSLFLPSGTPLDVLTIKSTVGNGTVDNFNAPIVVVSGIDSMINNGQIIGDKKNIIALSLGSDNSITVNANTLYSGIRTTKNNQGTVTLSGGMPNNPGTIYGLGLENGSPKLKQVTFTTDYNNLGSIIANNVTINDDVTLTTGGIAGTDFDAKITLGSVNGNANVRFVDSTFSDPRSMIVATQANKGTVTYLGNALVSNIGSLDTPVASVRFTGNDSGAGLQGNIYSQNIDFGTYNLTILNSNVILGGGTTAINGEIDLLTNNLIFANGTSTWGDNTSISTTLNVSSGNIGQVVIAEDAQVNATTTGTTTIKIQDNANANFSGTQAYTLIQGGARFNGTLGAPNFAVTGSNIFVKYELIRDSNQDYVLTRTNDVLNVVTTAVGNSAIANAPGVSQNISRCLESTNTAAYNNMLLAKDPSDVATFVGAIATDTSAAVTTVNLNDTQKTQDLLSNRLGTLRYLSNAETSDVAGSATGAVSSGDEAEVSYGVWAKPFYNIAEQDKKGGIAGYKAKTTGVVVGLDTLASDNLMIGAAIGITKTDIKHQDYKKGDKTDINGLSFSLYGSQQLVKNFFAQGNAIFTLNKVKSKSQRYFFESNGKMSKQIAAGNYDNMTFGGNLIFGYDYNAMPNVLVTPMAGLSYLKSSNENYKETGTTVANKRINSKFSDRVDLIVGAKVAGS

SEQ ID NO: 17388 - protein, 149 aa, Pseudomonas putida
LNVYTRLGGMVWRADATQTNPTYGRISNHDTGVSPLAAVGVEYAVTKNWATRLDYQWVNNIGNAGTVGARPDNSMLSVGVSYRFGQNEAAPVVAPAPAPAPVVETKRFTLKSDVLFTFNKSTLKPEGQQALDQLYTQLSNLDPKYGSVV

SEQ ID NO: 17389 - protein, 294 aa, Pseudomonas fluorescens
VSFKASHDLGEGLSALAYTELRFSKNVPVQVKDQQGEVVREYEVEKLGNNVHVKRLYAGFAYEGLGTLTFGNQLTIGDDVGLSDYTYFNSGINNLLSSGEKAINFKSAEFNGFTFGGAYVFSADADKQALRDGRGFVVAGLYNRKMGDVGFAFEAGYSQKYVKQEVEQAQAPKVFKDEKEKAFMVGAELSYAGLALGVDYAQSKVTNVDGKKRALEVGLNYDLNDRAKVYTDFIWEKEGPKGDVTRNRTVAVGFGYKLHKQVETFVEAAWGREKDSDGVTTKNNVVGTGLRVHF

SEQ ID NO: 17390 - protein, 397 aa, Pseudomonas cichorii
AQAEFFADGKAGLELRNFYFNRDYRQPGASQSYSEEWAQGFLLRYESGYTEGLFGLGIDALGLLGVRLDSSPERSGSGLLPYSTSDRRAAHDYSSLGLTAKLRVSHSTLKIGSLMPRLPVVQFNDTRLHPQTFQGGLLEVNEIDGLALQFGQLRQVKQRDSTNAEDLGITRGNKRNVLAGRHPGSDRFDFAGGTYRWSERLSSSYHYANLEDFYRQHYLGVQHLLPLTDDQSLKSDIRWARSTDEGGSRVDNRALNALFTYRLGGHAFGLGYQRMSGDSGFAYLAGTDPYLVNFVQIGDFANKDERSWQLRYDYDFAAIGLPGLTFMSRYLRGEHIDLLDGGGRGKEWERDTDIAYLVQSGPLKNLGIKLRNGTFRSDFGNDIDETRLIVSYALPLW

SEQ ID NO: 17391 - protein, 119 aa, Pseudomonas chlororaphis
GFSGSVQFVPAQNSKSAYTPAHFVQNKQNKKNQPPTLVPAVVGKPGSDVYYAGLNYKNGGFAGNYAFKYAKHANVGRDAFELFLLGSGSDEAKGTDPLKNHQVHRLTGGYEEGGLNLAL

SEQ ID NO: 17392 - protein, 358 aa, Pseudomonas mosselii
SQLAMASAQDESKGFIEDSKLNVKTRMLYFSRDFRNVPNGAQSRVEETGLGFLGTFESGFTQGTVGFGVDAIGMLGIKLDSGKGRAGTGLFPQGSDGRSQDDYSEGGGAVKMRISNTVLKFGDQFTALPVLATDDSRLLPEVAEGGLITSNEIDGLTLHAGHFTALNAQAQTYHDSLNLTEANVFGGTYAINDNLSTSVYYSHIEDHFRKWYGNINWALPISDKQGLVFDFNIYDTKSIGNNLTGAFVSKADGSNELDNIAASLSAAYNIGAHTFTLAYQKVSGDGDYAYGVDGGGTIFLANSVARSDFNAEDEKSWQARYDLNFAEYGVPGLTFMTRYVRGTGATTRTTDDGKEWER

SEQ ID NO: 17393 - protein, 198 aa, Pseudomonas putida
SQATKHELYQSVNLDNAKVTGFELKTKFTLGKWISWLKNVDFGYQLTKQKGKASDNRPLNAIQPMTQVMSLAYTHPDNLFGANLYLTHVSQKEASDTYNIYSKDATAGDKEYVQNKHIKWRSKAYTVTDFTFFVKPMKNLTLRAGVYNLFDKKYMTWDSARSIRMFGTSNLINQETGAGINRFYAPGKNYRMSVQFEF

SEQ ID NO: 17394 - protein, 128 aa, Pseudomonas putida
AVPSEQGVDFNAELIFTPEWEFWGGSARPNVGLSLNSSGDTSHIYGGGLWEYQWKNGVFFDAGVGLSANNESGKDLGSAVLLRLALEVGYNLSECNRMSLMMDHISNANTADPNPGIDNIGIRFGHLF

SEQ ID NO: 17395 - protein, 320 aa, Pseudomonas marginalis
GFVEDAKFDVLLRNYYFNRDNKDHSNDQKDWTQGIWGNFSSGYTQGTVGVGVDAFGYLAIKLDGGDGTGGTGNMSRDSDGDVNNSQGKAGAAVKFRISKTELKAGDMQPSTSPVFAVGGSRILPQTASGFQLQSSEIKNLDLEGGHFYSATSQDSNARNGNLYANYAGVASNSIDYFGGKYGITDNLSASLYGAKLEDIWNQYYANLNYTIPMGGDQSLNLDGNIYRTTDAGSAKAGDISNTTFSLAAAFSFLKAHTITVAFQKVNGDTPFDYIGVGGHDSSRRGANRGGDSIFLANSIQYSDFNGPNEKSAQIRYDLKM

SEQ ID NO: 17396 - protein, 177 aa, Pseudomonas fluorescens
ASRGVNKVILVGNLGQDPEVRYMPNGGAVANITLATSESWRDKATGEMKEQTEWHRVVLFGKLAEVASEYLRKGSQVYIEGQLRTRKWTDQSGQDRYTTEVVVNVGGTMQMLGGRQGGGAPAGGNIGGGQPQGGWGQPQQPQGGNQFSGGAQSRPQQSAPAAPSNEPPMDFDDDIPF

SEQ ID NO: 17397 - protein, 187 aa, Pseudomonas fluorescens
SYYVVAINGEFLPLFTKVDGATGAKKTADTATTTDLYKASFMAGGGAFGYKMDDIRVDVEGLYSQLSKDALAVAPTPAIADSLTAISGLVNVYYDIAIEDMPITPYIGVGVGAAYISTPLATAVSSQNGKFAFAGQARAGVSYDVTPEVKLYAGARYFGSYGANFDKTDKDGKGKLKVLYSTVGAEG

SEQ ID NO: 17398 - protein, 369 aa, Pseudomonas fluorescens
TAAPFVSDQAEAKGFVEDAKLTETLKNYYFNRDRKNDSNDQIDWTQGFLGNFSSGYTQGTVGVGVDAFGYLGIKLDGGDGTAGSGNTSVDSQGRVQNNMGKAGAAIKARISKTELKFGEFQPSTSPVFAVGGSRLIPQTATGFQLQSSEVQNLDLEAGHFYSASSQDEMNSDGELHSQYSSTTSNPVTGKTMDFAGGKYGITDNLSVSLYGSKFKDIWNQYYSNVNLTTPISGDTSLNTDFNIYRTTDTGKSNAGDINNTTFSLATALSFLKAHTVTLAFQKVHGDTPFDYVGVGDNNRGGDSIFLANSVQYSDFNGPNEKSAQVRYDLKMAEYGVPGLSFMARYVKGWDIDGDKMAIDSPCRSYGYGE

SEQ ID NO: 17399 - protein, 406 aa, Pseudomonas fluorescens
AVAISTQDESKGFVDDSKLNVRMRNLYFSRDYRKTESAGNKPAGLRHDQREWGQGFIGTFESGFTQGTVGVGVDAIGMLGIKLDSGRGYSGTGLFPSGSDQRSQDDYSKGGAAVKFRISDTVLKVGDQFTALPVFATDDSRLLPETAQGALLTSNEIKGLTLHAGRFKSMRAQAETDRDRISDGRGRRGLKEADVFGASYAFTDSLSTRLYYSKVEDYWRKYYANVNWALPITDKQGLVFDFNIYDPKGEGDNLYRATTDGDKLDNRAYSFSGAYNIGAHTVTLAYQKVTGDGEYANGIDGGGSIFLDNSVARSDFNAEGESSWQVRYDLNFAEFGVPGLTFMTRYVRGTGARTADTNDGKEWDRDLDVKYVLQEVPATDLSFRVRHATYRSSGQIGSVRRSAFDR

SEQ ID NO: 17400 - protein, 1021 aa, Aeromonas hydrophila
AGVKITQQNGACTGVVVDATGETVIGASVIVKGTTNGTITGLDGDFSLSNVKKGDIIQISFVGYQTVEIPWNGQPMNVTLQDDTQTLGEVVVTALGIKREKKALGYAMQEVKGDALLEARETNLANALTGKVSGVQIIRSSNGPGGSSKIQLRGANSVTGLNQPLIVVDGVPMDNFTGASNNDIDNPTLDMGNGLSDINAEDIESMSVLKGASAAALYGSRAGNGVILITTKKGTKREGLGITISGSVSAETTFMLPKRQKTFGQGENGVFDSTNGYSWGPEVTGQSYTKWDGTTANMQIFDNVKNFFDTGVNLSESISFQQQYDKTSIYTSLNRMDDSSMIPGANLSRTNLTLRASSTFGKDDRWSIDAKVQYINTLAENRPISGARGNNAFYTIFNMPTTIDIRDFSSPVKDEYGEMIWWSKGGINPYWSKDYNPNKDSRNRFLMNGSLKYKFTDWLDAEIKAGSDMYFTEGEEKLYAGSPTNNKNSRYSTSEKKFFENNFSFLISGHKDELFGKFGGNFSFGGNLMERKSTGLDNAMGKLTAPDLFSLANGDKKDLSITETYIHKKINSLYGTLGINYNGWAFLDATFRNDWSSALNKENRSFFYPSVSLSWVISDMVGKVGKGMPEWFTYAKARASFAQVGNDMDAYQLYNTYSIGSDPNGNTTAGQGKTKYDADVRSELITSWEAGAELKFFNNRLGVDFAWYKTNAKRQLMNIPLNNLSGYDNMKVNAGNIQNTGIEIMLNARPIETTQFSWDTQLNFSQNKSKIIELLPGKPGMQYALGGSDALQVYAVAGGAYGEIWGTKYQRVEEGEFKGQLLLNESGLPQATSDKHKIGEQQPDFLLGWTNTFNYKNFTLSFLIDGRFGGDIFSFTNMNLQRSGISECTAPGGKREDIVVAGVIKDGNGYKVNDQSVSLERYYKALATGRAGISEAYIYDATNIRLRNIALSYRFPSSMLKKTPFQQVKLGFTVNNVWMISSHLDGIDPESVYATSTNATGLENSSAPTSRSYLFNVTLGF

SEQ ID NO: 17401 - protein, 1126 aa, Anabaena variabilis
MQNYFSIQLLRVVKSSLWLTSKKIPRTMRLFILFLICSMSFVHATDSFAQKVEISIDAQNQTVEKVLKEIEKQSGFGFFFNNKHVNLKRVVSVSVDKSNIFKVLDKIFEGTDVKYSVLDKKIILSTEMTSKQQQAVKISGKVVDVNGEPVIGASIVEKGTTNGTVTNLQGDFSLSVSSDKAVIEISYIGYQPQELKVIAGKPLNVTMKEDAQALEEVVVVGYGSQKKVNVIGSIAAVDSKKLESRTAPSVSNMLTGQLSGVTITQSSGNPGQDQGTIRVRGVGSFGATPDPLVLVDGLPGSLNDLNPADIESISILKDASSAAIYGSRAANGVVLVKTKGGQKGKVTVSYNGYVGFNQATELPEMCDSWEYAELYNKAMGKEVYSAEEIQKYKDGSDPYNYPNEHYLDKLLGNKGLQTGHELTVNGGNDKTQYMVSFGYVKQNGLMEHNHYDRYNGRVNLTTELAKNLTLTTRLGGVVSKRSEPSTPGGMDSAGFKAFSSNALRFPGLWATKLEDGSYGLGPKVLGTPLAWLDSGSFYDENFDKFRSNVELAFTPVKGLTLKAIGGYNYTGQQIRHYRSAMEITGGKKLGPSSLSDTMYKTVYKTFQALADYNVKFSKNDLSVLVGYTWEDESQRTVGGSRLNFPSDEVPYLNAGGADGQTNSGGGYDWAIMSVFGRLTYNYDQRYLFETTMRYDGSSRFPTDNKFGFFPSVAVGWRLSEEQFFKEAESLSFIDNLKLKASYGILGNNNIGNYPYQSTYALGKAMNYVFGGVYTQGAAVTTYVDPTLKWEKTRTTDVGIETAFWNNKLTFNAAYFYRKTTDILYKPSASYSSIFGLGLSQVNTGSLENKGWEFEIGHQNKIGEFSYHVNGNFSIIKNKVISLGVGDVEQKSGMIGNGSDLFLGYPMNMFYGYKTDGVFLTDDEVKEWHDQSKIAPNSKAGDLRYVDISGDGKVDESDKTYLGSKIPQYTFGLGLGAEYKGFDFNILLQGVAKVKGQLTNYAGYAFFQEGNIQKWQAEETWTNNQSNRYPKYPRLEVMSNAGSNNTLGSDFWILDASYLKVRNIQLGYTLPKRITQKFGSSNLRFYISLDNPFSISGYRKGWDPEINTDGSYYPILSTYTFGLTLKF

SEQ ID NO: 17402 - protein, 151 aa, Anabaena variabilis
MWRTFLRVPLLLLLASLGGCAVYDYDYDDGDWRHYRGQPYGYAYEVPRYRVYDDGWRSERRYYSTRYYDQRYYPAPRRYDGHRDYRREQYRYQQRYHESRPAHRGERHPGNWQRGGQPQWRGHSPQRWQQHGRQDRPGHQGQQGGTPRWRN

SEQ ID NO: 17403 - protein, 987 aa, Anabaena variabilis
MLKAASFVSTSLIALAAATSVSAQTVQTDSGASTKAAESVSVEEVVVTGSRVRTTYNSPTPVNVVGQERMQQLAIPDVATALNQIPSFRATTSASTILFRVSGAIGGNTPDLRGLGTSRTLVLVDGRRFVPSLDSGGVDLNSVPNALVKRTEIVTGGASAAYGADAVAGVVNLILDTKFNGVRIDASTGVSEHGDGKNYFISASGGRGFASDRGHIIAGIEYRDDKGVGNCFTRDWCAKLTNFVPNPGYIGGVSTNGLPATLVLDNVNFVYSPTGVLLSAVQTVGGVKTTLGQQVGNTGATALPTALRGLQFNAAGSALTPFQFGNYLSGTFMQGGDPAASNNWGWGNPPLVTPTSHASGLVHVDYDLTPKTQAFGEFIVSRTEGGPVRTSVLLQAPAGGSAGLDINNPFITPAVRAQILGANPNITAINVNVAVAQGGDTVVASSTNDIYRFVTGLKGDLFGDWRWDASYEYGRTNSETIVKNTRLAAFDTQATNAITPPAGYTGTIYTTPAGAPVICASSVANPSDGCLPVDLLGSNITPAVLSKYFKDERQTRKITQNDVMVNFRGTLFSLPAGPIQAAFGAEYRRDSVSGDVDALTAAGRFAAPQVTALPEVVQKVTEGYAEANIPLLADLPFAKSLSVDVTGRLTHYSGFGSARPWKIGLEYQPNDQILVRVTRSADIRAPSAAESNPNTVQTFLPLNDPFSGSNHLIGAPAGGNPNLELESAKTNTAGIVLKPNFLPGFHASVDWYDITVKNAIDAVTAPNILSACATKNLLCNLITFSGAAKASPVVSVLSNFQNVAQVHAEGYEFQSDYTIPDVWDGAVTFQLNANYVKDLKSIGGTGLVTRMNGVTGNAGSLAGIAGVPKYKIDGLVAYTRPSWMVAAHMRYIPESILDPTKIGPKQAGYNINLPTSIMINSVSSRFYLDLSGSAHLPSIFGSSKTELYGGVTNVFDKDQPPELRLFGNPLQYDTVGRAFRLGIRAAW

SEQ ID NO: 17404 - protein, 362 aa, Anabaena variabilis
MKLGFGAAAMLVIAQGAYAQSSVTLFGLIDSGISYVSNEGGGKNVKFDDGIFTPNLFGLRGTENLGGGYRATFALVNQFSMANGSIIGTGIFGRNAYVGIESDRFGNITLGNQYDFMVDSLFAKGNAISMDISGLYGFRNGPFQRLALPNNPTGAFDWDRTAGSKPVANSVKYSSPTIAGFSGGVMYAFGGVAGSIGADNAVSAGLNYEVGAFGIGAAYTNEKYGPAPGTPSTSVRNWGVGMHYDFGAVTAKALLTTVHNSFNDAGVWMAEAGGMWRIRPDVFLGAKYMYMKGNEAVNDNHAHQVSVALQYLLSKRTMVYVSGDYQRANRGANAQINGVLDPNGASSSATQAVARIGLHTMF

SEQ ID NO: 17405 - protein, 780 aa, Anabaena variabilis
MLQLANTPASKNLKLSVLTAAILISNSALAEHNNNQLDKKNVEEVKVWGESKASDQADFTTPNSVLTREDFQSINIATTEDVVKFEPSIVIRRRFIGDSNGTMGIRGSNMFQTSRSMVFADGVPLHYHLQSRWSGAPRWTMVSASEIAQVEVLYGPYSAEYSGNAMGGVVVIETAIPQQREFHFDGAFFTQDFNAYKFDDSVNGFKGFISAADKIGDLSLYASYNHLNNDAQPQSFYYNTPTETDNPNTATGAYAGKSSTGDDVLYFSDSGVVNTQTDNLKFKVGYDFGHWQTLLNIAYEDRQSSSDSPTPFLEDLNGNKIWGGNVVVDGQNLTIPASRLAVSDMDRRSLSVGLRLKGDLNSNTSLEANLNQFSILEDQNRSSSVNPNHPSYTLDGQVSDYDDTGWTTAEAKLRFSQLGNTHLALVTGVRHESYQLNYSVYDSSNYAAGSKDTLTNTSGGETSINAAFAQFSWDINSQWDMAFGARFESWKSSNGYISEENTTTGNVEKAPVPEISAEKLSPKLSVGFSPNSDWQLRYSLARAYRFPIVEELFSQYQAYNAISLANPELKPEDGIHQNIMIERSLNNGYARINVFTETIEDAIDSQTTLLPGGGSVRTFSPVDETKAQGVEFIVNQYDFLISDLDMRFNWAYIDTEVISNSTAEGDDISPENSIVGNELPRMPHWRGNLMASYALTEKWTTSVNLQYASDAYGRTDNTDTERNVYGAQDGYTRIGLKTHYALNKTLKLGIGIDNLTNEIAYVAHPWPGRTVYFTLAYDLK

SEQ ID NO: 17406 - protein, 1261 aa, Anabaena variabilis
MSHLLDRLQFFKKKQGEFADGHGETSNESRAWEGAYRQRWQHDKIVRSTHGVNCTGSCSWKIYVKNGLITWETQQTDYPRTRPDLPNHEPRGCPRGASYSWYIYSANRLKYPKVRKPLLKLWREARAQHGDPVNAWASIVEDAAKAKSYKSQRGLGGFVRSSWDEVTEIIAAANVYTAKTYGPDRVIGFSPIPAMSMVSYAAGARYLSLIGGVCLSFYDWYCDLPPASPQIWGEQTDVPESADWYNSSYIIAWGSNVPQTRTPDAHFFTEVRYKGTKTVSITPDYSEVAKLTDLWLNPKQGTDAALGMAFGHVILKEFHLDRPSAYFVDYCRQYTDMPMLVLLEEHAGGAFKPTRYLRAADLADNLGQDNNPEWKTIAYDERSGGLVSPTGAIGYRWGESGKWNIAELDGRSGDQTRLQLSLLDGPEHACEVAFPYFAGQEHPHFKGVANDEVLLRRVPFREIVAADGKRLRVATVYDLQMANYSIDRGLGGDNVATSYEDADTPYTPAWQERITGVPAARATQVAREFADSADKTRGKAMVIIGAAMNHWYHMDMNYRAVINMLMMCGCIGQSGGGWAHYVGQEKLRPQTGWAPLAFGLDWSRPPRQMNGTSFFYLHSSQWRHEKLSMHEVLSPLADASRFAEHALDYNIQAERLGWLPSAPQLNRNPLRIAAEAEAAGLPVADYVVRELKSGGLRFASESPDDPQNFPRNMFIWRSNLLGSSGKGHEYMLKYLLGAKNGVMNDDLGKAGGPRPTEVDWVDDGAEGKLDLVTTLDFRMSSTCMYSDIVLPTATWYEKDDLNTSDMHPFIHPLSAATDPAWEAKSDWEIYKAIAKKFSAVAEGHLGVEQDLVTVPLLHDTPTELAQPFGGDGHDWKKGECEPVPGRNLPTLHLVERDYPNVYRKFTSLGPLLDKLGNGGKGIGWNTEKEVKLVGDLNHRVVESGVSQGRPRIDSAIDAAEVVLALAPETNGQVAVKAWEALSKITGREHAHLALPKEDEKIRFRDIQVQPRKIISSPTWSGLEDEHVSYNAGYTNVHELIPWRTITGRQQFYQDHPWMQAFGEGFVSYRPPVNTRTTEKLLNRKPNGNPEITLNWITPHQKWGIHSTYSDNLLMLTLSRGGPIIWLSEHDAAKAGIVDNDWVEVFNANGAATCRAVVSQRVKDGMVMMYHAQERIVNVPGSETTGTRGGHHNSVTRVVLKPTHMIGGYAQQAWGFNYYGTVGCNRDEFVVVRKMSKVDWLDEPRHGGLGGDALPQPLPQDI

SEQ ID NO: 17407 - protein, 853 aa, Anabaena variabilis
MECGAALKLNQYIYLGIASTICLLITQKANAQEKPINTKDIGLITNIPQLSDIQRPATSVKDWLAQSAPTPPQIKITGVRINRTDDNFELILETPDGEISAPETLQEGNIFIADIPNAILALPEGKVFREDTPVDGISYVTVTQEESNNTVRVTISSPGNLPPIQVVNQSNNLTIALTPTPTSPDIELIVTAQKRPEDAQDVPLSLTVIPQQEIEDAQIRSFQDIANNTPNFSFLPTTAGSADFSYYSVRGLNNFNFLANQDTVGFYIDDVPFDYGGFLDVGLIDLERVEVLRGPQSTLYGRSSPAGVVNVISRPPSNQPEMRISALYGSYNNRELQLSLSDAIIPDKLAFRLAGAYNARDGVFDNIFLNKPIGERSQLTGRAQILWTPTPEWNISFNAYASDNDNGNPTFSRQNAQNPFQVSQEVDGFNRLSTNTQALKISYNGNGFRATSITSRRFSNQNTLVGDNFPGDLLQQIIGINSTLWSQEFRLQSPESADRLRWLLGGYYESRNFNVLDDTFKYTDAGAVAFGVPAPGSDRVSAEQNRQTYAIFGQIDYKPIAPLTLFAGWRYETADAELDRRRVFVNPDGTVNPPTAEVRNATLNSDAFIPRFGLQYRFNPNLMAYATIAKGYRPSGFNYRADTEDTRRFQEETTWTYEVGLKSSWLDDRLSANLSIFQSDVDNYQVLLTDDFGFFRNVTNANVKVTGLEFELKAKPLQGLDLIAGIGYVDSKFKNYRNPFTNGDFSNNRVPFAPELTYNLAVQYRSPGGIFARAELRGYGITYFDDANQVKQDPYALVNARIGYEGEKYGIYLYANNLFDTRYITSGFLFPPPNVTAGFGDPVTYGVRVSASF

SEQ ID NO: 17408 - protein, 857 aa, Anabaena variabilis
MRTQAVSRPFPSRPAGIMFFALCGAGAGLACAGAVGAPLRTQQAMQTTIAGDHAGDYAEVLDGALTIAPGAALGADGLGTSLRQSGGYSVVGSGAQLTGGIEMTGHAATRLGVGAGPQAKSYRLAMADGSAAHLDNIWLRSLPDGATSANGGTALDLRDHAAATMGANTRIQATVPLSDGMELVAHASAIVDGSRIEGTMSGAQAAGAALLSLHRATLIGGAQGLVASQQSLVTVSGGQIASLGTTSNPHGDVDSVGLFAISGGPADAPLSVDVSGHAVIQAKGARSAGLLAEAIDAPIEVSVRDSVIQGDHDGIVVNMNPVLSGGAKLATLDVAGTQVVSGDGAAIRLGRGAKAAIALSRNASVNPASGVALLTGAGSEASVTVENAAVNGRAVNQGGTSRIALGANGVWRGGMSGVDSLTVNAGGLWALDGSSDVGQLAMNGGTVNLNGGSQAHVLSARTLSGHGNFLLKTDLAGYAGDQLAVSGLATGSHVLTVADTGRAVADPKSLQVVRTGGGDAGFSLANGAVDLGVYRYRLQRDGFNWNLVPLTTGRYSASATSVLNLISASPVVWYGQERTLRSRLGELRFDRDRGGAWVRPYAGDYRILGVTGAAFQQRQSGIALGADQALPLGGGKAYVGGVFNYSHAELDDHAGASGAVDAYSVGLYGVWLAQNGAYLHGLASLNRYQNQGQATMSNGVRAKGSYRQNGVGASLEAGRRFALPRDWFVQPYAQLAGVRMNGATVALDNGMLAQADHADSIQGSVGASLGRGMHAAKGGVAEPYVRLAVTHEFVKNNSVRVNGQPFDANLNGSRVEIGAGVSAEIGKRLSGHLDYAYAKGPRLEKPFMLDAGIRYQW

SEQ ID NO: 17409 - protein, 862 aa, Anabaena variabilis
MRVKQDSLFAYIWLTSTISILNAFPAYSQEIAIKDIPQLSEIQLPYTSVKELFAQQQNPVIQVTGVRINQTPKSLEIILETPASDKLQVTNKSEENNFIVDIPNAQLSLPNGNSFRQEKPFTGITELVVTNQDANSIRVTVTGEEGVPKVDLDDSDEGLIFVVTPVTSSTSQPQQPQILDKPTSETPATQPSAENQEPIELTVTGERDGYNVPTATTGTKIEAPLRDLPLSIQVIPRQVIEDRGVVRLNDLADNVAGVQQEPGYGSLPSVGFRIRGFTTNFGNLRNGFQDFGYVTPRDIANVEQFEILKGPASVLYGGGQFSSGIPSGVVNTVTKKPLEQPYYNASITYGSYNFFRPTIDLTGTLTEDKSLLYRLNIAYENADSFRDFTRNDSFFIAPAFTWKIGPRTNLAIEFEYQNYNFNFNYGFLPEPEFLTLPRNRFLGEPDFNDSNVNSTAFTYRFEHQFSDNWKFRQGFNLVQANLNSKSTFLFALEDDRKTANTSPSASDEVNDNLTLQNEIIGKFKTGSLRHNLLFGIEFSRYKFNYNFTTGNDIRIDIFNPQYDANIIIPSSPTFGREYGSNNIAIYIQDLIEVLPNLKVLAGGRLDNNELFRNNTVTNTTINEQSNSRFSPRVGIVYQPSQTTSLYFSWSNSFAPNYSARSRTDEQFKPEIGEQFEVGIKQDLIKDRLSATLAFYQITRQNVLTPDPIDPNFSITTGEQRSRGVELDITGQILPGWNIIANYAYTDAVVTKDESIPVGSRLYGVPENSASLWTTYQFQSGNLQGLGLGLGLAFVGEQETRLPSTLTLPSYVRADAAIFYRRDNYKIGLNFKNISNVKYYTLDGYFIYPAAPFTVQGTVSFDF

SEQ ID NO: 17410 - protein, 724 aa, Anabaena variabilis
MRVKKFLWLITVVSTGVNSPLSAAESTDDNGETMVVESTAEQVLKQQPGVSIITRDDIQKNPPVNDLADIIRKMPGVNLTGNSASGTRGNNRQIDIRGMGPENTLVLIDGVPVTSRNSVRYSWRGERDTRGDTNWVPPEMVERIEVIRGPAAARYGSGAAGGVVNIITKRPTNDWHGSLSLYTNQPESSKEGDTRRGNFSLSGPLAGDTLTMRLYGNLNRTDADSWDINSSAGTKNAAGREGVTNKDINSVFSWKMTPQQILDFEAGYSQQGNIYAGDTQNSTSNAVTKSLAQSGRETNRLYRQNYGLTHNGIWDWGQSRLGFYYEKTDNTRMNEGLSGGGEGRITNDQTFTTNRLTSYRTSGEVNVPVIWLFEQTLTVGAEWNRDELNDPSSTSLTVKDSNIAGISGSAANRSSKNKSEISALYVEDNIEPMASTNIIPGLRFDYLSESGSNFSPSLNLSQELGEYVKVKAGIARAFKAPNLYQTSEGYLLYSKGNGCPKDITSGGCYLVGNKNLDPEISINKEIGLEFTVDDYHASVTYFRNDYQNKIVAGDKIIGRSASGAYVLQWQNGGKALIEGIEASMTVPLMPDRLNWNTNATYMIASEQKDTGNPLSIIPKYTVNTFLDWTITSALSANVNWTLYGKQKPRTHAESRSEETKGLSGKALGAYSLVGANVNYDINKNLRLNVGISNIFDKQIYRSAEGANTYNEPGRAYYAGVTASF

SEQ ID NO: 17411 - protein, 1066 aa, Anabaena variabilis
MKKSDKMVIIALCTFLNSYIFALEPNFEKDLDIINTKSAYEQGITGQDVFIGIFDDDFRLEHSSLNDQILEALTFSDQTKANYWNYNSHGSQVAAIALGAFNNPIMHGVAYNAKGYGMQAPASLDAFNHIKENLDAEYKFFGDPNKNIKIINNSFGDFVFPILHIDATEDFYELTQDEVEDYIIEAMDQTNANSSIIRLSKEKQILNIFAAGNSGISSPSTLASLPHYDQDLNAWLAVGAIDSSKVTKLGDEGFDMSKPFAFTDFSNAFKGTAYFSILTPGEYIWSADSATTNGFVPEQGTSMAAPFATGAAALVSQKFPFLNGKQIGDLLLSTANSNIKLPKMVLKNITNNKSKKLFVSLIYVDNAIPTMADGSLDWTQINKDRIEAGYTDEEIAKFYTQYFKKYSIKTTDKQIQKYIAEQIDFISDINNIQVSSITKEELIGQGILDIKKAMNGLALLDANRLTLNDILNYGNEQALYYTIDTNGYNATFANDIAQRKYNPLWHYKGGEYSMHDLNVGFIKDGGGILTLSADAFFEGNTIVRNGGLKLFRIGNKGGEIKNSNVFVEQAGTLSGNGIIQKNLYNQGIVRPGNEDLSDLIVNGTYTQNGENASLQIDVANLAKNNSKLIANNYDIKNSKLVFIPLTDTFYEKNTKIKLDLGNLKNHLNSFSTIGLEKSLTLDFDISQDKESIVFKGVKNGAYDIKNSGIGASLRDIRYKLNDPNLNRQNLYKDFFKNLDTSKDISSIQNTVKSIDNQSYLSNISALIEDQAKITQNYTIFAINNNLSNTLFAPNNDYAKNKEYFWYAAPNYKKTDADEYKGRKIGTDFGFGTSMSDNGQISLNLGASNTKNKFNESNYETDSINAGINYIYDFQNFKVLSAAALGYGKNTLDLSSNPILSSSSKSNYNHFIAGAMMGLAKDFEFNNIILTPISYVNYNYIYQEGFDINSNIFARKVDSISHHTTSINAGLNLAYLNKNQNITTKLSSYAIYEYRLSGKDIKNSSKFIDFSSNGFTQKYELSEHLLTIGANLEMLYPNDVFIRFSTAANIQQDAKSLNLTATIGKMF

SEQ ID NO: 17412 - protein, 875 aa, Anabaena variabilis
MAKVWKTVRQAALSGSSLIVLFAAGHGSAQTANTPPSEPATGASENVLEELVVTGSSIRGVPPIGSNLISISRDEIKAIGAVTTPDLLATVPQLNSFNTAPRANNAGAGSFAPGMRSLPATATLPLLNGHRVVAGGANETNPDFPFLPDLAIERVEIVADGASSIYGSDAIAGVVNFITRKRYSGLQTSVRYGAADDYHTFSVSGLAGRDWGSGSVLAAYQYAESGNVTGADRDYRSVDFRPSGGVDTRGTSCPSPNVVVGATVYAAPALAPNTTNHCDVGAPVDLVPASRLHSAFLTARQEAGDHVTLWGDLLYSDRKDTVRAAIPAQAVTLTAANPFFRAPPGVATTFETVYFRPDNLVGADHFEQTYHVKAGNASAGADVRLPRDFNLSAYGTYDWATHVAFQPMINPVALAVAAAGATPATALDPFGQGTAPSVAAGITNYSTSVTIKQRTKLGAMKIDGPLFDLPGGEVKIAAGAEYRRETFAQRGFVGATPVPENLGRNIKSVYGELFVPIFGAGNETRFMHRLSLSLSGRYDHYSDFGSTTNPKVGVNWDPVEGVTFRGTYGRSFRAPGLRDVGATVGAYYLDAATAGVAARDPTRGAAQVNTVYLLGGNRTLQPEKARTYSFGVDVAPPFLPGFRASATFYDINFTDVIGTPPTSLVFTDPTFASVVYRNPSATQLASLLALAVPVNLPSPLPTIGNALDLRRGNFGVRKTSGLDFDVNYRRPTGFGSVFVGVAGNYIYKFDTQLSPTAPVSNALRLGVPRATLRTTAGFTTGPVSVASYVNYRDGVTNAFNTPTGVGAYEADPYTTVDLRVAVTLPNTGLTSGTELALQVNDLFDKTPPFFPATDGIGGNYNPIGRFVALNLRKTF

SEQ ID NO: 17413 - protein, 117 aa, Anabaena variabilis
MQKIVIVANGAPYGSESLFNSLRLAIALREQESNLDLRLFLMSDAVTAGLRGQKPGEGYNIQQMLEILTAQNVPVKLCKTCTDGRGISTLPLIDGVEIGTLVELAQWTLSADKVLTF

SEQ ID NO: 17414 - protein, 188 aa, Anabaena variabilis
MFKGQKTLAALAVSLLFTAPVYAADEGSGEIHFKGEVIEAPCEIHPEDIDKNIDLGQVTTTHINREHHSNKVAVDIRLINCDLPASDNGSGMPVSKVGVTFDSTAKTTGATPLLSNTSAGEATGVGVRLMDKNDGNIVLGSAAPDLDLDASSSEQTLNFFAWMEQIDNAVDVTAGEVTANATYVLDYK

SEQ ID NO: 17415 - protein, 732 aa, Anabaena variabilis
MFNHTPLATALALAFAVPFATPAVAQTAPQTTSQPPAANANATITTAADAGSLPTIGVAAQAEQQDFQAERATVGAKTPTALRDIPQTVTVINKAVLQSQGATSFQDALRNAPGVTIGAAEGGQIGNNINLRGFTAQNDIYLDGFRDRNQYYRDTFDLEELEVLYGPSSMLFGRGSTGGVINQVSKKANLHDSAEVTGMIGTDAKYRSTVDVNHKLTDTSAIRLNAFGQSLGSTRDEMKNKDYGIAPEVRFGIGTPTEVTISALIQHNYDMPDYGVQALNGRPSPVPKNTFYGLTTDRTIQDIQTVTAGIKHKFSDNLILTNQTQFSHSMTDARETAPQAVLTGPLATSPALSNGNFTKLSPSQLFIKLQSHDRVIENHSLYNDTMLQYKFVTGPIKHDLIAGVDLGHDSYSNQAQTRGNLPVVSMVNPAYLSNPAGVTTTVGNYADSGSNEIGAYVNDTVSIGQQWKVIGGLRWDRFQAQIHNTISAPSYATQTNFFTSVRAGVIYQPTDWQSYYVSYGTSFNPSLEALTVTNLTQNLAPESTKSYEVGGKWDLLGGNLSVTSSFFREEKTNARTQVSPTEYELDGDVRVDGFQAGVTGHITDKWQVFGGYTYMDAIILKARDGTQGHVPANTPRNTLTFWTTYAITPHWEIGGGPTYMSPRYASNTNYVQVPGYTRWDATAAYHAKKYDVRLNLLNMTNKYYYDALIPSDGGRSVPGIGRTLLATFDYRF

SEQ ID NO: 17416 - protein, 546 aa, Anabaena variabilis
MTKLFWNALKFSPVLFAATFFATNSALAVEAGEPVMSVSQLTQASESQNIGQVTSVSQFSDVQPTDWAFQALQSLVERYGCIAGYPNGTYRGNRALTRYEFAAGLNACLDRVNELIATATADLVTKQDLATLQRLQEEFSAELATLRGRVDALEARTAELEANQFSTTTKLSGEAIFSVSQAFGDTRALPSGSQAARSDLDSNLTFANRVRLTLNSSFTGTDQLQTRLNAGNIISNNANNIGNASTGTNMTRLGYDGGTDNSVSIDKLNYAFNFSDAIRVKIDATGAELNENANVFNPDFRSSGSGALSRYGRFSPIYRQAYDGAGITVNVNPSGPLTFTAAYMATGRNSAANPGLIAAGREGGLFEGDSTIFGQIAFKPNQALNLGFAYARTYQQNGAVFGDTGSAFANRPFGNAKTEANHYGIQATFQPSSTLTLGGWVGYTTVDSLQDNRDADAWYWAASLGIRDFGREGNTLGLIFGQPPKITGGNNIASENGTSYHLEGLYKLKLSDNILVTPGLLVIFNPENNNNNDTIYVGTLRTTFTF

SEQ ID NO: 17417 - protein, 732 aa, Anabaena variabilis
MKPGGRQILAVRQQRRSGIPRIPFANRSALAFAALVLASAGARAADPPGTAVAAATAETLPDVVVSATRSEQRRFDAPAAVDSVPVDPLRSATPLVNLSEVLAGVPGVAVRDRQNYSQDLQLAVRGFGTRSTFGVRGVRLYVDGIPATMPDGQGQASTADLANASRVEVLRGPFAQMYGNASGGVVQVFTPDPPKDGFSGRASTGFGSDGQWQAGIALAGGNDRLGGSLDAWTYQTDGYRDHSAARRYQLNAKVVAQPASGTRVTGQFNYFNQPLAQDPLGLTRAQADANPRQAVSAATQFDTGKNVEQTQAGVVVDHQLTGTDSVSARLYGGTRNLYQRLGFSGAAPNSAGGIVDLDRTYGGAALSWSRRTATAAGLPLLWSAGLEANGMRDGRNGYVNQNGTQGALRRDETNTATDLGAFAQFDWTFHPAWQLVGGVRASRVRLGIDDHFINAASPDDSGSATYSNVSPVLGVVWHALDSLNVYANLGRGFETPTLTEVAYGPGGVGSNLGLQASTSRQGEIGIKWQAAGQRLEAALFDADSHDEVVPQSNNAGRTVYQNVSGVHRRGFELGWRGGFLGEVGTPGKGGGSRIEAGLAYTWLDAYFGDSFVNAQGQTVAAGKRLPGTARHSLGADLSWRPAAPLTLGAEMRVDSRVYADDLNTQAAPGYAVFNLRAGYEFRIGPTRLYVFGRIDNLTDRRYIGSVIVNEANGRYFEPAPGRRFFLGLRAAL

SEQ ID NO: 17418 - protein, 575 aa, Anabaena variabilis
MSNLLWKSLVVSPAVLGATLLVSSAAIAATNATTELSVTETVVPTELAQQPEIVAQAAPITEDTKVIDQVNRYSNEGKGNAQSQVTSVSQFSDVQPTDWAFQALQSLVERYGCIAGYPNGTYRGNRALTRYEFAAGLNACLDRVNELIATATADLVTKQDLATLQRLQEEFSAELATLRGRVDALEARTAELEANQFSTTTKLVGEAIFAVTDAFGENTGDANNTVFQNRVRLGLQTSFTGRDVLTTRLAAGNATGFDFRDNNNNSIGASGQGLQTFQVGSTGNNNVEIDRLTYEAPFGPAQVYLAASGGRHSHYAAVNNPYFFDKTDGGNGALSTFSSENPIYRIGGGAGIAFNVPFGQGGSILRPSSFTVGYLASDANNPGPNQGLFNGDYAALGQLNFSVGDRLALAATYVHGYHGASGSALFDSGANGAIVGTSLANNNSFLNASSSNSYGLSAAFRPSDKLSVSGFVSYSDVTGFGANDDREVWSYGIGVALPDFGKRGNVLGIFAGAQPYARGVQAGANEVPYQVEGFYKYRVSDNISITPGVIWVTNPGQNSNADDAIIGTLRTTFTF

SEQ ID NO: 17419 - protein, 707 aa, Anabaena variabilis
MFSGPPSPRSSLLLALLFSPVLLADDLFVDSEALPQILTATRLKQSPAEVPGSMTVLDSELISASGARDISELLRLVPGMMVGNISGNQAVVNYHGTNATEARRMQVLIDGRSVYRAGLATVDWSDIPVAMEDIERIEVFRGPNTVSYGANALMAVVNIITRNPADSHGTRLKLTRGQRGINDFYASQSTGWNGGDLRLSLSGQEDDGFDSDRTGADYRDNRRLNRFSLAVSQTLSDNQSLDWQINAKDGTNQRPYTYRPVFSGITAAGNNSDVVAKDYAGSVRWNLDLNPDHSLYVQGSAQHWDRQQTWRACDAEVSFSPQLTELWQLNPNYTERLARNMTLFTGPGAPAGTPQEMALANQVLDQWRNGARQTLCGDIDQSARESRYDLELQDTLSLSDSLRLVSGLNYRYDRADSETYFNGTLDDTTWRAFGQLEWRASEHWLLQGGAMFEDMQLIGSSLTPRFAINYLFNPRHSLRAVYSEAIRSPDMFENNVNWSYQVTNLRPAAYGQSSARYFVKTRGPGDLDQEHMRSRELGYNGYFPEWGLALDVKLFYDEITGMISEPLRNNQYIASNANDSRFRGTETQLDWRLSAADRLRLTYAFVDAEASNPLDQQFTARNSGSAGWLRDWGHGWNSALFYYGDNALNGYRFERVDTRIAKRIALGKAQLQLAGVLQQRLDHEPTTFVDNNYDERRVVYFSAELEF

SEQ ID NO: 17420 - protein, 924 aa, Anabaena variabilis
MLKHKRSALSIALAVAMAPTWAAAQTATPAQASDAQQGASEQTAGAVTDLDKVQVTGLRRAIEGAISVKRDSTSIVEAISAEDIGRLPDVSIAESLARLPGLAAQRVAGRAQVISVRGLSPDFSTTLLNGREVVSTGDNRSVEFDQYPSELVSGVTVYKTPDAGLVGQGLSGTVDMQTARPLSYNERVIAIGGRYQRNSLGKAANVDPYGNRFNVSYIDQFADRTIGLTIGYAHTDMPIQENQVGLYEPWQQVNAQRQRPGVADGVYFSDGIKALRRTGNQKRDGVMATLQYRPSNAWTSTLDAFHTEAEQIDTANQFELNLSNYNGGYTPGLNISNVRVNDRNTFIGGDASGVYPLVRGMYNKREDKIDAFGWNNEITAGSVKIVADLNYSKATRDELNLENNLQRAPMPQLDTVGVSVVGNGFSQLTPGMNYSNPDELFLTNTIYGSGYGKVPSVEDVLKGARLQASFPMPEALSWFSDLDVGVNYANREKQKTQPEGNITLGAQGEATVAADLQYAPVNLGFAGLGSLPAWNVPATVARYMLFNPSDDASFLVSKAWTVEEKITTAWLRANINTEWGEVGVRGNIGVQLQSADQSSQANYWDASQPAGSEVRPIDDGKTYRDWLPSLNLAFQFPYEQTLRFAMAKQVARPRVDQLRASLEFGVDTSTGRPGASGGNPMLDPWRANALDISYEKYFADRAYVAAAFFYKDLKSYIYTQSRDNYDFSALVAGYVPPPGSAPVLTTGTFSAPFNGKGGTLRGVELTASLPLDLILAPLEGFGIQASATFNDSDVKIRDPESASSVGDGEISLPGLSKRVYNLTAYYEHKGFEARVSQRRRSDFIGEIGNFNGNRTLRYVVGENITDAQISYNFSEASSLSGLTLLLQASNLSNSPYRTYAETKDRPLEYIEWGRTFVLGANYKF

SEQ ID NO: 17421 - protein, 733 aa, Anabaena variabilis
MQNIKISAILAAFLAVGSSCVAAENVRLETIEIKNSTGESISDSGISEHFLQKDALFGPLMDKKVKDIPLQINTVSNELVQNLQATGLENVWHVIPSATVSYMGSGSVTRPGTRGMYGGVIGNNYWDGFMVTATTAVPMMIFDKLEVQNGLSGSLYGSQHPSGIFNYTRKRPVDSQTIVRVDWSEKANFGTMLDTSDRFEKVGYRGIFYFNDGEGFVKDSVKRSKLANLALDFYPTDDLTIETNFTYYNYIRYGYGARLMSPQTNGLATFNVPGAIANDKKGIAQTWAGMDLESYNTSVKLKYNISNNWYMEGGYQHHISDRNTMEQGNTLTGNNGEITSSVDRKLSKPPRFILQSWFVKAMGHETTGSIEHDLGISTYGYIYDSKSEFIYGSRNKGTVPVGSQNINNMRNVSQPNNFKIDNERKRALKFKTYNVTLADDIKLSEQFSFLGAITHTWVKQDSFANNDPANTSRDKVGSNTDKEFTYLAGLTYRPIDNTNVYLTYSNSVQVDGLVPPAYDAGRTLTYVAPIKTKQYELGVKSTIGTIDLSAALFQIERPLYYRVGTTTKFIKQGKQVNKGLEATAGGKLGEYVSVYGGFMLLDPKLKHTVNSYADNKYVVGAPKFQTNLLFDFAVPNTNKLSFMTNLHYTGKRYVDDRNTQSVDGYFTTDLGVRYATKTWFGKETTLRFNVNNLFDKKYYISVRPGESDGAGSGTTDLYTGDSRNFMASFEVKF

SEQ ID NO: 17422 - protein, 130 aa, Anabaena variabilis
MEATLTSLEKSAADFKQQTTPQINQAETLANTLSKEANAITQELSNNHFQRVGMIGTQTNNGALNGFGLQASYKQFFGKNKRWGLRYYGFFDYNHTYIKLGFFNSDSNVLTYGVGSDLLFNFINDKKPTF

SEQ ID NO: 17423 - protein, 358 aa, Moraxella catarrhalis
MKKLALATAVAALSVSAAQATPTVYGKAFLTIDANNTDTTYNSGLVQLSEDTNESGLNSNTSRIGFKGSEALNANTDVVYQLEYKIDIDADRGDNFKSRDTYLGLAHKQYGTLLAGRLTTIDDSVDFASMLEGNNVADIGPTFNAPRANNAFAYVSPEYNGTQFLAMYAFDSDTDKGGLAKDDQFGVGATYSTGPINAGATYIHYGDDSHIRLSGNYAVSPALTVGALYQISEFGVAAKNQKASPLSEGKVGDKKENTLIVSGEMKTATPWTAYGQATLIKNVAGNDGDESVGVGIGGKYAFNKATTGHVYTGYVNSERKNVKYEGSNETHKNAHKDTKFDGYKNSGFGIGAGLEYKF

SEQ ID NO: 17424 - protein, 323 aa, Moraxella catarrhalis
MKKLALALAVSATLAANSSVAATIYSGDGLTYKLKGDWQVQLRDDYKKSTDADVEFDDLELKNTVIYDLGNGLQAFGQLDYSFNSEADDTSSDSGHLEEAYLGVQYDNIKVKVGKTNTAGDEFGVEKAYETILEQDQFDVVKSSGDDLIRIEADFEAASVVFSHEISSDGNSSANGEATDLFVSTSFDAVSLAAAYQTHQANASSYDDDTWGLSASFDAGFAKFGADYSSTDYGNPATADADITNLVATFAANEQTKVALGYVMVDSDAANEDSDAWYANVTYKFPSQKNVSVFAEVSQADFENAADDAASEVDILAGMQIKF

SEQ ID NO: 17425 - protein, 573 aa, Xylella fastidiosa
SKPVFSCSSSVGSINSLSNGDDLSSRDVVTPVDTLTIEIDKDYVDTYIRVLSNKIQKIEELPGSSSRSEELNHIKEAMAYISNRIQDVEELDEKMLLAMNARLQEHDEKISSLLLEKYTGEEAAGLFLAQLLLQDMLVSDGKSESTLPAGDEEQEDTEVSRQLSSLPALASSNECALALSDDREKECLALGDGSEDKESYDSRFEEEEETIGQLSDSDGGNLKITEVDTAIPLEQEAKKEMQTQISENAPTLNQVKVVNTIVNNMIRNRLDASMNMSNNMVAVGAGDEEESHIKRGLWMRGMYGTNNHGRVDNMTGYRGTNIGATTGFDAEIDNNIVGIAYSNVHSVFKFKNSKNNDKELIHSHVVSIYGQKELPKNFTLQALVSASKNFIKDKTTYSYGDTKIRSNVKHRNHSYNAEALLHYNYLLQSKLIITPNIGLRYGKSRDGVYHETGINVQEIALTMKENNILSGIVGTKVTVPLKDALKFNNLGLTFQGAVEHNFKEKTQRINRVVKIFDNTFKHDYLIPKQPKTSYNLGTGIIGSIKNTTISLDYNYYLNKHYRSHQGSVKLKVN

SEQ ID NO: 17426 - protein, 227 aa, Xylella fastidiosa
SFAYSGNNDASDVSGVMNGSFYVSGSYSPSFPSISSFDISESDRGGSYVKGYNKNLSTLNVSDPISFTQNDPSFKFAKSLLTSFDGATGYAIGGARVEVEVGYKKFETLAESDYKHIESHNFVAVGRDATLTPDNFFVMKIDSVKDISVMLNACYDVMHTDLPVSPYMCAGLGASFINIADHVTSKLAYRGKVGVSYKLTPEISLIAGGFYHGIFDEQYAGIPASNR

SEQ ID NO: 17427 - protein, 384 aa, Xylella fastidiosa
  misc_feature (12)..(12): Xaa can be any naturally occurring amino acid
QQPVPNWLRPPXFVSDQAEAKGIVEDSSLNLLVRNYYFNRDNKDGARDQKDWTQGIWGNFSSGYTQGLIGVGVDAFGYLAVKLDGGDGTSGSGNMSRSDTVNADGSRDVNDSQGKAGGAVKVRISKTELKFGEMQPSTAPVFAVGGSRILPQTATGFQLQSSEVKDLDLEAGHFYSASSQDKNASDGGLFATYAGVEANSIDYFGGKYGITENLSASLYGAKLEDIWNQYYANLNYTIPFGGDESLNLDGNIYNTQDTGDAKAGEISNTAYSLAAAFSFMKAHTITLAFQKVNGDTPFDYIGVGKNNRGGDSIFLANSIQYSDFNAPGEKSAQVRYDLKMAEYGVPGLSFMTRYVKGWDIDGTKTPVGSPYAGLYGEDGKHNET

SEQ ID NO: 17428 - protein, 793 aa, Xylella fastidiosa
MNPFVSLTVASVTALFVASPAFGQEATQSTTLDTMIVTGTHVTERTVVESQSPIDIISAAHLAATGSSELATALSRMLPSLNFPRPALADGTSGIRPAQMRGLAPDQTLVLINGKRRHLSAQINVNGTIGRGSSAVDLNTIPITAIERIEVLRDGASAQYGSDAIAGVINIVLKGATQDGSLAVEHGQYSAGDGATSKLSGDSGISFANGRGTLHLAMDISQQEQTNRAGPYQGSAPNTGNYPDIGRTAFIYGDPRVNAVAFSANGMFDVGEHVKGYANAMLSNRDITSFAFYRSRNHNGQSMLLAQRYPEGYVPEIEQNSKDRSLVTGLKGSTEHGLNWDMSYNYGSNHIGFHTNNSINYSLGVESPRDFYDGALEYTQHLLNTDFTKVLDWGLTYPVTLSFGTEYRYEQWNQSPGIPASYNGMTGGAQGFAGFSPLNTVHANRNNYALYAGLDGDLSEHLSAGVAGRFEHYSDFGNQTSGKLSARYALTDQAALRATIGNGFRAPSLAQQRYQVVTSTYSNGTFYESGTFPTTSPVAQALGAAPLRAESSLSYSLGLVLQPFERLYLTLDTYQIDIAHRILLSSNLNDAAVLAALQQQGNSNVTSVRYFANAANTRTRGVDLVGTYTIPFAVGQLDLTTSYSGIATRIRSAVTQPAALSAIGSTQTIVGRDEIGRLEESFPKDKLILSGTWKLTQWDLMLAATRYGTVTVRNPTSVSRDQTYGARWVVDASASYKPDMHWMLTLGANNLLNAYPDKTVNAINSIYGQMPYSNYAPFGFNGAYVYARIGYSW

SEQ ID NO: 17429 - protein, 1029 aa, Xylella fastidiosa
MQKIKNKFIVRTILATTVTTVLSACGGGLVRIDTPTPTPTPTPTPTPTPTPTPTPTPTPTPTPTPTPTPTPTPTPTPTPTPTPTPTPTPTPTPTPTPTPTPTPTPTPTPTPTPTPTPTPTLPPLQPSLAAKIGRHLELTNTKAAHELGLTGSGFIIGMVDTGVHRNNIALQGKVIRNGVYNFYTDYHAPSAPDDIDNHGTLVAQLIAGKPVEHWPGGIAPGASIFSARVYPSDEEFEAYIEEQMASSHIMDTYEAEASKIKLINADMIAAGVRIQNNSWGHSSAGMWTDPKITNLFADTYRDFVIGNNGLVVFSTGNEKLSQPNGLARLPSLLTAEGSPSAADLEKGWLAVVGLDSFDHPDQLGSYSNHCGVAMYYCLAAPGNVIVINYNVTTSPIGNDGYEEQRGTSFSAPLVSGAAALVWEAYPYFTNDLVRQTLLGTATDLGAPGVDEVFGYGALNVGKAVRGPAKFDWGDVKVNFNDSRSTWFNDISGSGGLIKDGTGTLVLAGSANQYSGATQVLGGTLQVSSLGESAVSIAHSATLIGSGRFGGAVSNAGTLEIGTDGLKVQGDYTQSETGRLALNVGDQLSVAGHATLQGGELQVLGKRDYVSLNTSYSVLHADGGLSGTFSGLTWGPAVLLGEGQLHYGANDANVTLQRLDVNAAARALGIVDTVAQVSAQRVEQAFREIDIQQAQGHGRLSTSFMAAAAALQQSGSAQMVADSLRSLSGQAHLEVAAASFDVVDVGRRSLATRLGGRPMGERTVTWRQSLGGSGQDGTAGGTFALSGWLLGRDTQLASGDIVGFAFGQSEASPSGSVSGLRGLDRQVQGRMYVQRSQGPLYVLGQLGFGSFQRRLDRQLQLGHWSDWASSRYRGQFFSGSVEAGYHWRRGAWALTPYVGVDQTQLKTDGFREQGGAGFGLQVQASQAIRSQLLAGVRTELGWRGVKLRGYGEWQQTLRQSGLNPQASFTATSSWTPLVASPWSSRSGGLLGLSMVWPVEMTAGEWSMGVEHFFGARSRGDSFGLGYQLSF

SEQ ID NO: 17430 - protein, 851 aa, Xylella fastidiosa
MRGEMLIKPALLHRLCLAATVSVLISNQTVWAEVNTSQNKTPQLSKGVPILAQAPTTEILEVTGVKANPTEKGVEVILQTTSGEKLQLVNRSQGNAYIADIPNAQLRLPNGDTFTFTSPKPVEGISEIIVSNLDANTIRVTVTGEAGLPVVELFDSDEGLILGVLSAAPSQTQATPTPEPEQPAATTDQPIELVVTGQQDSYRVTNAATATKTDTPLRDIPQSIQVIPRQVIEDQRATQLNEALRNVSGVQPSNSAGRTRDRFVIRGFDDFNSVIRDGFKENTSVYRETANIERIEVLKGPASVLFGQLEPGGVINVITKQPQREPFLIMGLEAGSYGFFRPTVDFNSPLNDSKTLRLRVNAAVEISESFRDFDKETSRFFIAPVLAWEIGDRTSLVFDLEYLKDSRPFDRGLVALGDRVAEIPFNRILGEPFDSKEVEDLRIGTRFEHGFNDNWKLRSAFRIVSTQTSSFVTEPGSLDEATGLLSRDFGVDRPTPDETYAFQTDLIGKFKTGAIEHELVIGFDFNRQTNFVDDRRSAPAPAIDIFNPVYLTARPNIESDPFRGLFAADNIGIYIQDQIKLAENLKLLIGGRYDFTNQSFLSIVDGVKFFDISDQAFSPRIGIVYQPITPLSLYASYSRSFAQNFGIQRDNSRIEPERGTQYEVGVRGEFLDGKLIASLAGYQITKTNVATPDPADLNFSIPVGEVRSRGIEFDIAGELAKGWNIIASYAYTDAKITEDNTDNEGNRLNRVPENSASIWTTYELQSGALQGLGMGVGLFFVGERQGDLSNSFTVPGYTRTDAALFYRRDNWNIGLNFKNIFDVNYIESTTSRTSIDAGIPFTVIGSLSVKF

SEQ ID NO: 17431 - protein, 491 aa, Xylella fastidiosa
MNPFHHAPRRRAAHIHVLLLSMSALLWLPAAQAQYWSPGAQAGPHNVGTDGVFDEDEEPGPRPRPPLPKEDLEALEDLFGSGDTPPEPPPAPPSPGPMAPNVPEDASPHLPDHAGGDAMPPASPPAPPEARPKQPEARPEALPEAPPQAQPEAPPVVPPPAEPPAARPPAVPPARPAGDAVYLPGTRTLTPTANAAVGTASAAQGLWQAEMNALGKRMGELRLTPAAGGVWGRAFTQRQKLDNGVAREFRQTVGGFELGADTALAAAEGRWHVGAVAGYSQGSLKFRHGGTGDDDSVHVGAYATYIGNSGFYLDGIVRVSRFSHEFKVHDTQGRRVRGQYRGNGVGASLELGKRFTWPGAWYVEPQLEVAAFRAQGADYTASNGLRIKDDGTNSMLGRLGLHVGRQFDLGDGRVVQPYMKLSWLQEFDGKNTVRTNGVRHKNRLDGGRAELDLGVAAQLGKHGSLYGSYEYAKGSRQTMPWTFHIGYRYTW

SEQ ID NO: 17432 - protein, 799 aa, Xylella fastidiosa
MHKINTTLFKRSLLASAVAGALNTPLVQAQEESFALEEILVTASKRERSLQDTPISVSVTSQLAIEQSKIIDIADLQVLVPSLRVTSFTRVGSAVYAIRGFGNGGSSAGTEPAVGVFIDGVFRSRSSSSIGDLPRVSRIEVLSGPQSTLFGKNASAGVVSVITTPPSQEFEAKIEATLGNYNQRIVKGYVSGAVTDKLSMSFSGGMNQRDGFTESLSPGLKDLNDKDRYNLRAQALFEPNDSVSLRVIADYSDLDEICCTVGAVVNGPTADAIKALGGDVISTDDQFGYTSVLNLDPTNTIEDKGISFHADIDFENFTLTSISAIRNNESGPDLGECDYTSLDICKGTSHREIETFSQELRLTSNTDNALSWMVGASYFNEDITGEAETIYGDDLRNYVLALTGGPFSPLPTLEAIAGIPGEAFTAGWIVGGMIEQNNEAYSVFGTFDYQLTDSLTATLGLNYTNDEKEVELIQTSNPDVFSALDLDVVAGGAFAPFKGLQFRPPQLSIPNAVEDGKTDDSDTTWLARLSWEMNDNFNFYATASTGFKSSSWDLSNFAHPNINDAAAIAAAGIATPNQQYGNRFSSPEYATVYEIGMKSRFDNGSLNIAIFDQSIEDFHARTFDGVNFISSNAGELASQGVEFDILYAPTADWTFTLAGTYLDPVYEDYRNAPPPIGQSGAIDRSGERPGGIHTLSMTGSVVYNLTFDNGIDGYIRAEYQYERSSDLSDSFPGLSRQVNTANASAGLNFNNGFGAQLWIRNLNDDEYYTGAFAGVAQSGTVNSFLNQPQTYGVTVSYTF

SEQ ID NO: 17433 - protein, 806 aa, Xylella fastidiosa
MAAFLHLRQGALRMRFSSSCYALSLAVAAVLLAPDGRTQTVTPASGNQDATTLDAVIVSGTARFKGLAKRDASFSITTASPEQIQQAVPQSTADLLKIVPGVWAEPSGGGTGANIFVRGMPSEGDAPFVTMQLDGSPLFPPPTLSFLENSTLFRVDDTVERMEVLRGGSSPIFSNGQPGLTVNFIQKKGQDAPEGSVRLTGGNTALRRIDVFNSGPMGNGWYYSVGGFFRDTDGVRDPQFSADKGGQFSATLSKRWDSGELSLYARHTDDNNAFYTAIPLLSRNNGNALSSFPGLNAQTGTLLGRDFRTVDLLVGPNGQTLRRDLADGRGVDIDVFGGEWNWERGGWTVADRFNVMNGSAPTYALFTGDAPQRLGDFIAGYGSSGSASYTNGGGAVDANQQVLEAGWWSVDKRLNSLTNDLRLSRELFAGNTLTVGAYDAKYSSADTWYLGNTLLLTAQNNARRIDVALDDGRQPTRQGFTSTAFFNLRAKYNGENIAAFVADEWELSERLRLDLGARYECQSVTGDVHDTATVDLDGNPATLYDNATSLALATTRRIDQDDEAFSWTAGVNFTLDRNNSLFVRVNSGVKFPGFDNLRDGQNRVQDVDQYELGVKSGTSAYDLYLTAFYNTFKNSPFQAFLANGQNFTAVGDSRARGLEVEGAIRPLGGFELAGTGVWLDAKYRNYREFTGNQVMRQPKRQFRITPSYYWMLPFGDLKVFATYSYIGERFADLANSQRLPSYDMLELGANLHVGEHWEVTASGSNVTDTLGLTEGNVRVPGAATGGLFMGRPIAGRQYQMSVAYRW

SEQ ID NO: 17434 - protein, 398 aa, Xylella fastidiosa
MAIRRLRTIFVSLLLGLAASATQAADRSDRNVTAKLEGRFEWDFALFDNDTRGTPNRSNNEIRRFWLDVTGKVFAFDYTIEGNFTNLQDKFKGKSIEMGDVYLRHDFGNTGTLTLGQFKQHFSLDDRTSPDYGQFLERSGGANTLAPEYHKGVSWKATHQNTTWWVSAYSLDSISLSNVNGRGLGGRGTWSPDTPEGDVLHLGLSLAHQRYDHPGSDGMTALSIRPLPAGHLSDNSGITLAHFANGRDTKVNRWALEYAQVRGPLSWQSEYIGGAFNDGMQRATVQSAYGFVSWFVTGESRTYDRKTGRFTRIKTLHNPRGALELALRYDRMWGNQHHNNQPNFLNASTASCTLGVNWYIKPNLRLMLNLIDSRNRDRLAGTVLDHTRALTGRLHYDF

SEQ ID NO: 17435 - protein, 389 aa, Xylella fastidiosa
MRPIKFLFTLCLTSTASAAVAGDFNHWPLQYTFGNATEASLTGNFAYDYNNFSGDDRLKDRNFMRRKELGISIKKKDVYDAAVAFDFQSKLWLDVFFRFETKALFDQDYGRIRLGYMKTPVGMEALASSRAGSFMETALPVQSIYEGRRTGVEWVLERPQYLLQTGAYGGKDLQGDNPGTTQAIRAIWTPFKSTGDVLHLGVSYSQENPRGYHNGSNVSFSPRTRVRARPESGLTDVRLIDSGTLVDVDKIQRNGLEQLWIHGPLLVQSEALHIKVTRNNGLPTYNGNGQYIYGSWILTGESRPYTAGTVGNVTPMHDYGAVELLARYSRLNLDNGSILGGRQHDWTVGANWYLTNYFKFQANYVKVNATRLGTRTTPDIVELRAQVHF

SEQ ID NO: 17436 - protein, 681 aa, Xylella fastidiosa
MLVTHISILPRTVLFLAVSNLLLTPALAMADVGPPPTDSRHFKTTEVTRHLKDLDAVVVTAIPLRDSYSDLSRPVALLAGERLDEVRASSLGETVAVLPGVQSSNFGPGVGRPIIRGLDGPRIAVLNNGLSSQDVSTVSQDHSPAVEPFLANQIEVLKGPSTLLYGSGAIGGVVNIVDGRIAEAPVGGFNGRAEMRLDGGDKHGNTNMFRIDAGNGSALSVHADGVYRNEKDYDTPKGRQVNSFIDTKSGSMGASFSGDFGFFGLSVARFHDSYGNPGEPGDPVAGDRGSWLRLHQDRYDLKAGLTDPWGEASALRFSLGHTQYDHIEFEGNEVGTTFGKRASEGRVEASFAFGGGWRTAFGVQGGDSTFQALGEESFVPKTNNKSIGVFGLAHNTFGLFQAEFGARGDQVKYDTDNGVTRNYHPGSFSFSGDLALSKQWRLTLNVDHAERAPVEEELFAKGSHIATLAYEVGRADLKKEKANQAELGLVFRNDWSDAKVSTYYSRYGNFIYLVDTGSTWFWDDGQRDLPVRQWSQANAIFHGIEGEATFHLAKNTSGSWDLRVFGDAVRGRLKDGGNLPRIVPARYGAELRWEDVGWRISLGAKRYEKQNRVAVNETPTAGYTMVDAHLAYHIDVDNIAWEVFFDGNNLTNRDARVHTSFLKDDVMLAGRNYTVGLRMFF

SEQ ID NO: 17437 - protein, 730 aa, Xylella fastidiosa
MERKNHKKTTLATLISVLLMGGAGATYANSASISEKLDLATQHLDGAASTGEAISSDGKTIATSINNRTRAFLLSGDNWATKTELGSLKSDSSGTSIVRALSADGKIAAGISSVDSSSTQLHATIWSGDNWATKTTLGTLATNNGGDSVVYALSADGKVAAGQTAASTGTLHAVIWSGDNWATKTDLGTIRSDGAGDSMVKALSADGKIAVGSADSDIKTPVNGMYAGGVLTGPNSVRAIAWSGDNWATKTDLGTLRSDNLGAAVANAISADGKVIGGASHHYVTTEYYRSNDDQLATIWSGGNWATKTNLGSLRSDNSGASLVAALSADGSIAGGAALNDANATRAIIWSGRHWATKTDLGTLKSDNSGNSEVAALSPDGSVAVGTAAADSGSSHATVWKITYPAESTSTSDSTTNTPTPSQPSVVTVDADNTKKTLSRLGAETFSVMDLQRQGLTRLQQHCQIDAAGQSCWAVQTAISSIDGNRDKVAGIKLGHGFTETFSVGLSLDRSLSRSLPDSYLKNNGNLGAGLYAQWNTAFHGSQWYVRPAVAFNRYNVTVQRPVLENTEAGIGTSRMKGRGASLETGQTFKSDHGVLLGWHLGGRYNNVSRAEYSEQNAAFPTTYGKASFKRTSAYLGADATIPLTTNLKWMAAAEIDRALKNRDAVYSAQADYIGSFNHRAGIKGTIATLSSGLQYTISEKILLGLTLDVNQTAFGDIARGGTFTVGGHF

SEQ ID NO: 17438 - protein, 1041 aa, Xylella fastidiosa
MKTFSRYTPALNHLALALASTLLLIATYTANATAAESEHSTNEDSKAAPHDSKTTELDRVVITGSRIPRAGFDTLEPATVVNRQYIDSFGFTNVADALFSQPGFNSSASVRGNQAGFGAGVSFLGRFGLGSNRQLTLVNGRRLVTSNPPTVFGPGDGGTQVDLNVIPTSLIERTETIGVGGAPTYGSDAISGVTNIILKKNYEGAEVNIGYGLTERGDNARYSYSALLGSNFANSRGNVTIALDADDSAGVLGEARRYYRNGYSMQTNPNAAAIAQFQPGRQYATDGRVNPTIPFNTSNTDGIPGRVLIRNRRINNMTWGGLLYPSTGRYIRDASQQPRGFGPNQDQFLQFDKHGNLVSYNPGVNFGNSSSSGGDGLDLNQTTQVTSQLDRKSVFMLGNYDVTDNISSFFEGSYYTSKALELTDQSIYNAASFGTGNVNGSGDQSGALNFNIDNPFLSEQNRQALRNLGITDFRLSRASRDLVIGNSSTDTRLWRAVAGLNGHFDAGGHPFTWETSLNHGEGNFDYYRTGLIQQHFINAINVTRNSAGEIVCDSSAAGTTVDPNCVPLNLFGEGVASAAARNYVTTPTHAKAQMKQTVFNANLSGSFIDLPGGKLGFNVGYERRREEGRFTPDEYQRLGLGRTVPTTGSHGTFTTNEYFGEILAPLVNPDAHLPGLHRLDLTAKLRRVNNTVNGWFTAYTYGIQYEPFQGLQLRGNKTHSFRAPAIVELYTSQQPRYYSIPEPCTPANITAGNRPELRQRNCEAFFAYYNGVNPGTFQEAPTTQLGSVSGNPTLENELAKSWTAGIVFQPEWAHGLRVAADWYNIKISNVITQLDSGDITSGCFDNETFNRNDVPNANRFCSMITRDPSTGVASSVRGEYTNGPYINFRGWTAEINYRFDLKELRWGGSGILDLGFYGYFPKNLKYTAAQDIPAEESVGTIDNSKRQFQWNARYLTGPWNFGVSANYKSAALYSLTNTVETRDYLGIPSYTSYDANIGYTFDKHSSLNLAILNATDKMVAFPYVYDGLGRRYMLTFNYKFH

SEQ ID NO: 17439 - protein, 129 aa, Xylella fastidiosa
HNGSRDQGVLSLEYQHTPFWERGRLSARLAGAATVHNNGDFHLGAGVAGEYALDRNWFIEASVLPGLYIEGEDSNTLGSRFEVRSLFGVGYRFDNGNALSLAITHKSNASISDFNPGVNSVLLRFHRSF

SEQ ID NO: 17440 - protein, 884 aa, Xylella fastidiosa
MGTELDAVVDQNGLLSIKLKQINRNDNNMMKLSAVSAAVLPALLAVNSQGVNAAEDVAQDKIEKIAIVGSRVAGRSVEDLPVPVDILSAEALENTGQTEVGRMLQAIAPSFNFSSSSISDGTDALRPATLRGLGPDQTLVLINGKRRHQASIIHINTSVGRGTAGTDMNAIPASAIKRIEVLRDGAAAQYGSDAIAGVINIVLKDGSEGGKAAINYGEYSEGDGETVNVDFNKGFALGDNGYLNTTINYRDRAPTNRAGLHGSCQFYGCEELSDGTLLAGDPRELTADRNTFRIGDADSQQFGLTVNTGYELGDGELYGFITYSTRDNESAAFFRHNANAGGNPVLQDGDATIPLGFLPKINTTIDDISYNFGYKTEFDNDSSLDLSYTYGENSIDYTTSDTINASYANFLRYEQGLSAADIRTTIPREAYAYGMELSLQTINLDFTKNFDDYSLAMGAEMRTDEYRILAGNEYAYRDYDTNNGVSIYSGLSGGVGSENASGGTQGFGGSSPASSVDESRDVISFYLDAEAYVIEDVILSGALRYDNYKGFGDTVNFKLAGNWAITDDISLRGALSSGFRAPSMQQLYFNNISTQFVVGPNGTLVAEEVGTFRNDSTLAQSLGIPKLKEEKSQNRSLGIVYNVTDSINVTVDYYSIDIDDRIVISNRLGKGLSTSLDAALVSSGAGAGQFFLNGADTETSGIDFVATYNTEGFGGTLDFTLAANFTETEVVSLFTPSGSGLETVPVESVFSDQEISIIEEWQPEDRINLSALYQNEDWTVNLSLNRFGEYTVEDGGRQTYGAEILTDVKVNYFINENLSVNVGANNLFDVYPDKNEIGNSRTGTIVDANGNTVVSSNGVFEYSRRSAPFGFNGAYYYVGAEYRF

SEQ ID NO: 17441 - protein, 359 aa, Xylella fastidiosa
NDTGKSRVNETGLGFNALFQSGYTQGTIGVGVDVIRVLGVKLDSGKGRSGTGLFPTGADGRAQDDYSKGGGAVKFRISDTVLKIGDQYTTAPVFASDDSRLLPELPQGISITRNEIKGLKLEGGHFTSSVAQAQTYRDSLGLTKTDFIGGVYALTPEVSASLFYAKTEDYWKKTYANLNWTHALSNDQSLAVVFNIYSTKSDGAGLQRAEKDGTTKLDNRAYSLQGAYTIQAHTFTLAYQKVSGDGDYGYGVDGGGTVFLANSIARSDFNAEDEKSWQARYDLNMATFGVPGLSFMTRYVSGSGANTGTTSNGKEGKRDIEAFYLFQSGPAKDVSLCVRQATYRSSDQVYSGSGDELGL

SEQ ID NO: 17442 - protein, 190 aa, Xylella fastidiosa
MYVVMIIRKHFFIIATLITPWLVLPPVSAMDKGWFNTFTDNVVETWRQPEHYDLYVPAITWHARFAYDKEKTDRYNERPWGVGFGQSRWDDKGNWHGLYMMAFKDSFNKWEPIGGYGWEKTWRPLEDDHFRLGLGFTAGVTARDNWHYIPVPVLLPLASIGYGSATFQMTYIPGSYNNGNVYFAWMRFQF

SEQ ID NO: 17443 - protein, 193 aa, Xylella fastidiosa
MTAYGGLQCDTDFYLDGLLSYGLFKGDVVTLARGKTTTLKGKPLSASVTAGKAFMVGEEGFVLDPQVQAIYQHIQFDKARDIDDFEIELGKLDQWTMRVGGRLTKTFSATDEPRVVSLYGKLHLAHSFGKKQSVHFKDAFQLGAFGSFVETGLGFNARLSSNFTLHGDLSYQQKLTKAGFSGTSFSGGMRYQF

SEQ ID NO: 17444 - protein, 147 aa, Xylella fastidiosa
METLIAISRWLAKQHVVTWCVQQEGELWCANAFYLFDAQKVAFYILTEEKTRHAQMSGPQAAVAGTVNGQPKTVALIRGVQFKGEIRRLEGEESDLARKAYNRRFPVARMLSAPVWEIRLDEIKFTDNTLGFGKKMIWLRDSGTEQA

SEQ ID NO: 17445 - protein, 447 aa, Xylella fastidiosa
MIRRVFTLVNVTTLTLSITGVLYISNAHAAAFQLKENSAKALGRSFAGAASAQDDAAIIVNNPAGMRQLDGRQFQADLSTVRFSAEYRGNPGIYRNGNPIGGGNGGDAGMVALLPDSYFHMPFGDNNNVHLGATLNAPFGFSTKYDRNWTGRYHGIYSKLQAIDLGIAVSYDVNPYVSFGGAVFAERLNVNLSNAIDFGSILNARRVPSFSPGSADGYSHIEGHDTSMGFTLGGLFSPDEKTHIGFSYRSEVKHNANNGNAHFTVPENAAAVLAVAAPGTFINTKIKSTIRLPASATTSFTHAIDDRWSIMAEVTRTAWSKLDKITIHFASSQPKNVLNFSYRDTTFVALGTEYRFNDMLTLRGGLAYDQTPTTAEYRSVRVPDNSRTWISFGMTWKPSKQTDYNIGYAHLFIGHPTITQISATGSTLAGAYNINADLLATSINYKF

SEQ ID NO: 17446 - protein, 349 aa, Xylella fastidiosa
MIRQSGIRFVAVGGLSLLVALPAVAQPLDWPELYGRLHLSADVLNNGDGTSRHLSDNSSRLGLRGQVLLDDDRLRAVYQVEIQAALNEDDSSDELTLRNTFAGLEGPWGLLRAGRIDTPVKRMRSNVDPFSDSVGDARNILRLNTAAYDDRDLRVNFDRRLKNSLNYTTPRYQGLGAQLHYSADAEGDGSASDNDDEAWSAMLDYERDATWVGLGYERYRAGETPTIWRVAASQGLGDWRLTGLYQSTRDPDSWALGGSVTYAFGVNRLLAQVYTVDARDGDDLDATMYALGAERFLADSVRVYLRLAWLDNDDEGDLTPYRQSRSADPEMDTPGEDPYGVSVGLRIDF

SEQ ID NO: 17447 - protein, 395 aa, Xylella fastidiosa
MKKSAVLGLGCTIAAACAMPSLVHAQGSVTLYGLIDEGFSMYTNVAGKHQYLLNSGVMQGSRWGLKGAEDLGGGYKTVFRLESGFDASTGKLSQGGLGFGRQAYVGLESPYGTVTLGRQYDSVVDNLGPLEAGDQWGGYIAAHPGDIDNFNNQFRTNNAIKYTSKAFAGFRFGGMYSLGGVAGDVTRNQVYSFGGQYANGPLVVAAAYLNARNANAGFFGNSTSGTVNPSISNLPSPVYNGYGSAHTYQVIGTGAAYTFGAATIGGTYSNIKFYNLGQSYPSAFRGQTAGFNNFEVNFKYQFTPALLVGVAYDYLRAGSINGFSAAKYNQGSAGVDYFLSKRTDVYVTGVYQHASGYAANSAGTAMVPAVAAINGLTGSSGPNQFTARVGIRHLF

SEQ ID NO: 17448 - protein, 682 aa, Xylella fastidiosa
QRKIYYETRSKQASKQKFKKSFIVSLFFSILYTSPLLAVDYVYDKTKLTNDEITRLKKLRDKTSEYWKKETYLITEDNPKVPPFPALYPRTYQFENINNSKKISFYDQEYTEGYLVGFARGLGVAKRNGDTEEQIRKYFKECFNSNTKIRDYSTCQAEKFGSHPLIVKSHIFSLGPKIKNSHINSEILSVGNYTEWANQVIHHIENYVSFAAHLYSGLDPFHYIEVTDNSHVIGQTISLDEFRLENSLWEPRWDSNVGKLKTTNADIRFNTKSESLLVKEDYAGGARFRFAYDPKEAKNTALIFEKNVTGTSDIIFENPIDDLKSLDGHQIIKVNGTADKHAFRLSGKHQKGIYTLSLQQRPEGFLPKCKNAMIWRFMHNRLKPPIPYCALRLNNKNSDIFDRTLPRKGLWLRVIDGHSNQWVQGKTAPVEGYRKGVQLGGEVFTWQNESNQLSIGLMGGQAEQRSTFHNPDTDNLTTGNVKGFGAGVYATWHQLQDKQTGAYADSWMQYQRFRHRINTEDGTERFTSKGITASIEAGYNALLAEHFTKKGNSLRVYLQPQAQLTYLGVNGKFSDSENAHVNLLGSRQLQTRVGVQAKAQFSLYKNIAIEPFAAVNALYHNKPFGVEMDGERRVINNKTAIESQLGVAVKIKSHLTLQATFNRQTGKHHQAKQGALNLQWTF

SEQ ID NO: 17449 - protein, 849 aa, Xylella fastidiosa
MYNGYTYDNGTTIADTNWYDGDVFTLNISNSTIDDDYEALYFTDSYLSGDDGTTTKTTNESFYTALGVAVNLNVESNINIANNSRVAGIALSQGDTTNTAYTSEYHQWDNNISVSNSTVTSGSEIPLEDDYDGAEYFFGNSAEPSDYNGDSSVNDVALSFSDNPDSNYSMKNNVYFDHSTLLGDVEFSSHWNNDGEFFYSTGYDSNGDGVKDTNGGWIDDGQNVDELNITLDNGSKWIGSANITADAIAPVNMYDVAYNSLTPGATIEANDWDRVIDNKVFQSGVFNVALNNGSEWDTVNTSVIDTLAVNNGSQVNVTDSTLVSDTIGLTNGSSMNIGEDGQVATDHLTIDSYSTVALNDDVTHYGDYSLYANTITVTNGGMLDVNVDQFDNGVFSTDKLELTSGNTADHNGNVVSGVFNIHSSDYVLNADLVNDRTWDTTQANYGYGTIAMNSDGHLTINGNGDINNGDELDNSSVDNVVAATGNYKVRIDNATGAGSVADYKGNELIYVNDVNTDATFSAANKADLGAYTYQAKQEGNTVVLEQMELTDYANMALSIPSANTNIWNLEQDTVGTRLTNARHGLADNGGAWVSYFGGNFNGDNGTINYDQDVNGIMVGVDTKVDGNNAKWIVGAAAGFAKGDLSDRTGQVDQDSQSAYIYSSARFANNIFVDGNLSYSHFNNDLSANMSDGTYVDGNTSSDAWGFGLKLGYDLKLGDAGYVTPYGSVSGLFQSGDDYQLSNDMKVDGQSYDSMRYEIGVDAGYTFTYSEDQALTPYFKLAYVYDDSNNDADVNGDSIDNGVEGSAVRVGLGTQFSFTKNFSAYTDANYLGGGDVDQDWSANVGVKYTW

SEQ ID NO: 17450 - protein, 927 aa, Xylella fastidiosa
MTHVAIDSHRYIPRNLLCASISGVLLVAAVSVQAQETNAASNLERITVTGSNIPRTDTETASPVQIVTREDIARSGRATVAEYLQTLTSDGQGSIPKNFGNGFAMGGSGISLRGLGAGSTLVLINGRRIASYGLADDGQKLFADLSSIPMDAVERVEVLKDGASSIYGSDAIAGVVNIILRNDFQGALVSASYGLSGYRDGHTPKATMTVGVGNLASDGWNALVSVDVGKSDGIMTSDRKDRKWIGTGDTRPWGYDLANNQQFLRGAITGKGTIADSSPVGAVRNPSNSQFSSLPGCSKFSSISPQDPGGGCLWDAAQFRSLTPDEKYANVFTRGTFTLFDTTELYTELSYSKKKSEFSNLPSPVSGAWGSPGGAVNASSGDGATVLAPGHPDNPYNVPARLRYAAFDVGPRVKENTNDFMRVVLGIKGSVASWDYDVSVLHSQSQMDRKFTGYLRYSSVRCVLGNLACPAGVWNIGNGSETNPRSLYDFISPVLSAQAKTKLDVFDARVSRALADLSGGAMGLAMGVEYRRDQASLTPMTYTDIGDIIGAGYSAYSGEEKVSAAYAELAAPFTKAFEATVAGRVDHYSSGNTAITPKLGVKWKPFDWFALRGTYAQGFRAPNTAESGKGGLAAFAGITDPVRCAAAGGSGAECAPRLVSVITSPNPDLKPEKSNSYTLGMVFQPTSSTSMTVDGWQIKRTKEIAQIGTVDAINAGYVIRDDNLLKGVAGTGQLLGVKAKYVNLNATTARGVDTDVQHRIAIGGLGDLILDLQWSRMLKFQREEANGNISEYAGTHGNCDVSNCIGTPKDRINFGATWKLNNISVSALGHYRGPMENRLFKGGACVSHFADGSDAPNHCRLNAFTSVDLSANWQATEALAVFGSVQNLFDRIAPLDPLTGGALNYNPLDSAGAVGRFFTVGARYAFK

SEQ ID NO: 17451 - protein, 998 aa, Xylella fastidiosa
MERKHFTKTKLASSLSLILGVSGIMPAMAADDTSQDKNIEVIQVSGIRGSLIKSMDLKRGSEGIVDAINAEDIGKFPDSNLAESLQRITGVSIDRQNGEGSRVSVRGFGADQNLVLLNNRQMPVTTGSRSFDFANIASEAISAVEVEKTAQASNPTGGIGATINVLTHRPLSSPGLKASFGAKAVDDSSTDKGSVTPELSGLYSNTFADDKFGISISGSYQERESGNQQAQVGTGWRSFPGIVDQDWAGSNAEWGGVPKDANQINRPGDDDVYSVPQTTVYRFEEQQRKRTNGQLVLQYQPTDSIRTTLDYTYMRNDVDTQFHDVSAWFNFVPTQESTWSDGPVSSPLVYSELYDAPADLSMAAGDYGTRDQSGSLGLNIDWEVSENLSLALDYHDSYAERTPNSPNGSSSLLSTAAFVRTSAATDFTGDVPVLAVGGGNAVRPEDMRVTGSVFTNAINRSEIEQLQISGSYDLEEAGTIDFGIAMTDVNNHSQSVNVQRNDWGGVGSEGDLDAAWFPQDTVLDKLDGSQGDFSDYQGSAATDPLNTIFLWDFEAVRARAAELYASSAVGDCGNGFCPSTDYASDTDRFTQEESQSAYIQYNYAGDLGDMPFDVHVGLRYEKTDVTSTSAVSAYDTATWIAETEIALSSSAADNRVFQTQTGDYDYLLPSVNFNIEVVEDIYVRMAFSETIGRPDYTSIQGGTTVGTLANRGGGSGEAGNPSLLPLESTNYDISTEWYYDEGSYVSVGYFRKDVTNFISSNPENSNLYNIPDPSNGQYVQEAIAAGASTAIEQRQWIFDNYGSTDPNVSINPANGNIEIAGNPGDPDLNFLITKPTNSDLSNVIDGWEFAIQHFFGESGFGVQANYTLVNAGDSYNNANLGRPGDPSQNVINGISDTANLVGIYENYGFTARIAYNWRDEFLNSQGQGTGANPQYTEAYSQVDFNIGYDVPMVEGLTVFIEGLNITDENTRVHGRANEQVLNYTQTGARYSLGARYTF

SEQ ID NO: 17452 - protein, 1083 aa, Xylella fastidiosa
MKLKFNGFLVLLLVLVAQLSFAQERAVSGTVSDNAGMPLPGVSVLVKGTKAGTQTDFDGKYSIKASSSQVLVFSYIGMKTQEIAATSSTVNVKLAGDAQELESVVVTTALGVKREKKSLGYATQEVKGGDLRNGTSSGNFLNELSGKVAGVNITRNSNFGGSTSAISRGVKAIGQSNEMLIVIDGMPINNGNNTNDGTTAQSSGGRGFDYGNNAMDINPEDIESVNVLKGATASALYGYLAGNGVLMITTKKGKAKRGLGITVSSEVVTGSPDKSTFVKYQKDYGAGYGGSFGEQDIDGDGIPDLVVAMGDDASVGDAFDPTLNVYQWDAFSLYPGNNNYGKATPWKAAANDPFKFFKNSLSLVNSISFEDGNEKTNVVFNYTNTKQTGILPNSELRKNNFSLKLNHQFTDRLSLSTFANFSAQETLGRNMTGYSANLISGFRQWWQTNVDIKELERAYNNSGGENITWNRKSVANGAPAYWNNPYFERYQNYQNDSRNRFIGYANFTYKIADWLSATAKVSTDTYAEIREERVAVGSVAKTFGINALDETSGYQRYNGNFSEQNYNLLLNFKHNFGENVSLTGVAGGTIRNTYFNQITASTQGGLIIPGIYSLSNSRAASPYPYERETKTSVNSYYASASLGFLDTYFIDATARRDAFSNLPADDNSLISSSVSGSWVFSKNIDASWLSFGKLRGGYSESPLGTPALALVDTYTKYDPFNNNQMYSVNSIKNNPDLRPIKTNTTEVGLEMQFLNRRIGFDVSLYKNINDGEAVRVPYSTATGYTSKYVNAAKIENKGIEVQFNVTPVKTNNFAWDINVNWSKNENMVTALADGVSNLQISSFPGTVTLNAVVGQPFGVLKGTDYTYTADGQRVINPATGRYVINTSTNNIIGNINPDWIGGIRNKFTYKSLSFSFLIDTKHGGDIFSTDQWYGVGTGLTNETAGNNDLGIPKRNTLVNGGGVILEGVYADGTPNTTRTAYSTGGAITNAYTNGPRSQYVYDAGFIKLREVNITYSLPSSLVQKMKLVDAKISLIGSNLWIIQKNIPDADPESGLGSNVGSQGLSIGSLPTTRNIGCNLTIKF

SEQ ID NO: 17453 - protein, 728 aa, Xylella fastidiosa
MTSNASPLRSAVSAIALASAFAAAPLAAQDETDDDQRASQQADDDFHNRSRDLPPEIVVTAAGLTQLDVLAGTSVLEGFELQRSLDGTLGDTLVKIPGVSSTGFAPGSSRPVLRGLQGERVRVLIDGLGAIDVSNTSVDHAVTIDVLTAERIDILRGPAVLLYGSSAIGGAVNVIDKRIPRRIPDEKIHIDGLVRGDTALDTREFGASLDAPLGSMFVFHVDGSYRNTNDLEIAGFQIAPDLRADLLADADEEEEEGEFEEADEMREAANQTGFVPNSATETWTANAGLTFFSGDSNLGFAVGWYDTRYGVPGNPEGGHHHGEGEEGEEEEGEGGEGGEEIVSIDLRQFRADLRGELDLGDGFFDTLITRAGFSDYTHTEFEGDEVGTVFDVQGFEARAELAQTRRNGWGGNTGVQFYLRDFVAFGAEAYVPKNTTTQFAVFTLQEFDLGGVQLEVAGRYETTDIESTTVGIERKFDTFSGALSLSRETESGLRFGVNVSRAERAPSAEELLSNGPHIATQAFEIGDPDLSVESAWGVEAYLRGRIGPATISLAAYRNWFDDFIYLQDTGLEEDELPVFVYLQQGATYTGFEGEIEFPLIDSGPFRLTTDLHVEYVDADLDDGSSVPRTPPLSLLGALEADWEQFNIRGEVQWFDDQDSVSAFETPTDGFTFVNASIAWRPIRGDNNVTLLLQAENIFDVTGRRHASFTKDFVPLAGRNIKGSVRFSF

SEQ ID NO: 17454 - protein, 1041 aa, Xylella fastidiosa
MKTFSKYTPALNHLALALASTLLLIATYTANATAAESEHSTNEDSKAAPHDSKTTELDRVVITGSRIPRAGFDTLEPATVVNRQYIDSFGFTNVADALFSQPGFNSSASVRGNQAGFGAGVSFLGRFGLGSNRQLTLVNGRRLVTSNPPTVFGPGDGGTQVDLNVIPTSLIERTETIGVGGAPTYGSDAISGVTNIILKKNYEGAEVNIGYGLTERGDNARYNYSALLGSNFANHRGNVTIALNADDNAGVLGEARRYYRNGYSMQTNPNAAAIAQFQPGRQYATDGRVNPNIPFNTSNTDGIPGSVLIRNRRINNMTWGGLLYPSTGRYIRDASQQPRGFGPNQDQFLQFDKHGNLVSYNPGVNFGNSSSSGGDGLDLNQTTQVTSQLDRKSVFMLGNYDITDNISSFFEGSYYTSKALELTDQSIYNAASFGTGNVNGSGDQSGALNFNIDNPFLSEQNRQALRNLGITDFRLSRASRDLVIGNSSTDTRLWRAVAGLDGHFDAGGHPFTWETSLNHGEGNFDYYNTGLIQQHFINAINVTRNSAGEIVCDSSAAGTTVDPNCVPLNLFGESVASAAARNYVTTPTHAKAQMKQTVFNANLSGSFIDLPGGKLGFNVGYERRREEGRFTPDEYQRLGLGRTVPTTGSRGTFTTNEYFGEILAPLVNPDAHLPGLHRLDLTAKLRRVNNTVNGWFTAYTYGLQYEPFQGLQLRGNKTRSFRAPSIVELYTSQQPRYYSIPEPCTPANITAGNRPELRQRNCEAFFAYYNGVNPGTFQEAPTTQLGSVSGNPTLENELAKSWTAGIVFQPEWAHGLRVAADWYNIKISNVITQLDSGDITSGCFDNETFNRNDVPNANRFCSMITRDPSTGVASSVRGEYTNGPYINFRGWTAEINYRFDLKELRWGGSGILDLGFYGYFPKNLKYTAAQDIPAEESVGTIDNSKRQFQWNARYLTGPWNFGVSANYKSAALYSLTNTVETRDYLGIPSYTSYDANIGYTFDKHSSLNLAILNATDKMVAFPYVYDGLGRRYMLTFNYKFH

SEQ ID NO: 17455 - protein, 779 aa, Xylella fastidiosa
MIVMCCHNSTSTDHVSLRPPMPFIKSRKHLITATASSRHLTAAALLSSFSFVAQAQAIPITTLDKIDIQAEQLKRYSADKPTYGKYTQPLIDTTQTINIIGKTLFNEQGATSLTEALRNSPGVGTFYVGENGTTSRGDSVYMRGFDSSSSIYVDGIRDLGSITRDVFNLEQIEVTKGPSGPDYGRTSPTGAINLITKQPFLHNANTASISYGTASQRRITSDLNLIVSPDSAFRLNIMGQDSGVPGRNNVKNKRWGLAPSAAFGLGTSTRVFVNLQYINQNNIPDGGVLTIGLPGYSTPDSTRTQISTAPRVDSKNFYGTGSDFEHVKSSMTTVRIEHDINDKTKLQNTLRWGRNEQSYLLTSYRGNVENLITPDLADPSTWTMNREIPIFKNQTNTILTNHTNLNRTLKTGPIEHNIATGMELTRERMQGYGISSSGRWPAANLYHPDPDVSGLHWAANGAYANGRTDTTAFYLFDTLKLNQHWQLNGGLRWDRYNTDYAALLCDPVRSRIYCNTTPITLNRFNGKTSGTLFGWKTGILFKPTEHSSLYINYAVSQQPPGGSSLDLSAKPQDANNPKYQTQAARTAEAGVKWNSSQEGLQLTAAIYNTQVKNDIVQDPIDLQYYQNGKKRVRGVELSAIGQITDAWSMSAGFTTMDAKVKQGPAVSADGSLTLAYTPSQAFTAWSTYTLPFGLTIGGGARYVGEMKRDSKTAIGTPTYIESYWVLDMVLSYRLNKNLDLRLNSYNLLDKNYVAAINKSGYRYTPGTPRAFLLTANFHL

SEQ ID NO: 17456 - protein, 970 aa, Xylella fastidiosa
MKTIFAARTILASALAAALSACGDPLVRSETPTTPTTPTTPTTPTTPTTPTTPTTPTTPTTPTPLPDLDPALAAKFRAHLDVTNTEPAHTLGFTGKGYMIGVVDSGVNPDHVTLQGRVIRNNVYVDYQDPSSPHDVDGHGTTVAQLAAGRPFGDFPGGIAPGATIFSARVFSSAAESAKEDPIGGNFFEGEAALLKRVNADMIAAGVRIQNNSWGYESDDSNGEPIWTSPIITGLFVNAYRDLVLNNNGLMIFASGNEKQTQPGRLSRLPSLPTVEGGASPADLERGWLVVAALDSFDHPDQLASYSNHCGIAMHYCLAAPGDVITVNSSVTNSSSVSDKYYVGQGGTSFAAPLVSGAAALVWEAFPYFSNDLVRQTLLGTATDLGAPGVDEVFGYGALNVGKAVLGPAKFDWGDVQVSFDDRRSTWGNDITGSGGLIKRGTGTLVLGGSNNQYTGATQVLGGTLQASSLGASAVSVANTATLIGSGRFGGAVSNAGTLELGKDGLKVQGDYTQLETGRLALYVGDQLSVAGNATLKGGELQVLGKRDYVTFNTSYSVLQADGSLTGTFSQLTWGPAVLLGEGRLTYGANNAYVTLQRLNVSAAAQALGIVDRVAQASAQRVEQAFRAIDAQQAQGRGALPTSFIGAAAALQQSSSAAVAAGSLQSLSGQSHVAAAAASLDAIDLGRRSLATRLDVLRSGERIVTWHQALGGPGHNGAASGTFSLSGWLVGHDAQLASGDIVGVAFGQADSSPSGSASGLRGIDRQVQGRVYLQRTQGPLYVLGQLGFGSFQRRLDRQLQLGDWNDWTSSRYSGQFWSGSVEAGYHWRQGSLALTPYLGLDQTQLRTDGFREQSGSGFGLQVQSAQATRSQLLAGVRTEWRWGGVQWRGYGEWQQTLRQSGLNPQASFTATSSWTPLVASSWPGRSGGVLGLSMVLPVGVTAGLWTMGLEHYFGTRSRGESLGLRYQLGF

SEQ ID NO: 17457 - protein, 389 aa, Xylella fastidiosa
MRPIKFLFTLCLTSTASAAVAGDFNHWPLQYTFGNATEASLTGNFAYDYNNFSGDDRLKDRNFMRRKELGISIKKKDVYDAAVAFDFQSKLWLDVFFRFETKVLFDQDYGRIRLGYMKTPVGMEALASSRAGSFMETALPVQSIYEGRRTGVEWVLERPQYLLQTGAYGGKDLQGDNPGTTQAIRAIWTPFKTTGDVLHLGVSYSQENPRGYHNGSNVSFSPRTRVRARPESGLTDVRLIDSGTLVDVDKIQRNGLEQLWIHGPLLVQSEALHIKVTRNNGLPTYNGNGQYIYGSWILTGESRPYTAGTVGNVTPMHDYGAVELLARYSRLNLDNGSILGGRQHDWTIGANWYLTNYFKFQANYVKVNATRLGTRTTPDIVELRAQLHF

SEQ ID NO: 17458 - protein, 970 aa, Xylella fastidiosa
MKNMKTAFFPGSILVLTLVAFLSACGGSGLVRPPTPTPTPTPTPTPTPTPTPTPTPTPTPLPVLDPALAAKFRVHLDVTNTEPAHTLGFTGKGYMVGVVDSGVNRNHVTLHDQVIHNNVYVDYQDPASPDDVSGHGTNVAQLIAGQPVEYWPGGIAPGATIFSARVFSSAAESAKESPIGGNFFEGEAAQLKRVNADMIAAGVRIQNNSWGYENQNTGDKQVWIDPAVTDGFVNVYRDLVLNNNVLVIFASGNYSQQQPGRLSRLPSLPTVEGGASPADLERGWLVVAALDSFDHPDQLTSYSNHCGIAMHYCLAAPGDLIEIDTNVTTSPVDGDKGYLNGYLIQNGTSFAAPLVSGAAALVWEAFPYFSNDLVRQTLLGTATDLGAPGVDEVFGYGALNVGKAVLGPAKFDWGDVQVSFDDRRSTWGNDITGSGGLIKRGTGTLVLGGSNNQYTGATQVLGGTLQASSLGASAVSVANTATLIGSGRFGGAVSNAGTLELGKDGLKVQGDYTQLETGRLALYVGDQLSVAGNATLKGGELQVLGKRDYVTFNTSYSVLQADGSLTGTFSQLTWGPAVLLGEGRLTYGTNNAYVTLQRLNVSAAAQALGIVDRVAQASAQRVEHAFRAIDAQQAQGGGALPTSFIGAAAALQQSSSAAVAAASLQSLSGQSHVAAAAASLDAIDLGRRSLATRLDAPRSGERIVTWHQALGGPGHNGAASGTFSLSGWLVGHDAQLASGDIVGVAFGQADSSPSGSASGLRGIDRQVQGRVYLQRTQGPLYVLGQLGFGSFQRRLDRQLQLGDWNDWTSSRYSGQFWSGSVEAGYHWRQGSLALTPYLGLDQTQLRTDGFREQSGSGFGLQVQSAQATRSQLLAGVRTEWRWGGVQWRGYGEWQQTLRQSGLNPQASFTATSSWTPLVASSWPGRSGGVLGLSMVLPVGVTAGLWTMGLEHYFGTRSRGESLGLRYQLGF

SEQ ID NO: 17459 - protein, 928 aa, Xylella fastidiosa Dixon
MTHVAIDSHRYIPRNLLCASISGVLLVAAVSVQAQETNAASNLERITVTGSNIPRTDTETASPVQIVTREDIARSGRATVGEYLQTLTSDGQGSIPKNFGNGFAMGGSGISLRGLGAGSTLVLINGRRIASYGLADDGQKLFADLSSIPMDAVERVEVLKDGASSIYGSDAIAGVVNIILRNDFQGALVSASYGLSGYRDGHTPKATMTAGVGNLASDGWNALVSVDVGKSDGIMTSDRKDRKWIGTGDTRPWGYDLANSQQFLRGAITGKGTIADSSPVGAVRNPSNNQFSSLPGCSNFSSVSPQDPGGGCLWDVAQFRSLTPDEKYANVFTRGTFTLFDTTELYTELSYSKKKSEFSNFPSFVSGAWGYPGGAVNASSGDGATVLAAGHPDNPYNGPARVRYAAFDVGPRVKENTNDFMRVVLGIKGSVASWDYDVSALHSQSQMDRKFTGYLRYSSVRCVLGNLACPAGVWNIGNGSETNPRSLYDFISPVLSAQAKTKLDVFDARVSRALADLSGGAMGLAMGVEYRRDQASLTPVTYTDIGDIIGVGYSAYGGEEKVSAAYAELAAPFTKAFEATVAGRVDHYSSGNTAITPKLGMKWKPFEWFALRGTYAQGFRAPNVAESGKGGGLAAFANVSDPVRCAATGGSGAECAPRFVSVITSPNPDLKPEKSNSYTLGMVFQPTSSTSMTVDGWQIKRTKEIAQIGTVDAINAGDVIRDDNLLKGVAGTGQLLGVKAKYVNLNATTARGVDTDVQQRIAMGGLGDLILDLQWSRMLKFQREDANGNISEYAGTHGNCDVSNCIGTPKDRINFGATWKLNNISVSALGHYRSPMENRLFKGGACVSHFADGSDAPIDCRLNAFTSVDLSANWQATEALAVFGSVQNLFDRIAPLDPLTGGALNYNPLDSAGAVGRFFTVGARYAFK

SEQ ID NO: 17460 - protein, 209 aa, Xylella fastidiosa Dixon
MAGGFANDRLYGAALQYQRGGLTVGASYPTMNRARSADAAGAVTGDNTFDASSQQNLGIGATYAFSKALIGFAYSHVDVYDPTSNAYFTGTTRPAGGHWQSWKFDHFEINGRYRVTPAFYAGAAYTYTQARVDSTADAFHPKWRPLSTKLDYDLSKRSSGFAEGVYQHAQHAMNARTGTGFDHAYIPGAANIASGPNQYVVRLALLHPF

SEQ ID NO: 17461 - protein, 965 aa, Xylella fastidiosa Dixon
MQKIKNKFIVRTILATTVTTVLSACGGGLVRIDTPTPTPTPTPTPTPTPTPTPTPTLPPLQPSLAAKIGRHLELTNTKAAHELGLTGSGFIIGMVDTGVHRNNIALQGKVIRNGVYNFYTDYHAPSAPDDIDNHGTLVAQLIAGKPVEHWPGGIAPGASIFSARVYPSDEEFEAYIEEQMASSHIMDTYEAEASKIKLINADMIAAGVRIQNNSWGHSSAGMWTDPKITNLFADTYRDFVIGNNGLVVFSTGNEKLSQPNGLARLPSLLTAEGSPSAADLEKGWLAVVGLDSFDHPDQLGSYSNHCGVAMYYCLAAPGNVIVINYNVTTSPIGNDGYEEQRGTSFSAPLVSGAAALVWEAYPYFTNDLVRQTLLGTATDLGAPGVDEVFGYGALNVGKAVRGPAKFDWGDVKVNFNDSRSTWFNDISGSGGLIKDGTGTLVLAGSANQYSGATQVLGGTLQVSSLGESAVSIAHSATLIGSGRFGGAVSNAGTLEIGTDGLKVQGDYTQSETGRLALNVGDQLSVAGHATLQGGELQVLDKRDYVSLNTSYSVLHADGGLSGTFSGLTWGPAVLLGEGQLHYGANDANVTLQRLDVNTAARALGIVDTVAQVSAQQVEQAFREIDIQQAQGHGRLSTSFMAAAAALQQSGSAQMVADSLRSLSGQAHLEVAAASFDVVDVGRRSLATRLGERPMGERTVTWRQSLGGSGQDGTAGGTFALSGWLLGRDTQLASGDIVGFAFGQSEASPSGSVSGLRGLDRQVQGRMYVQRSQGPLYVLGQLGFGSFQRRLDRQLQLGHWSDWASSRYRGQFFSGSVEAGYHWRRGAWALTPYVGVDQTQLKTDGFREQGGAGFGLQVQASQAIRSQLLAGVRTELGWRGVKLRGYGEWQQTLRQSGLNPQASFTATSSWTPLVAPPSSSRSGGLLGLSMVWPVGMTPGQWNMGVEHFFGARSRGDSFGLGYQLSF

SEQ ID NO: 17462 - protein, 1023 aa, Xylella fastidiosa Dixon
SGTVTDTQGMPLPGVNVLVEGTQRGTQTDFDGNFSLQAAEGETLIFSYLGMKSISQVVGTESTYSITMEEDSAELDAVVVVGYGTQKQSDLTGAVSSVSSDELLTQPVSNVFQALQGKAAGVDITSSERPGTVGSVRIRGNRSLTASNAPLYVVDGVPLLSASSIETINPRDIESINVLKDASATAVYGSRGANGVIIVTTKKGKTGRFALNYSGTVTTSNIVDRAPAMSAADFIEFRRWAAYNLDPNTYAHPDSPTLANDTNIFDSPLDGQTSRDNVLQGWQNGSFDASRVQNTDWTDYVTQTGVLSEHTLSASGGTEKINAYGSVGYTNNKGTQKGQFYERYTANLSANINATEWFEFAANFNLSWSEQDYGFSTLGGRSGSVPNAIYGAAKNIYNIAVPYDANGNLVINPGGENTIYTIIGEENKSTQLSQTLRALGSLSATFDIGEIYEPLEGLEYLVRFGPDFRHFREGVYIDGSSSHRINSDGSLGTNYARLNNRRDLSWTLDNQINYSTSFGEKHNLDLTLLQTASSWNIESSGMSGNNIPKASMLWNNFGAIDLTNSENNVSIGSNLNERQLSSYMVRANYGFNSKYLLTVSGRWDGASQLGEGNKWDFFSSAALAWRLDQEDFLASADWVDNLKLRLGYGTTGNSAVSPYATKGDIISIFLPFNGLSNQIGYTTNEPYYSRSQLSLANPNLGWEKTTQYNLGIDFGLFQNRLSGSLNVYRSYTSDLLMSVNIPTLTGFPSTIANIGKTNNRGFEVSLNAIPIASSEGFQWESDLNVAWQRDEIEELAYGENDMVDNNWFIGESIGVIYGYDNAGIWQDTPEDQAEMAAWNENGYDFTPGNVRPVDQNGDYVMNADDRVILGNTAPRWTLGWNNSFSYKGFELSTLIISRLGYQANIGGEPMTARSNQREVDYWTPDNTDSRFQKPILGQATSGSQDEFSGLLGIRDAGFIKIRNISLGYNFTPEQSEKMGLNNLRVYVQAVNPGSIYQGAAWYDFDTNSTIFNRSFAVGLDIGL

SEQ ID NO: 17463 - protein, 1003 aa, Xylella fastidiosa Dixon
MKTFSKRALLRASAAPAILGASLIASAAIAQDAPQAAEAPAAGDTIVVTGSLIRNPNLQSNPVLTTTADTIELKQNNTAEDILREIPGIVPSIGSAVNNGNGGASFVNLRGLGSNRNLVLIDGDRLVPAELNGRFDLNNVPVALVERVDVLTGGASTTYGADAISGVVNFVTKSDFSGLEANISNQITEEGDGNYFRADLTMGANFDDGRGNVVFAVGYQQSDPVYQGGRDFSFDNVDSYSGLAGGSGTATPSRFTNVNVTGTDNGNGTRQITADGTAFRPTSAFDAFNFNPYNIFQTPFERFNMFGAAKYEVSDAVEVYSRGIFSKNTVNTIIAPSGAFGIAVDVPLSNPYLTAAQRNAFCARDTNPAAGVYTPLFTQAQCDAAALATDPNDPNYQTVSTAFSRRSVELGPRVSDFTTTFFDYKIGARGGITDTINWDVTGAYGESENIQTQQGYWLNSRVRQALLATNTETCLDDSNGCVPLNAFGGNGSITDSMNAFLNANSQIVTKTSLAQVKGLINGDFGWTVPWATDAVAFALGGEYRKYTASQESDLLSQSGDLGGAGGAAPNITGGYDVYEAYGELVLPIVQDRPFFEELVVQGGVRYSKYSIDAAGSPGYETWTWNAGGTWSPVRALKIRGNYARAVRAPNIAELFAPNNTGLTNLAVDPCAGNAPLNNANLAAVCTAQGGGAFLGLIENDPAGQVNATSGGNLALSPEKSNSWKIGAVFQPDFLPGFSATVDYYNIKVTGAITTPTPGDAISACFDNLSASSATSDACTSIQRNPATGNLFGESTTTPGLFLGLSNLGTLKTDGVDFSVNYGRDIGFAKLSLSLTGNWTGSSKFQASPTSLNRECTGYYSVNCASIQPEWQFSQRTTLGFETFDISLLWRYIDSVSYEPAAYDDDLAAAIGFGCEDPEGADPDGCVVNPEFRKIPAEHYFDLTGRFHVSDNITLTLTAQNMFNNKPKVVGSTLGSTAYNSGNVYPSTYDALGRRYAAAVKFRF

SEQ ID NO: 17464 - protein, 212 aa, Polaromonas naphthalenivorans
MMIKEAISLAGLGMLMLSTAYAEDSRWSYRIGATNVAFDASAKVSIDGTRVPGGSADASDNNALTFDFGYIINDNWNARLIVGIPPTTKVTGAGTLPPILLGRVQYAPAVLSATYNLPQMGLVRPYVGAGINYTRILKSKDANLTSFDADHAWALVLHIGAEANINRDWFVSFDIRKLYLKTDASGFLGPQVATARVTLNPLLTSIAIGRRF

SEQ ID NO: 17465 - protein, 144 aa, Haemophilus influenzae
SEADYNAVPIFARFGFNMNSVFGMKESKSTLQLALEPFCNPVTEPDSGVETGLNVFIRYLQPVAPSVKLVGEIGSGPMYLSINSAEQGKAGFNFLNQFGLGAQVAVSPKSAITVGYRFRHLSNAGTSEPNRGINSNAVVVSYSL

SEQ ID NO: 17466 - protein, 617 aa, Thiobacillus denitrificans
MQLSKHPIRSLMAAAIALAALPAMAGENPYSKAVFFGDSLTDAGYFRPLLPEATQGLSGQFTTNPGWVWSQQVANYYGLNKDPNGNGQNGDNYAVGGARVSVEGSGALGAIPSLKSQAARYLAANGGKADRNALYTVWGGANDLFAAAGAAGAGAPPAQVQGIIGAAVTDQIALVGALKQAGAQYVLVPNLPDVGITPQFRGPNAAAATAMSVGYNKALYGGLKQAGIEFIPLDTFSILREVTANPGMYGFTNVTGTACKINPANTTGSIIGCNPTTYVSPDAYQTYLFADGVHPTVTGHQLLGQYAVSVLEAPRLQQVLSHSAQTIGRSRADQVSNHLGARPADGLSWWGGVRGDLQRYDHADLYDGLAPAGLFGIDWARNGVVVGGFAGFGRLNADFGNSRGDFTQKDTTAGLFAAWYGDRVWVNGQVSYTWLSYDVNRKVQLGPATREHGGSPDGSNLTAALNAGYEFGTEGGFRHGPVAAVIWQKVKIDGYSESAAAGTLATALGYDRQNVDSTVGRIGWQARFDGGTVKPYVQVTYDHEFEDTKQASAWLQTLPELGSYRVPGLDFDKNYATAVLGARMDLFGLQGNVGLSTTAAQKRARDASIFATVSGSF

SEQ ID NO: 17467 - protein, 520 aa, Thiobacillus denitrificans
MRQSNLSFQIFMHHLVKALLIFLITVFTICIAKSITPEKGKYPQAEDIHKEDEEDEEEIADNGLLDAVSNMNLDISGIGKAREGLRKDITEISKLLYMLEQSTASSKNLTMRLQQANTRENEQSNYTGLLITEIESINKENDYLQQKNNQLKIKLQQLEVKVEQALARNTDLRQILLKPQAEMDNLRKQNEQLKMQLQQLQLKLQNLISLQDKDSNLAPINGIKLNYINDVKCIALANTVIVKALACTFTDKLSKSNRIKNHCHITSSGSNIDKYWNVWAEPSFINTYQQEYGKIQKHSSIVNGILVGVNKYLNDRIAIGIIASYLKLDAQYASNILKKTKCRVYSLYLGSRYYFQKNIFTQGIIGFANYDGKNKYQHIYKQPSAKIDNISYYGNLMIGYHFTNQRQLNLEPSIGISCIYFDMKSYKPSNDKILESIIGATIKYPIIYNISNATEIVTELSGFINYNILDNYDYMYKTYYQLGAKININYDMIRLAISYNVYLTEKHIAHAGTIHIGTNF

SEQ ID NO: 17468 - protein, 843 aa, Thiobacillus denitrificans
MHSPSSTAGPRASLRATALAALAVSTSLLLHALPVQAAEPAASAAARSYQIQPGPLGPALMAFAAQAGVNLGMDLQQLGGMETRGLSGTFSVEDGFAQLLNTSGWTARRVGAGNYALEKLPAAARQAPSTAAAVPSPSAPAAAPAAAQATELAAITVTARTQNNLVAPSRQVTILEGQEVEQLRQGSDSLATMLSKVVPGMADSSHTITDYGQTLRGRNMLVLVDGVPLNTNRDSSRNLANINPADIEQIEVLRGSSAIYGSGAAGGIVSIRTKRPSGETRAETIVTGSAPLSRLRGAGLGGEVQHYLSGGGEVVDYSVSLGAKHMGGAFDAKGNRIAPEPSQGDLFDSSIYNASAKIGFKLDADQRLQLTASHYNAAQDTDYASDPAVARLPAGTAAARPIKGLVLADQNQIRNTMLGLDYENRDIAGSTLAAQLYYRDFFTRFAPFDARAVPVRGANVDQSMQNSEVFGGRLTLKTPLGASKKSLLIWGADFHQERTDMPIDIFDPRAYDASGGLVFNKTGRLVYMPPVTTRSIGAFAQLQHQFSDQWSAEGGLRYDRAQASFNDFTPLSQSRVPNPQSVNGGTVQYNAWTYNLGTVFTPVKGQEFYASYSQGFELPDIGVVVRNATPAFNLGNSNLQAVKTNTYEMGWRGKFSNVMANLSVFQSRSNLGAVQSFNNGLSLLRTREKIHGLEGGLDYFSDDDHWSAGGSFTWMKGRELPQAASGYQDMTGFRIPPLKLTAYVEYRPDARWSHRLQATSYAAKDYRLDGKTGFGRYDTRGYTTVDLISQWKIDPKNRVSLGVENLFNRQYFPLYSQLLRSNNNTSRLPAAGTVLKISYAHTW

SEQ ID NO: 17469 - protein, 802 aa, Thiobacillus denitrificans
MSLCDGGTLSRTMKDIAGRKDRAGAVTACRSRWKTGRKKVGFESHSVKIARGKRFVLLAATALAGIGGPAFAQATTASADSGSDEIIVTALKRSTNLQDTPISISAVTGEAIANSGVQSIADLNSSVPSLAFVDGGPSNRRVVIRGIQAAGEPTVGTYYDETPVTGAIGAANDAGGSTPELRLFDVERVEVLRGPQGTLYGSGSMGGTLRVIYQKPTFATEGAVDLSLSDTRYGGLNYEGSAMVNVPVVNDKIAVRAVGFYRNANGFIDNTALNIKNINDQKSYGGRFLVRFTPTEALTIDAAAYINRSRTDTNAWTLTSGKFKSDALTRQPVRDNLELYSLTANYDFGGVVLTGVVSYLDRDLDSVSDVSRFIRSTRTPAGCAARVSAGQPCSTAQLDNYYALVDSQSTSALFPQQTMKSWTAELRLSSDGSGPLNWTVGGFYSDRDTSVANPQSNADPVSGAIIEPQQIATVRFIDDSLRQVAAFGEFSYDVTDRLNLTAGGRYFRYNKDISGQTTIGSILVGAVVRPLSFVKSKEDGTVFKFNGSYKVTDNVLFYAEAAQGFRPGGANQVIGLAQELTPYKSDSLWNYEVGFKNTLFDRKLLLNVDVFQIDWSDMQITGRTPNGAFSFITNAGKARVRGAELEATIRPTAGFTITGNASYIDAKLRENQSNANVSAPGLKGDRIPYVPKFSAGIGAQYVWALTDTLSGFARIDGNTVGGSYSDFRPTGTFTRKIDSYQLVNARLGVEGPDNKWGAYLFVTNLLDDTAITRSQSSAIAVGRTLVNSAAPRTIGVNVRTRF

SEQ ID NO: 17470 - protein, 364 aa, Thiobacillus denitrificans
MKLHPLALSLLLAAPAVASAQSVTLYGVVDTGVEYVNHIGTAGSSVVRMPNLSGTVPSRWGLRGTEDLGGGTKTLFALESGFATDTGASNQGGRLFGRQAWVGLSNDNWGQISFGRQYTMLFWATLDTDLLGPNAYGSSSLDSYLPNARADNAIAYKGKFGGLTVGATYSFGRDTVNAGPSPSGTNCAGENPADSLACREWSAMLMYETGRWGVSAAYDSLRGGPGAFAGLTSSSLKDDRLALGGYALVGSAKVGLGWIARRNEALTASRSNLFYAGVAYDLTPALTLTGEAFYLKYRNSADKAWLGAVRASYALSKRSSVYATVGYLENGGNLALSVSSAATGASPAAGGSQLGAMVGVKHVF

SEQ ID NO: 17471 - protein, 1055 aa, Thiobacillus denitrificans
MNKKKNYIKRTALPMAMLLSAVAVSPLFGEKAYAAVEATQQQGTIKGTVVDSNGEPVIGANVIIEGTSTGTITDIDGVFMINAKPGTKLTISFIGYESVTVPAKANMRVTLSDNSTMLGEVQVVAYGVQKKVSVTGAISSVGSEELLRTPVSSVTNVLGGQMTGLTTVQYSGEPGADAADILVRGKATFGDSSPLIQVDGVERSMTDLDPNEIESVTVLKDASATAVFGIRGANGVILITTKRGKEGKPKISFSTSASVLQPTKMVEQANSYQYATFYNQLMANDGQDPVFSDAIIEKFRTHSDPIRFPDTRWADYIMKNSALQSQHNMSVSGGTDKVRYFISAGAYTQGGLFNSFDLPYDVSYSYKRFNYRANFDINVTKSTLLSFNVAGNVDNNSKPHTSQGTSGMIKNMYYATPFSSPGIVDGKFITTATDYDDERLPFTGGTGMAYYGAGFDKTSNNKLTADLILDQKLDFITKGLSVKLKGSYNSGFVVTKTGTGGAVATYTPVLQEDGSLAYRKSGENTDVSYSYSTGKSRDWYMEASLNYARSFGDHNVTALLLYNQSKEYYYGGSGSQYRDIPRGYVGLVGRITYDWKSRYMAEFNIGYNGSENFAPERRFGTFPAGSIGWIMSEEKWFQPLKPWVSFFKLRASVGLVGNDKPSDASLRFLYLADPYQVNNSSLPNRNGGYGYSFGIENSTASLGAIESSKNNADVGWETALKQNYGVDMNFFDDRLRTSVDYYKEHRKDILLIDGTAPGLLGFTVPYANLGEVKSWGWELSLNWNDKIGDNFRYWATFNLSYNQNEILEDKQAPQSYDYQYTKGHRIGARSQYVFFRYYDEQTPELYEQTFNRPYPEQIQTLRDGDAVYVDLNGDRKIDANDMSYDYGYTDDPEYMAGVTLGFSWKNWEVNTQWTGAWNVSRMISDVFRQPFYSSSDASQGGLLAYHLDNTWTEENPSQSAKYPRATFTNRDNNYATSTLYEQDSKYLRLKTLQVAYNFNLPIMKKLGLNTFQLAFSGYNLWTLTPYMWGDPETRASNAPSYPLSKTYTLSLKLGF

SEQ ID NO: 17472 - protein, 837 aa, Thiobacillus denitrificans
MKTKIFPLNKIAFACSLLLANPLAWAGDQFDASLWGDGSVLGVDFARFNVKNAVLPGRYEAQIYVKFEEKGVSDIIFADNPATGRTELCFTPKLQEMLDLMDEAIVKSPNSEDDTCVFASDAIPKGTFEYQSGEMKLKLELPQALTIRRPRGYIAPSRWQTGTNAAFANYDINYYRSGNPEVKSESLYVGLRSGVNFGNWALRHSGSFSRFENQSSSGFTDKGKNHYERGDTYLQRDFALLRGNVTVGDFFSTARIGENFGMRGLRIASDDRMLAPSQRGFAPVVRGVANTNAKVSIKQNGYTIYQITVPAGPFVINDLYASGYSGDLTVEIQESDGKVRSFIVPFSNLAPLMRVGHLRYQLAGGRYRIDSRTFDERVLQGVLQYGLTNHLTLNSSLLYTRHYRAGLFGFGLNTPIGAFSADATWSHAEFPLKHVSKNGYSLHGSYSINFNESGTNITLAAYRYSSRDFYTLSDTIGLNRTFRQFSGAYLPEIYRPKNQFQVSLSQSLGNWGNLYLSGQTYNYWEKRGTNTQYQVAYSNSFHILNYSVNLSQSIDKETGKRDNSIYLSLSLPLGDNHSADSSYSRSGNDINQRLGVNGSFGERHQWSYGINASRNNQGYRSYDGNLSHNNSIGSYRASYSRDSLKNRSISLGASGAVVAHKHGITLSQPVGESFAIIHAKDAAGAKVESGANVSLDYFGNAVMPYTSPYEINYIGINPSDAEANVEFEATERQIIPRANSISLVDFRTGKNTMVLFNLTLPNGEPVPMASTAQDSEGAFVGDVVQGGVLFANKLTQPKGELIVKWGERESEQCRFQYQVDLDNAQIQSHDIQCKTAK

SEQ ID NO: 17473 - protein, 251 aa, Thiobacillus denitrificans
MKDIHFKKALLTLSILFACPAHALELKTSYGSINAGYANWNTGFENTHRGEVWKATADFGAIFDKGEFYSFYESNVLNHAVEGRNHVLSAQTHIRLFDSDFSFMGKLYGQFENTWGDELNMMYGLGYLGWSGPSGFFKPYVALHNLSNDYVSIKYGQATGLNGYVVGWTSAWFFDLWGEKMVLSDWNEFELDRNDAYAEQQHSKNGINGGLTLTWKFYPHFKASTTWRYFDNKLGYDGFGDQLIYMLGYDF

SEQ ID NO: 17474 - protein, 143 aa, Thiobacillus denitrificans
SAKDTAALKVGFRWHQDETMQLGGLTLSHYYHFGYNYWQSLDVDGQEGVNNALEFIPVFRFSDGEQDFFSYVETAVGVSVFSRTQFNDKEFSTNFQFANSLAFGGYFTPRVSWSLQLQHYSNNSIKLPNNGINFYNFNIAYRY

SEQ ID NO: 17475 - protein, 721 aa, Thiobacillus denitrificans
MSRFPAAPSPAEAALCGCIVAFCAHAAPARAGDPVVTLPSLSIEATDLPSLADSPLSASSPGASDRAAAQLGSPDAVALFHDTPGFSAYSAGGISSLPVLNGMADDRVATVVDGVRISAGCPNHMNPAMSYIDPDSVQTATAIAGITPVSLGGDSTAGTVDVERRDPQFARKGQVLVTGHVTGNYRSNGGGSGASGTVTLADDTFSLRYTASYAHAGDYHAGGDGGVVRSTDYLTFNHAVTLGMHKGNHLLALTAGQQDTPYEGFPNQYMDMTNNRSTYVNGKYDGSFDWGDLEVRGYWQRVDHVMDMLGDKGGHSPTTGMPMNTDSRMAGYTLKATIPLGPRDTLRLGSSFDHDGLNDWWPPLQGSMMMGPGTFHNVNNGHRDRLGHYAEWEARWTPRLSTLLGFRNDLVMMNTGPVSPYSWTGMMAAADATAARAFNAMDRGRTDVNFDVTALTRWQALDSLTIEGGYARKTRSPNLYERYAWGRGAMATKMIGWFGDGNGYVGNPNLTPEIANTASITIDWHDPHGQAWDLKIQPYYTYTHHYVNVVRLAQYSNGTSRLEFVNHDAQSYGINASGSYRLWNTVRYGQGDLVGTVDWVRGQDLVTRSGLYHQMPANGMVGVHETVGNWTGRVEMTFVKSKDTVDRLRNEPRTPGYALLGLGGSYRWRYLALNAGIDNVMNQKYYLPLGGLSLGDYDATGVLGPLKGMGRSFNVSLTGSF

SEQ ID NO: 17476 - protein, 230 aa, Thiobacillus denitrificans
MRKLLVAMSALMLATALNGVSATAEAADMPAGKPFYKAPVVEAWNPWMIRLRALGVVTRDSGTVNGIAGSDLATSDVVVPELDISYFFTRNIAAELILGVTKNHVTGAGSLAGVDVGKSWLLPPTLTLQYHFTDFGAFKPYVGAGVNYTFFFSQSAAGGTVTDSHLKDTAAPVVQVGFDYMINNHWGFNVDVKKLWLRPDWNGTLAGGVPVSGKVNLDPWLIGTGITYKF

SEQ ID NO: 17477 - protein, 661 aa, Thiobacillus denitrificans
MKLTRTLVLASTSLLATVATSQAQEVKRDTKKQGEVVLKPITIISHGKDNIEATGGTVLTYKDIEKLQPANVSELFSRQSSIAVSGGGGPSKRIHVLGMEQSNLAVSVDGVPQTATSWHHTGSNVIDPAFLKRVEVEAGAAAADSGFGAAAGAIRYETVNALDLLEPGKTFGARIIGSYGTNGRGFSGSTAAYGLKDGFDWLLMLHGTSGHNYKNGDGTEILGTEPAARNILGKAGYEFDGNRIDIGYERSRDKADRLIKMNMGLPGDTEYPLEVARDSVNIKYTRTDATDMWDPEVQFYYNRNDYWRNDYQNRTNGNMILKEDLYGGKLQNTFTIDYGKITAGIDFGKHDYNTDNYGHNDRRYRKFNTQQVGAFTQGRFEFDNGFSLSTGARYDYSRFADWNDEVFSDSGASVNGTLSYKFNEHIEVFAGASRTWLGYVLGDYGYVHARNNAFYTDPTFSPGRARNYKAGVNFGGADWSAGITLFDTRIAGLPNYDSQKLGNDPEEYRSRGFTLNARYIWNYTTIGATFTKAKVTAGDDPVLPNSGSFMPIGDMATLFIDQEIPDYNMKVGATLAWAGRISDEAATAANFYDQPAYTVVNAYAEWNPPAVKNMTLRVGVENLFNENYYERTSFAPSQKRGGIDPVWAPGRTFTFQTAFKF

SEQ ID NO: 17478 - protein, 229 aa, Thiobacillus denitrificans
MKKKLLALVAVLLATGAWSSTGYSAGNYVSANAGISWFGDAKLTDNADDEENFCVDLDSGIALTGAYGHDYGDYRIEAELGYQRNDIAKSIDYLYGSVYDEYSMTGNMSVISLMGNAYYDINLTDDLELFLTAGAGAAFVSFNDVGDVDDDFRYDKVTATAFAYQLGAGLSYKVAENLRLEARYRYFATADFTIDDTANFWDDYAEDDYMNTVKNISSSSVMLGLRLSL

SEQ ID NO: 17479 - protein, 707 aa, Thiobacillus denitrificans
MKFRLMLPAAVLAALSPAGQAQTQERSVDGAGATLAPIRVDAQKAPALTQPLDTGSHLGLSPLETPASVEQINRATLDTRGDSSIIDAVSRAAGISASPHPGNGNSELAARGFVGASSVTQLYDGVRPYGAIGVTFPFDTWSVDHIDVLRGPASVIYGEGAIGGVVNIVPKKPTRTPIRNELQVGGGTEGTARAAFGSGGAINDKLSYRFDISGNRSSNWVDRGDSRNLSVSGVLRYDVTPDLYVTASYTQGFMHPMQYFGVPLVNGARNRALDKKNYNVGDADIAFRDSWATVSANWQPSDSLNVTSTLYRMKSNRHWKDAEYYTYLPSSAQVRRSSYTEIFHDQEQYGNVTTATVGGALLGMRNTFSAGVEFNHTTFQHDNNSPYAGTSTVDPFNFDPGSFINTAGTFPKYRSQSNQYALFAENRLEITPRWSVIGGLRYDHASVNRDDLVNGGAFTKVFANTGWRIGTVYDVRPGLAVYGQYSVAADPVSSLLSLNASKANFTLATGRQIEIGVKQSFLDGKAEWTLAAYRIVKSNLLTADPVNPNQSIQVGQQSSRGLEATVGAEIAKDWRVDANVSILRAKYDDFQQSSGGTTVSRAGNVPVSVPQRLANLWVSWRFAPDWTGIAGVKYVGKRFADTANQLVMPSYTTVDLGLAWKPRKDTTITARAYNVFNRRYVQSAYYNETQYLLGNDRRIEVLANYRF

SEQ ID NO: 17480 - protein, 161 aa, Thiobacillus denitrificans
MKYDTSELCDIYQEDVNVVEPLFSNFGGRASFGGQIITVKCFEDNGLLYDLLEQNGRGRVLVVDGGGSVRRALVDAELARLAVQNEWEGLVIYGAVRQVDDLEELDIGIQAMAAIPVGAAGEGIGESDVRVNFGGVTFFSGDHLYADNTGIILSEDPLDIE

SEQ ID NO: 17481 - protein, 661 aa, Thiobacillus denitrificans
MKFTRTLVLVSTSLLATVATSQAQEVKRDTKKQGEVVLKPITIISHGKDNIEATGGTVLTYKDIEKLQPANVSELFSRQSSIAVSGGGGPSKRIHVLGMEQSNLAVSVDGVPQTATSWHHTGSNVIDPAFLKRVEVEAGAAAADSGFGAAAGAIRYETVNALDLLEPGKTFGARIIGSYGTNGRGFSGSTAAYGLKDGFDWLLMLHGTSGHNYKNGDGTEILGTEPAARNILGKAGYEFDGNRIDIGYERSRDKADRLIKMNMGLPGDTEYPLEVARDSVNIKYTRTDATDMWDPEVQFYYNRNDYWRNDYQNRTNGNMILKEDLYGGKLQNTFTIDYGKITAGIDFGKHDYNTDNYGHNDRRYRKFNTQQVGAFTQGRFEFDNGFSLSTGARYDYSRFADWNDEVFSDSGASVNGTLSYKFNEHIEVFAGASRTWLGYVLGDYGYVHARNNAFYTDPTFSPGRARNYKAGVNFGGADWSAGITLFDTRIAGLPNYDSQKLGNDPEEYRSRGFTLNARYIWNYTTIGATFTKAKVTAGDDPVLPNSGSFMPIGDMATLFIDQEIPDYNMKVGATLAWAGRISDEAATAANFYDQPAYTVVNAYAEWNPPAVKNMTLRVGVENLFNENYYERTSFAPSQNRGGIDAVWAPGRTFTFQTAFKF

SEQ ID NO: 17482 - protein, 325 aa, Thiobacillus denitrificans
MKKSLIALAVAASFVGIAQAENTTTLYGALSAETAFSDSKNNDKDNKWDLSYGSSKFGIKGTEDLSNGLQAIYKMEFNFDAENGVNGTRYGYVGLKGDFGTLTLGKTDSLYGDLTTYNDIFENGFFDDENANYSAIRGGSRISKQIRYDSPDMSGLHFGIAGILDGSHTVATHLKKDDSKSFVGFQTGAWYEQNGLYASLAYSSLDGDWIAKTNQGSTEVIGANIGYENDQFRVGLGAEHAASLGEKYNLAGAYYLGPNTFRAGFAVSDSDEYNAGETAYTYALGYQYNFSKRTFTYIDGTYIDHGDNEKADDGYTVNLGLRHDF

SEQ ID NO: 17483 - protein, 1061 aa, Thiobacillus denitrificans
MDSTPEDTSMRRTLNSFKSKAMFTFVGGLLVVNPAFAQDVAPPPAPAPQSSSASATTLDAVNVTAIRNSLNQSMGIKRDAAGVVDAISAEDIGKFPDTNLAESLQRITGISIERRDGEGAQVTARGFGPQFNTVTLNGRLIPGADAFGAPGQTPIGGVDVGTRAFNFAQLASEAITGIEVFKTSRATAPSGGIGATINIQTDKPFNHDGVVANAGAKMVSDRSEPFGDALTPEVSGIFSYTNPEKTFGIGLSASYQKRHGGSVQATENAWNIQRWTGTDPALRPDAVVTNAPAIGQLYGMPNDLRYAFADFQRERMNGQAVMQFAPTDSLTLTLDYTYSANEIREERGEQGIWLQRANSFTDLTFDTGQAVATPVYLRDVPNGAKDFGMEQQRNEQKYTLGSLGFNADWQVSDRFQLSFDAHNSKTQSLPNDPTTGGSATYFSFAGTNNCTNGPYCGGQWGQELWFNNSLPIGARTWYPTAADSLANTNGVVNPAFTPAELGSQVLRIFYQKQVTETKEGRLDGKFDFDDGRFQFGVSSTNTTMQRRISDTNSPLGDWGVANAGNEPGMVALLQPVSITGMFKDFNPTGAASSAWRGDADQLALWGGRQYGATTRYNPQYTADNRVEEKTRAAYVQLEIAGAIAGMTTNTRLGLRYERTDVESTSQVATPTALLWLSNNDFELIRSTDQQPFSEGTSYNYILPNMDFSIDFTDQLKGRASFGQTIARAPYNTLIAGPTPNTPNGSILINPSNRAGGGSQTPTLNPLESDNLDLALEWYFADASYISATFWNKRVSNFIGNTVTRESLYGLTDPTSGPDAQSALAFLQSGACAAQVRAAGNDVASACSANDTSLFAAMALLRNAAATGGLNAYNGSSAQSLALENAYDIAGNASDPLYQFDVSRPINQNKANIHGWELGGQYFFGSTGFGIYANYTIVQGDVAFDNTVIDRDQFALLGLSDTANVMLMYEKYGWSARLAWNWRDEYLIAANQDNANRNPYYVEPYQQFDLSVSYAFNKQLSVGFEAINLTGEDVRWHGRSEKQIIRLIDQQPRYTLGVRYAF

SEQ ID NO: 17484 - protein, 731 aa, Thiobacillus denitrificans
MRGGRSGRMLLAAGTVLTGVPGTVLSARAQEAATLEEISVTSVSPIQGRPAAPAAPSPAVPFARAAEVLPVVTNTFSPVTVVPQERIARDQPRTLGDALFDRPGISASTYAPGAASRPIIRGLDNARVRIQENGIVNGGVSDLGEDHAVPVNPLNASRIEVIRGPATLRYGSGAIGGVVSAENNQVPTFIPARGITGQVTTGYTTVDNGRLGAASVDAGANGIAVHADGFATATDSYAIPGGIQRNSATETQGGSVGISAIGDRGFLGISYSHFNALYQIPGGEAAEARTRLNPNQDRVLARGEYRPLEGPFEVLRFWAGGSVYRHEEIGFGHAHHDHGDDDDHAHEGPAGEGVQAIFKNREVEARFEAQHVPVFTALGTLTGAVGVQTSRRVLNSQLESFLPPTESRVLAAYLFEELAVGGGLRFQAAGRIEGDRLNSIATQFPGSYLPTDGDPLSYALTRRFAPKSLSFGALQDLPYGFVASLNGSYVERAPTGAELFSQGPHHASATFEIGDPTLRLERARTAEISLRRADGPLRLDATGYVTRYTGFIYRRDTGNRCDDDFGSCGSGDELRQVVYSQANASFYGAEIGAQLDLFAVGDGWAGIEAQYDFVRAQFDDGSYVPRIPPHRLGGGAFVRANGWFARVNLLHAFDHTEIAPFETTTPGWNDLRAELAYTQALDPTVYGATEVTLGLQGRNLLDDDIRNSASFKKDEILLPGRNLRLFLTARF

SEQ ID NO: 17485 - protein, 156 aa, Nitrobacter winogradskyi
MRFSRFSLPLSAALLMGTCLPLAAEQSGITASLDAGVLNIKATEKFYSGSHKNSQLDWKTTNAMALRGSLGFELSPDWRIKTEGRIGFAGDGFMTDYDWLSPFYRDTSKNGWSHRSEHGDTRLDHYLTGSIELNRTLLEDPLQHLSAGVGFRYTDV

SEQ ID NO: 17486 - protein, 748 aa, Nitrobacter winogradskyi
MRSFVLFCLAAAALHGQSAEIQGTVVDARGGEPLSNVSVQLVGFAFRATSDSTGNFRISAIPAGDYVLNVSTVGYHLVKKPFHLEAAGTQEFEIILSPETFRQRDSVEVQASPFEPSRQDSPSTLVLGGNDAKNLASVLADDPLRSVQGLPGVSSNNDFDARFSLRGADFSRVGLYLDNVLLHAPFHMLQGQQVSGSATAFNGDMVEELELHEGAFPVRFEDRSAGVLDVHTRDGNRSATGFRIAASASNAGAMAEGPLGKKKRGSWLVGARKSYLQYIFQRTFPDTSFIFGFEDAQGRLTYDLTPKNNLTLYVLESYSALNRDITPNLGVNSLTTAGYHYTLGNLGWRYSPTSKLMIVNHLAWMREKYDNSSPAKLPLGAGFYGEWVWNAAATWMWNKQTPLDIGWSLRRLRSNGTSFQYQVNAPLPRLLDHSDGTAVREGGYAQQSWMPWTGRLHFTAGVRWDNQSIDHVAAVSPEASASLALASGTRIQLGFGQYVQYPEITLLTSPLGSRNLLPIRSNQWLAAFEQRLGARTRLRAEVYDRVDRDLPFQPLYDPRLLNGKLVVPPANPHYLNSLRGYSRGFEIFLQRSSANRATGWVSYAFGRTAMRDGITTNRFPSDYDQRHTVNVYGGYRIKPTINLSVKSSYGSGFPIPGYLQQIGALYYLTNVRNQLRMRSYLRTDVRLNKSWTKDKWKLTLFGEVINLTNRTNYIYDSFNGYNTKTFQAFLTLDTMFPILPSAGIVFER

SEQ ID NO: 17487 - protein, 283 aa, Nitrobacter winogradskyi
MRSVKLLLAAAAASLLSSAAFAADLPIAPPPYYAPPVVGFGGWYLRGDIGFSNQRVNNIAMADGRNAQLLSLQQTTAFDAAGIYGVGIGYQFNNWFRGDFIGQYRGNSNFKGTDLLTYPAGGGIVGNGINNYNATKSEWLAMANGYVDLGTWWGVTPFIGAGVGAARVTIANYTDTGMVNNNGFGFGAFPSFANAPAASRWNFAWALHGGLAYMVNPGLTVELAYSYVNLGSGMTGAVSDYTGFTRGVPMQFNDITSHDVKLGVRWYFNTPPVYSPPPLVTKG

SEQ ID NO: 17488 - protein, 538 aa, Nitrobacter winogradskyi
MFRRNLITSAILLMAPLAFSAQSLAESLTVEQRLELLEKALRETQSELKKYKDEEKKKYTPATVNRSVSTNDQGYAANPFPTSSAAKPDAVLVKNEEKNASETGSIYSSMTLKDFSKFVKDEIGFSYNGYYRSGWGTASHGSPKSWAIGSLGRFGNEYSGWFDLQLKQRVYNENGKRVDAVVMMDGNVGQQYSTGWFGDNAGGENYMQFSDMYVTTKGFLPFAPEADFWVGKHGAPKIEIQMLDWKTQRTDAAAGVGLENWKVGPGKIDIALVREDVDDYDRSLQNKQQINTNTIDLRYKDIPLWDKATLMVSGRYVTANESASEKDNQDNNGYYDWKDTWMFGTSLTQKFDKGGFNEFSFLVANNSIASNFGRYAGASPFTTFNGRYYGDHTGGTAVRLTSQGEAYIGDHFIVANAIVYSFGNDIYSYETGAHSDFESIRAVVRPAYIWDQYNQTGVELGYFTQQNKDANSNKFNESGYKTTLFHTFKVNTSMLTSRPEIRFYATYIKALENELDGFTFEDNKDDQFAVGAQAEIWW

SEQ ID NO: 17489 - protein, 396 aa, Nitrobacter winogradskyi
MAFRKKKLAMALRHLSFGIAMTAATTVTHAQGSVTIGGLLDESVALYRDNGGHSNVRMQDSAIYPSKFYVRGTEDLGGGLQASFSLDSMISLSTGALDPQSRGALFENSAWVGMRKVGIGGLRLGQQNDFAFDYFLIGAIDPATGIAGGMLNFRTGSFGADLLGLKGPAQIGAGLAAGGPYAPYTNAAGVPVGMSAINWDRVGGKRMSNAVKLTTDEIAGFSAGLMYSFGEVAGDFQNGSGKSAAIGYHHGETRAAMVYTEQNYGAVNGGQSGIANFLAGARTKVSRFDFSGMYSQARNTFTGARIYAVAGGIGYELMPDLILGGAYTYENGNEQLKNVIIHQGALQLTYTFSKRTAVYLVGVYQHTNGAYAAEIGNILASGKIQSVAAVGMMHRF

SEQ ID NO: 17490 - protein, 280 aa, Nitrobacter winogradskyi
MNVVRKLAVVVAAAALLAPIGRAVAQDAVPLPPPPQAAQPMAQQPMDQQPMAQQSISGASDAGWNTQYGMLFSLQNIFTRQNILEGYGGGVGLQYNLGPTTALRFALDASRTSNPAFERESSYTTPTGSFTSKTLQVPNGPTSTLDVGVSGSYLVRLGTSALAPYLGGGLSLGYATSNVDYEDNTVPTSREVVDDVNRTFDVGLLGQLGLEWRVHRSLSLFAEYGAGVTAFSYTSSSSDHREYNGGTLVQSSKSEGTQTKLFNFDTGLTQGGALGVVAFF

SEQ ID NO: 17491 - protein, 716 aa, Nitrobacter winogradskyi
MPFSLSKTALATHCALLCLTLPSFATHAADKTYATAQSMERMIITGSRSVERIDEVPSSVTLIDNESLKQDMLVSSELQNILAFRVPGMAPSSGTSSNSGQSLRGRQALIMIDGVPQSTPLRNGQLGIRSIDAGAIERIEVIKGATSIYGNGASGGIINYITKKATNDDKARLELGASSKFSAVKFEDTPGYRFDASIDGTNDNFSYVLSGAIEETGLQRDAEGDVIGLKYGLSEAKSKNLFTKLGYAFDEEKYLQLTYNYYEAQQEADYVDVVGSVNTGVKTYAIKDTSGNPRLGAPQGPRGNHNLMLKYIDDELFANTQLTVDGYAQIIENMFFYSTNLSNPSEGYAGGQSLIKSDKKGLRVNLNTQIDWDNVEVSFIYGLDALNDVSSQPLDDGRIWVPEIDMTNLAAYLQAKIIIDNDWIVKAGVRQDRVDLTVDNYETLKVCRDANTCSVPMDVKGGDIDYDTTTFNLGVRYNMNEHFSPFVSFSQGADISDLGRLLRTATVDDISLIRTEASVVDNYEVGFSGQFNDFTYELAVYRSNSDLGTGNKYDEATGVYMPVRAPQKIWGYEAQLSYQIQDHLRSNVTYSWIEGKDTENDVYLDGKAISAPKFTAGIDWQPFDAANLGINYLYVGDRDRFEPTNGNYVGSQGPVSSYNLVNLSSSYRIDNWQLSLGVENLLNEDYYSARSQAFTYKGYNTKGLGTTVNLGVKASF

SEQ ID NO: 17492 - protein, 668 aa, Nitrobacter winogradskyi
MTRITHAITPLAVAISTILSYPVIAQTDSESHSDTRIDEQMVITATHTKVSTTKAPASISVITEEDILSEPGLALNDLVKNIAGVESQMDGGRAGREMISIRGMDAGFTMILVNGRKLSSSNAVFRGNDFDLAAVPKESIQRIEIIRGPMSALYGSEALGGVINVITKKPTNEWQSQVSGDYGYRDDDGGSEYTAGFNTSGALLEDELFLSLSMNKSSRDPWHAFSGQGVSDNGNVYDRSQATTLEQRDTLTASGSLQWYINNEHDLAFDFSYADDQRDGVIESTNGLTDSESKVVRNTQALTYNGTYDWGDALLRYNRDSFETKDNFNDRNADLGLYDVNEVNHTVDGHGTTVVGNHTLTFGGEWKYTELKNPDSLTQTGKATVNQQALFIQDQWALSQKNTLTYGTRVDMHESFGTHWSPRAYLVHSATDQWTIKGGVGTAFKAPSLTQLSSENIVNSCKGNCLLVGNPDLQPETSLNYELSTSYVDTYWSMEAGLFRNEVSNLIDRDLDNPVDNVGGRDVYTYKNIDEAIIQGAEFSGEYDILANLRLNGTYTYLTTEDKTTGEELENRPNHMAMARLVWEPVDSISTFARVNYTSRTLLSVDDNVYRPSYVTADLGMNYFVNNDWRLRAGVKNVTNEQFDDYDVTRRGYVVTPRNWYVGTTLNF

SEQ ID NO: 17493 - protein, 527 aa, Nitrobacter winogradskyi
MSNDLALGGGSVLCCVLATVVAIASPSTAFAQSSSETKLPPLTVTAPQSIRPQQSRASRPSAGRRTTHQAASRTAAPVPSATFPAIERNMLSGAPGPLNLDVPNAAGSLVGLTPRETPATVNIVTQQEMQEKGLRTMVETLNSVPGVMSGNLPGEPGVISMRGFSRAATGYAIDGVRAPDPLIVSRDFDTFNFERVEILKGPASVIQGTGALAGAVNLVTKQPKLGQASAESLFSYGSFNSLRTGIDVNAPIGSNAAVRSTLSYGQSDGYVDDTRSRKVGATTSGTFTPTDRLTFSGSANFFHDEFRTPYQGIPLIARSLARDPTNLVTAPNGFVVDRSIRNQNYNVENGLMTSDTVWLKGGAEYKLTDNWTLKNDLSFFKADRYWANSEDFTFNAATGLLDRSTSKITHDHQFWSERATASYDGMIGGFRNRFAAGLEYVDTAFDSNRRFGSTTSVDPFNPARGYFPADTAANFPTRQDFASGLKTFAVFAENAVNLTPDWLVLAGIRHESMRLDRGIDVSIGAEV

SEQ ID NO: 17494 - protein, 168 aa, Nitrobacter winogradskyi
MRKFTQFVLITAAIMAAPSAFAEMKIAVLNYQMALLESDAAKQYAVDAEKKFGPQLNKLKNLERDAKALQDKLVSNGSKMSQGDREKAELDFKQKARDFQFQSKELNESKAAADRDMLKKLKPKLDQAVEETIKKGGYDMVIERGAVVDVKPQYDITRQVIERMNQLR

SEQ ID NO: 17495 - protein, 214 aa, Nitrobacter winogradskyi
MRRQTIRTCTTAIACAAGLAMIPSLSHAASPGEGINQGDIIARVRGISIMPDERTSNTLSALNVGVNNAIVPELDFTYMIRDYLGVELILGTSRHQITSSLGDLGGVGVLPPTLLLQYHFNHAGKVRPYVGAGINYTLFYNNGLHAGSEGIGINNHSFGPALQFGVDVQVTKKVFVNVDVKKIWMHTDATLGGQPLGRLNIDPLVVGVGVGMKF

SEQ ID NO: 17496 - protein, 272 aa, Nitrobacter winogradskyi
MRYVKTVVAAGAVALLSGAASAADMPLPPPYMPPPVQEFGGWYLRGDIGFSNQRIKERHYSRYDTDLVPGSLNQSTHFDSAGIYGLGVGYQFNSWLRMDVTGEYRAKSNYRGRDTFLVSPSPGTAGADNYTGHKSEWLVLTNAYADLGTWWNITPFVGAGIGAARVTLGGFNDYLDNGVHTGVAADASKWNFAWALHAGLAYKLAPNWTMELAYRYVDMGDGVTGILYNTDGSTINQAMHFKHITSHDLKFGVRWAIDPAPAYYHPPLITKG

SEQ ID NO: 17497 - protein, 730 aa, Nitrobacter winogradskyi
MNKKIYFSIVCALAINVAASDLGTIKVESSTIDSKFDTKKTEVSNTATISGESVDMAHTENIQQILQSIPGVTTEVKSGDTVKIHLRGVENQMYMGEKPGVAIVIDGVPVFERTGSVNIDLDNIESIKVIKGGASYLFGDDALSGAVIITTKRGAKYNNNFGAVEFGSFGYQKLLARSGYASDNLSFHLQASQKESDGYWQDSASVAKYLNGKLQYYIDDTSDVTFGFEYSDREKDTHGTVGGESAARTNPKSIYDGDQDSRDYTRNYDVTLLKLFLTYSKDFDSNSNLLLNGYVYTDDTLYLSSPQTQDSSGISNPSLDDKDYTYNNDYAQIQRGIKSEYRTSSNQFAALLGLDLRANTYENKSTYRVNQALVSYPRGIRTVIPNYYLAGDKKSDDTTDENVYAIYGEYKHQLSQNLSATANLRYDLIKLDYEDYRSNSYKEDFKIYSYRIGSNYRVSDNFDIFANFSTGFRAPTVAQLYAGSTSSWGYTQNNPDLKPEKSYNYEIGVRTSFNKINYEAAIFQIDREDFIMKTSGNYGSTNNTNNDMWDNVGGAKHRGLELSAEGKATEKLLFNLAYTYLDAYYTKYDNFGIDLDGSAYLSNLTFFNVTGNQIPRTSKHQVNLILDYLPMKNLKLSTEINAKSAYYADDLNQIKIPGQATLNLLANYNNKIGDYEYSLFARIDNVLDKSYYNTARSSGDRNEDGVFNAEDLSITVNQGRVYTAGLSVKF

SEQ ID NO: 17498 - protein, 756 aa, Nitrobacter winogradskyi
MTYDRRARLLTMTSVLSLAVALASPVLAQTATPARPVTSGGETIDLDTVTVTATRADRPISDVPQTVRVIERSEIEQQLQLTNNPAAVLAKLVPGYSVSTQTISGASETFRGRDLLVMIDGVPMNTPLRNVSRLLALIDLNSVERIEVVAGASSTYGAGATGGTVNFITKRPTEGAPKASVNAALRTFTANPGASLAPEVSGTVSGGVKGGVDYLVTATGSFANNTYDGDGRLLPSDGMLGQGGGGEYGRGNFLGKIGYNIDPTKRIEAQASWIYMQQDPKWATSYAGAYAAPAIGTPYTGQSVLEDSKSVSLRYTDSAFALGSLSMLGYYNDIKKRFNYSSFDIRNNYLVYYSGNLSSPTSPYNQTILNSERGGVNITVDTPLPILNGATLTWGADVVHDDTWQTLTNGENVFTPLSQMTYAGFAQLQVPIGERLVVRGGVRYEYLDVTVNDFTRPAAFLGFSGLGYAVLPAMAVTGGTYDYSAPTFNLGATYKLTETVDLYGGFSQGFALPDIGAFTRRAGASGTTQILQYGCFLGTRLPAGPYTCNKRNTISYDDLGVEAQIVNNYEIGVRGSIGAFKGSLAGFYSTSNEGVNFIASTNAIGQSKEIIYGAEFTGEYAFTPNFALGTNLALREGRWDSNGDGTIDAWLPNNRISTPFRGTVYGNYRFDQGTTVRAEVEFWSGRGKFDGTQLFEIQSGATLNLAVAHPLAGGTVYVSADNLLDSAYVNPSATATRNYDVYGWGRTLTVGFSKTF

SEQ ID NO: 17499 - protein, 446 aa, Nitrobacter winogradskyi
MKRILAGVALVGTAVSAQAADLAVKAPYLKAPIVAVYDWTGFYIGVNAGVGLGRDLATHNITPAAFATTYLQPQGALGGGQVGYNWQTNSFLGPLVLGLEADIQGTGMSDDRTNLFGNVAAYSQKLDWFGTARGRIGLAKGPVLSYFTGGFAYGNVKTTVTEGLASDSINRTQTGWTIGSGVEAALGGNWTGKIEYLYVNLGNKDDVLFLGTQPIRTEIRENIFRVGLNYRIGGTGIYAPAPVANWAGFYLGGNFGSGTARERTTATRVATEQFNLAPDGFIGGGQIGYNWQAANWVFGGEADFQGSTQRDNRTIVQGGVDSYDAKLPWLATVRGRLGYSVGSTLFYGTGGYAVGSVKTSIATPAFTETFTKTKSGWTAGAGIETPFTLFNLFGPNWTSKTEYLYVDLGSVNNTFASGLVTSSKVTEHVFRTGINYHFNQPVVAKY

SEQ ID NO: 17500 - protein, 369 aa, Nitrobacter winogradskyi
MRRTCIVGAAMLGLYASSAWSQSSVTLYGLIDEAIRYDNHQTRDGGHNITMGAGGAILGSRWGLRGIEDLGGGTKALFTLESGFIANTGAMAFPTPGGQTREFGRQAFVGLSKQGWGTLTLGRQYLLAYLMGASHDTFAFANYAATWGFQAAGLVGGARLDNTVQYSSESYHGFRVNGAYTFGGVAGDTHRNSSPAVSVAYDAGALSVGAVYQIVNNIGGAVPANTAYGNTYFGIGIPDSTQKLFMLGASWTISQATLYAQYIYSHVYPADYRNDSMSLGASYRFNPAWEIRNAVYVDVLHHASGEGTRITTGPILFYHLSKRTDLYTGFNYNHLSGQWTQLASTAGFTQSFNGSNSLFEGVLGMIHRF

SEQ ID NO: 17501 - protein, 736 aa, Nitrobacter winogradskyi
MFNHLAPGGGSALWGVLATTVAILLPSSAFAQSSSGTTLPTVTVTAPKSSKPQPKRATRNAARSNQAPRHARVPSQAAVAVPAAVPGSLTVATAQQALREIQQTPGGVALVTADAYRNSTVSSTIKDILDYVPGVFAQPKWGDDTRLSIRGSSLSRNFHLRGVQLYMDGIPINTADGYGDFQEIDPTAYKYVEVFKGGNALRFGANSLGGAINFVTPSGRDPFVNGVSVDAGAFGFRRLQANTGGSNGPWDGFVTASTQSSDGFRDHSYGHSTRVSGNVGYQFSPDFETRFYLNANDVRQRIPGTVSKDSALTSPQTAAAGNIALDQQRNIDTVRIGNKTTMRFDNTTVEFGAFGVDRHLMHPIFQWLDYRYQDYGGFARVTDDRVIGGFRNRLVAGVNLLNGRIDNQQFENLAGQKGALKSSSIDSSRNTSVYVEDSFYFLPNVAAVAGTQFLYATRNRQDRFLSDGDQSGRTEFNLWSPKGGLLWQIDPTWQAYANVSRSAEVPSFGESAMGVGIPTIPFTSIRPQTATTYEIGTRGKRPDFTWELTAYRAQIRNELLCFYSVFGNCNVTNADRTMHQGIEAGAGAAIVRNLFVRGDRPDRLWLNVAYTFNDFRFDNDSVFGNNLLPGAPRHFVRAELLYKHPNGFYIGPNLEWVPQGYYADSANTLSTDAYAIYGLKAGFDDGGRYSGYIEARNIGNKAYIASSSIIDRANAASPLFEPGTGRAVYAGFKVRW

SEQ ID NO: 17502 - protein, 747 aa, Nitrobacter winogradskyi
MAPSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLDLYNPVNTDFDFNAKDPDNSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 17503 - protein, 928 aa, Nitrobacter winogradskyi
MRQFYLFLIGIIFSAATWAQGTGSIVGVLSDKEVNNEPLPFATVQIKNTSKGTTTDFDGLYEISNVEAGTYTLVFSFVGYETVEVPNVVVEADKVTTINAGLGATAAALDEVVITTTVSRESEVALLLEQKKAVSIQQSIGADELARKGVSDAAAAIAKISGVSKQSGGAGNVYVRGLGDRYLNTTYNGLTLPSNDIEKKNMDLDLFPSDIIQNVAVSKAYSTKFYGDFAASNIDVISKDYKGKFFLDIQLGSSINTRAIGQDFTRSEGTGYFGFYNRYDNNPFAVILSHPVDPVDGGTPINVNGSISGGKSFEMGEGGRLSLFATASFANDYEYRRGSAADFTTVEKQVYDDVEEFEYSTTTTAMLNAIYSLNSGHKITFNSLFLNSSSDEVGNFGIDGNGRNRDAILNTDSGFFTKNIQFNQDMIFVNQLSGLHTFDEEFELTWGVGYNKVFSNQPDRKRFALENYNLALDNDPSTNPSFYNNTNFDNQRYFQNIEDEELNSRLNLEYTVSDNFKLNFGYNGRTKERFFKNIRYGYDLIAPNTPVEDINNLDSIFNVPNLGTVYDTFVFRAIAPELGIDNRNYPGLDENRYTGNLDIHAGYINAEITTGNWLFVPGFRVESFNQSITYDVINLPPDASGYAESYENFYLPSLNVRYALNDDSNLRFSFAKTVSFPEFKEVAPFVYEDVTKRVGGNPDLLNDPSFSDVYNIDLKYEWFFGKSELLSIAGFAKEIRNPVNLVIANDATGTRRYFRTGEKANVYGVELEVRKNLVTDADENAVVSAGINGTYMHTQQDLRSSNGLFSSTLDRDDELQGASPFLINADINYSPTSFENYKPVANLIYSYFADRIDALGSGQLGNIVEKGYGTLDFVWRNEFGDNWEINASAKNLLDPDIEYVREGTSFGDYTTSIYRRGINVGLNVKYKF

SEQ ID NO: 17504 - protein, 1246 aa, Nitrobacter winogradskyi
MSKLLDRFRYFKQKGDTFADGHGQVMHSNRDWEDSYRQRWQFDKIVRSTHGVNCTGSCSWKIYVKNGLVTWEIQQTDYPRTRPDLPNHEPRGCPRGASYSWYLYSANRLKYPLIRKRLIELWREALKQHSDPVLAWASIMNDPQKSLSYKQVRGRGGFIRSNWPELNQLIAAANVWTIKTYGPDRVAGFSPIPAMSMVSYAAGTRYLSLLGGTCLSFYDWYCDLPPASPMTWGEQTDVPESADWYNSSYIIAWGSNVPQTRTPDAHFFTEVRYKGTKTIAITPDYSEVAKLCDQWLAPKQGTDSALAMAMGHVILKEFHLDNPSDYFINYCRRYSDMPMLVMLEPRDDGSYVPGRMIRASDLVDGLGESNNPQWKTVAVNTAGELVVPNGSIGFRWGEKGKWNLESIAAGKETELSLTLLGQHDAVAGVAFPYFGGIENPHFRSVKHNPVLVRQLPVKNLTLAGGSTCPVVSVYDLVLANYGLDRGLEDENSAKDYAEIKPYTPAWGEQITGVPRQYIETIAREFADTAHKTHGRSMIILGAGVNHWYHMDMNYRGMINMLIFCGCVGQSGGGWAHYVGQEKLRPQTGWLPLAFALDWNRPPRQMNSTSFFYNHSSQWRYEKVSAQELLSPLADASKYSGHLIDFNVRAERMGWLPSAPQLGRNPLGIKAEADKAGLSPTEFTAQALKSGDLRMACEQPDSGSNHPRNLFVWRSNLLGSSGKGHEYMQKYLLGTESGIQGEELGASDGIKPEEVEWQTAAIEGKLDLLVTLDFRMSSTCLFSDIVLPTATWYEKDDMNTSDMHPFIHPLSAAVDPAWESRSDWEIYKGIAKAFSQVCVGHLGKETDVVLQPLLHDSPAELSQPCEVLDWRKGECDLSPGKTAPNIVAVERDYPATYERFTSLGPLMDKLGNGGKGISWNTQDEIDFLGKLNYTKRDGPAQGRPLIDTAIDASEVILALAPETNGHVAVKAWQALGEITGREHTHLALHKEDEKIRFRDIQAQPRKIISSPTWSGLESDHVSYNAGYTNVHELIPWRTLSGRQQLYQDHPWMRAFGESLVAYRPPIDTRSVSEMRQIPPNGFPEKALNFLTPHQKWGIHSTYSENLLMLTLSRGGPIVWISETDARELTIVDNDWVEVFNANGALTARAVVSQRVPPGMTMMYHAQERIMNIPGSEVTGMRGGIHNSVTRICPKPTHMIGGYAQLAWGFNYYGTVGSNRDEFIMIRKMKNVNWLDDEGRDQVQEAKK

SEQ ID NO: 17505 - protein, 90 aa, Nitrobacter winogradskyi
MGDHSLFYQADYVDHQSTTDTHDNGSSYQIDSIVYHTVSYSYTMPWNNTISAGINNLTDEDPRFDASGDYESSIYDIIGRSYWVSFTQAF

SEQ ID NO: 17506 - protein, 238 aa, Nitrobacter winogradskyi
MKKFLLTAAAVAAFAAPALAADLPPRPYTKAPPPYTPPQAVYNWTGFYIGGHLGGAFGGDSSLSGSDGRFLGGVQGGADYQFANNWVLGAEAQYSWLTNNNGGAVFPGGNIVTGNDRGLGSVTGRLGYAWGPTLLYAKGGYAFRDSRLGVTDAAGVPLAFATTGNRDNGYTVGAGLEYMFAPNWSAKVEYQYYNFGKTTFAAGSPTDIVGTSFRNDDHTVKAGLNYRFGWGGPVAPHY

SEQ ID NO: 17507 - protein, 253 aa, Nitrobacter winogradskyi
MILSAFSLEGKVAVVTGCDTGLGQGMALGLAQAGCDIVGINIVEPTETIEQVTALGRRFLSLTADLRKIDGIPALLDRAVAEFGHIDILVNNAGLIRREDALEFSEKDWDDVMNLNIKSVFFMSQAAAKHFIAQGNGGKIINIASMLSFQGGIRVPSYTASKSGVMGVTRLMANEWAKHNINVNAIAPGYMATNNTQQLRADEQRSAEILDRIPAGRWGLPSDLMGPIVFLASSASDYVNGYTIAVDGGWLAR

SEQ ID NO: 17508 - protein, 1489 aa, Nitrobacter winogradskyi
MTSYRVRTASSDLSGRSDRKKMTRPSGRSGIRLCLLLALLCHTGIPENASGATTRRLDENYTSNNTTLQSDSNYSNTNSFGLPRNVTIKQGATVYTSSTTSINIIGYTPLSPRTFFINGTLNNNGSLSNNAGLGGKISIGSTGALNNAGTVINNYELTNSGTFNNAGTVINNFSLTNSGTFTNNGGLDNKGLLTNNNTFTNNGTLTNTGSFNADVISAFFNGTDITINPENLFDIIVDGIGSVISGEGLGIIYNTDDFTNNGTLNNKFVLLNAGTLTNTSPTTLNNEGLLINTKDLINSGQFNNSAIVINSSNLTNTGVLDNTGSGTFDLTSFFDGENFSFDFSNLSSLLAGNGVLLNLNGGTIDNSGTLNNDGFLINLGTLNNTSATTLNNSGILYNGNTLTNTGTLNNTGTGTIDFTPLFSEGSFSLDFSDLSDLLGGNGILVNGGTIDNSGTLNNDGFLINLGTLNNTSATTLNNNFLLVNLESLSNTQGAVANNNGIMVNLGTFTNEGQFSNGRPVSVLISELTSLDSENLLGDIASTLTSGIMVNLEDVKNSGTFDNNFVFANIGSFENQSGGVLNNDFLLVNTEAMWNKTGGNMTNNGLLMNFGTLTNDGTVSNNGTIGAFSLDNPLQLGAIYNRGTLNNTGDFTNRFIVYNDGELNTSGTFDNRFLLVNADDMENSGSMTNSGLFLNFGSFTNDGSLVNEGPFGASFSGSAFALDANTLDNPLQLGAIYNGATLNNTGDFTNRFIVYNDGELNTSGTFDNRFLLVNANNMENSGSMTNSGLFLNFGSFTNDGSLVNEGPFGASFSGSAFALDANTLDNPLQLGAIYNGATLNNTGDFTNRFIVYNDGELNTSGTFDNRFLLVNANNMENSGSMTNSGLFLNFGSFTNDGSLVNEGPFGASLPENASEMTASDLDNPIQLGAIYNGGNLTNSGTFENEFLLVNAGTLSNNTEGSMTNSGFILNFGTLANNGDLFNDGGFKNLGILKGNGTIYGYFSNDGIIAPGNSIGTLTFEGSYTHNDSAIYALEVDSIGNSDLIDVKKTVAGRSGNAILNGGLVNVSPAKGFYRWGTFYTILTAENEVFGTFDDVNFPLSSLFLVPSLRYDDRNVYLDLVSDFTSSARTDNQYAVASALDSIPVSVQGDMADVMTCLVYQPTVNSALKAIDRISGHIYTALPDASFYSIDRYLGAVSSHFGGFSMNDKQGIESGFWSSGFGGWGDRDGTDTSSQYTYELTGGIFGYDHKLSETLLLGVAAGYASTDLSMDNLNEKANVDSWQGSLYGLYKDGPLHIGLIGSYGSHNYTTTRHIDFSCVNRTASADYDAYDLSASLEAGYRIDTGKNTFIMPTASLQAIWLNSEAFAEKGASALNLIVDDEHSTTLPGRIGLTFGVETTDRKGGKFTPEVRFALRHDFAADNQYSHQASFAGAPDQSFTIKSDRVERDSFEAGATLAYETKSGTSIFVSYDANLASDMNEQAAAFGFRYTW

SEQ ID NO: 17509 - protein, 404 aa, Nitrobacter winogradskyi
MKKILLIFLLGLPVLGFSQSFQVNLQGQKQIGMAGAGTGLAMDEAAIFFNPGAVSFLKQNGVQAGVSPLYLKTAFRQTGSAITEYNKDKIATPAMAYAVFGSPENKLRFGIGAYTPFGGAMHWKDDWTGRYTVTSLDLQAIYIQPTVSLKLGDYVGIGGGLVYALGKVDLQQALPLTRENGEAGTAQLKGHSKDFGWNAGIYINTQAGITIGVTHRSQVTANVDDGDAIFVGPSSLQPTLPTKFTAALPLPATTSIGFGIYPSEKVTLALDVNWVHWHKYKELAFDYDNNATIPDTRSARNYHDAAAFRLGFQHQTTAKLALRAGVGYALTPVDDEHVTAEVPDADRLLLSAGIGYQGTKGFGVDLSFLYEDVMSRQQTNGESGLSGEYKTRAYIPGISFSYKF

SEQ ID NO: 17510 - protein, 638 aa, Nitrobacter winogradskyi
MNLRHLLATTSITAFLSPLAHAAGDGAAQPSNDTALPAITVTDTRHLPESFDRRYASTQVLTRDDLDRLSPSDPSITQALATLPGVTVSQNGGPGSTASVSIRGSSANQVAVFVDGIRIGSPTTGIAPWSDLPTEAFERVEVISGPAAASFGANAMGGVVQLFTRRASNQPNRTTASFGGGSNKTFDTQLRTSGTVPSTGPLAALGGLTYSLGLHDYATAGIDATRPFAYGHEDGRNPYHAQDVDARLGYARDNWSVSTFALYHRSDLSYDNAGGANRELDHQLTTGVSLHVDITPDTQFDQSFGYANDRQFFYAGDRTIATDRIDSQRISTSTSLTHQTRGLTLFGQPLSGETKLAYDFTREQAFLPNDVAGGVPTRNDSAFSLHQSITLGKVTMFMAGRHEIIAGRAVNTGNAALAWAITPVYTARVSYGNAFRLPTFNDLYYPGYGNPRLSPERSNSVEAALDANTAIGTFTAALYDTRVHNLIAYDPVTFGPINIGRAHIRGIDLSYKGTLGRSTPVSVAVGFLNPQDVTNRTWLNRRPRQTVSVSVDHTWDELHLHALSTGASLLYGGTTFDDPANATYLPSYLTVSLRASYRINSHLTVSALLSNLFDRQYMTAYGYNTVGRSAFGKITYTF

SEQ ID NO: 17511 - protein, 732 aa, Nitrobacter winogradskyi
MAGRELEQGQRPVRRRRALGAHLTRKNLLSKPPGGAKDTMKTALFLGSAIAVIGAPSLVLAQASPSSWVSEVVITSPKGSFTAPSALSATRTATPVEEIPQSIQTLTRGLIEDQALQTLSGALVNVSGVTPTSTEQSVLQPPLIRGFPVSYYFDGAPTYQLPAGIADPATLVNVERIEVAKGPTSTLYGGGSGAPLSGIINVVSQDPGETFGGTVALRAGSFNTLGADAAINLPVNDKVGLRLAGMTEKADSYIDHIDSRRYAIFPTLAVEMSDKTRLVVRGRYNHLEQREYAGVPAGLTFAPSLVIDRYKFAGALDAPRTRITNKQLTANLTHKISDKVEASVTASRYEGAFKEWSSFPYGQISGSVYNFGTAYLPSDTTETYATGSLTARLGEGLVRHQVLVGVDYDKTRYFGAMYFNPAWATLDYAAARPYAAFGGNPPFFFDQNDRMRTTAVFVQDQIAIGERLDITAGLRWTTLKIQSNVGAATADTDKRVTPRIGATYRIANGVSAFAGYAEGFKGVVAGGFYGITPKPETSQSYEGGLKFAAPIKGLTGTVSFYQITRQNVITAHPTIPFVSVQTGEQRSKGVETDLVYEPSPALSVLFNYAYTKAKISKDNTLPVGDRLRAVPEHSGRLAANYRFLAGDLKGLRIGGGLTATSSRELTLPNTVAAKGLALIDAQASYDLGVVRIGLSVVNLAGRKGFEPYQYFGGPYVIPTQPRSAFVSLRTIF

SEQ ID NO: 17512 - protein, 1088 aa, Nitrobacter winogradskyi
MTKKINLFPSLIRFRETNRLKMAIAASIMLWCMAPQQAVADTYEKHEVASIQQQKVKANGTVVDQTGEPLIGVSVKVKDAPNGTITNLDGKFSIDVAKGATLEISYVGYKTVIVKAESTPMHIVLKEDSEMIDEVVVVGYGSQKKVNVTGAVGMVNSEVLEARPVQNVSQALQGVVPGLNLSVNNGGGSLDSEMSINIRGTGTIGDGSGSSPLVLIDGIEGSLNTVNPNDIESVSVLKDAASASIYGARAAFGVVLVKTKSGQSGKPRVTYSGNVRFSDATNIPEMLDSYTFAQYFNRAAANDNGGTVFSKEQLERIKAYQDGTLKSSATFNEQSRRWNYYTGSNANTDWFKEVYEDWVPSMDHNLSISGGTDKTQYIVSGSFLDQKGLIRHGKDTFQRYTLNGRITSNITDWFTLGYSTKWTREDYDRPSYLTGLFFHNVARRWPTVPVYDDNGYLTEPSELIQLEDGGRQINQKDLFTQQLQLTFEPIKNWKIYVEGSLRVTANNQHWEVLPVYQHDVDGNPVGMTWDAGVGSYPVGGSKVSEYAYKENYYSTNIYSDYFKQLDNGHYFKAMVGFNAELYKDRSVSADKSTLITPSVPTINTAVGEPSVAGGYRHTSVAGFFARLNWNYKDRYMLEANGRYDGSSRFIGDKRWGFFPSFSGGWNIAREAFFEETANKLKIGTLKLRASWGQLGNTNTNEAWYPFYQTLPQGQNYGWLVNGVRQNYASNPGIVSSEKTWETIETWDAGLDWGLFNNRLTGSFDYFVRYTYDMIATAPELPSILGTGVPKINNADMKSYGFELEIGWRDRIKNFSYGVKFVLSDAQQKILKYNNPDKSLSNPYYEGQKLGEIWGYKTIGIAQSDEEMNQHLANAKQPMGQKWAAGDIMYADLDNSGSVDQGNYKVGDSGDWQIIGNNTPRFNYGITIDAAWKGLDFRAFVQGIGKRDYWLNGPYFWGFSGGGEWASAGFKEHWDFWRPEGDPLGANTNSYFARVIRGTSKNQQRQTRYLQDASYWRLKNIQIGYTLPKVWTKKAGMESVRVYVSGDNLLTVSDITGVFDPENLGTQWTDPGKVYPLQKVIAIGLTVNF

SEQ ID NO: 17513 - protein, 274 aa, Nitrobacter winogradskyi
MSQNLDATAINQIHALISAQGVNEIISKIGADAVALPENFRIHDLEKFNLNRFRFRGALSTASIDDFTRYSKDLADEGTRCFIDADNMRAVSVLNLGTIDEPGHADNTATLKLKKTAPFSALLSVNGERNSQKSLAEWIEDWADYLVGFDANGDAIQATKAAAAIRKITIEANQTADFEDNDFSGKRSLMESVEAKTKDIMPVAFEFKCVPFEGLKERPFKLRLSIITGDRPVLVLRIIQLEAVQEDMANEFRDLLVEKFKDSKVETFIGTFTA

SEQ ID NO: 17514 - protein, 864 aa, Nitrobacter winogradskyi
MRQGDLGQRALEYRFRGSAFCKDVRKALIAALLATTAVIGGSAAPQSQALAQAQTSFNIPAGPLNRVLAAFGRQSGIQLSYEASIASGKTSPGIQGAATREQAIARILQGSGLSYSFKDSRNVLITQPGATATGAAPAGAIALDTIDVEGATRPGRTEGTESYTTSQSSFGKGQSLRELPQTVTVMTHQRMRDQGLRTLEDVMEYTPGITVEQQSSSSSGFYSRGFEITNFQIDGNSPLLSRSYSQTYAGGLTTSQADLAMYDSVEVLRGSDALYGVSGAPGGVINLVRKKPTSQFQMNALARGGSWNNYRGELDVSGSLNANGAVRGRFVGVYEDREFFYNVAKSNKYLLYGIVEADVTDSTMLTFGSDIMRQDGSNWRYGLPRYSNGADIGLPRSTFLAPDENRWLRNTTKQFVRLDQELGDKWTLGIEASRAHSKVDEKTQVFWGAIDPITLSGLRSGTGHGRQFYRNETQSTLDAVLKGSFHLLGMDHKLILGANIIRYDSGGETNARNGGTIFVPNIFEFDPADFRLNDPYFRIFQWATKITQKGVYGSLAAKIADPLTLIVGGRLSWYNYDDAITTFDRNTGNITGTTLTRFDDNKVFTPSLGLVYDFSTHWSAYASFAETYQPQANSLSGPLPGTPLGPVTGRTYETGVKGSLLDGRLNTSIALYHVNRNGEAVPDPAYPPVTGDLGRNCCFLGQGRIVSRGVDAEVSGEIAEGWRVQAGYTFNDNENVVAGGRYSTVTPKHLFKLWTTYALRGPLDGWKVGGGVTAQSSFYRKGEARTLNPNTGEYDGPLAPFEFTEPGRAVVDLYVEYKINQHWSATLNVNNVFDKRYYQTMGYADYANWYGPPRNFLLSARARF

SEQ ID NO: 17515 - protein, 345 aa, Nitrobacter winogradskyi
MKGIQTKSALARACIGGALALLSAAADASVTLYGRLDTDIEYQKGPDGRATQMVDNASRWGMRGSEDLGGGLRAAFGLEQGFAADSGTATNPQFRNAFVGLQGGFGAIALGRLDSVTIVGSPIYSQVTQNIDFAIHDAGATAIGTKVLNARNRVSNALGYATPEFGGFSVRARVNLAGPDPATPNARSPVRAEDDFRQYDLGLNYAAGNFAAGVGYSRDAKAGGLVANDFRDKVQGAASYNFTVVNIYGIYGRDRYAGTAATRTDVPYWLVGFTVPYGAHKLTVNYMERAVQRDPQGRLKKVQAGYGYSLSKRTMPYVFFDREDPNSHKPGDTVTTVGIGIQHKF

SEQ ID NO: 17516 - protein, 213 aa, Nitrobacter winogradskyi
MHPTRLPMRMHSTLLFAVLAPFVSLPALAQSKGDWTVAVGAHQVAPKSDNGSLVGGTLDVDVGKDIKPTFTAEYFVADNLGIEVLAALPFEHDIAIRGLGRVGSTKHLPPVISLQYHFNAQGTFSPFVGAGINYTRFFGTDTRGDLAGSKLELDDSWGLALHAGVDYTLSDRGALRVNLRWIDIDPQARLDGNHIGTVNIDPLVYGVAYVHRF

SEQ ID NO: 17517 - protein, 245 aa, Nitrobacter winogradskyi
MTGPTNGCSDIEFLENVMKKILLASVAIVGMAAIVPAQAADLAARPYTKAPVYEAAPIYNWTGFYLGGHVGGAFGGDHNLAAPGFTRNGNDGVFMGGGQIGYDYQFSPNWVFGIGANYSFLDTNDHPFVNRGLGSVTGRLGYTWGPALLYAKGGYAWADTRNTNGFGGDTFSNNRIGRDGFTVGGGLEYMFTQNWSGLIEYQYYDFGTTRTTFRNQDVRFRNDEHTIKVGLNYRFNWGAPVGPRY

SEQ ID NO: 17518 - protein, 243 aa, Nitrobacter winogradskyi
MKKILLGTVALVALGAAPALAADLAARPYTKAPAYAPAPVYNWTGFYIGGHIGGAFSGDNSIGTGVTASDNGKFLGGVQAGYDWQFAPNWVLGVEGQYSWLSGTNQSVAFGGTLNGAPGVFTYADNQRGLASVTGRLGYTWGPALLYVKGGWAYADYSSSLTFVPNAGGFAAVAIDSKKDGYTVGGGLEYLFAPNWSGKIEYQYYDFGNVDLGNGFSAKNDEHVVKAGLNYRFNWGGPVVAKY

SEQ ID NO: 17519 - protein, 240 aa, Wolbachia pipientis
  misc_feature (49)..(49): Xaa can be any naturally occurring amino acid
  misc_feature (52)..(52): Xaa can be any naturally occurring amino acid
MHYKKFFSATALVTLLSLSNAAFSDPVGPIAEEETSYYIRLQYNGEVLXFKXKVDAIQYQDNADKAFDPFKASFMAGGAAFGYKMDNIRVDIDGLYSQLNKNEISGTAKAGNTKIADNLSVMSGLVNVYYDVAIEDMPITPYVGVGVGAAYLSNPATEKIVADQKHGFGFAYQAKAGVSYDVTPEIKLFAGARYFGSYGAKFDKSEVYKDSNGERTKVTKDAYKVLYSTIGAEAGLIFNF

SEQ ID NO: 17520 - protein, 240 aa, Wolbachia pipientis
MHYKKFFSATALVMLLSLSNSAFSDPVGPIADEETSYYIRLQYNSEFSPLNTKVDGITGAQKDSKDTNDLYKPSFMAGGSAFGYRMDDIRVDIEGLYSQLSKSTLSRAPTPDIVDNLTAISGLVNVYYDVVIEDIPITPYVGVGLGVAYISNPAKAQVIADQKHGFGFAYQAKAGISYDVTPEIKLFAGARYFGSYGANFDKSEEVNKGTSEDKETKVTAGAYKVLYSTIGAEAGIAFNF

SEQ ID NO: 17521 - protein, 125 aa, Wolbachia endosymbiont
KTTGVVIGLDTLANDNLMIGAAIGITKTDIKHQDYKKGDKTDVNGFSFSLYGAQQLVENFFAQGSAIFSLNQVKNKSQRYFFDANGKMNKQIAAGNYDNMTFGGNLMVGYDYNAMQGVLVTPMAG

SEQ ID NO: 17522 - protein, 69 aa, Yersinia enterocolitica
GSFAYTHQGYDFFYGSNKFGHGDLDYYSVTMGPSFRINEYVSLYGLLGAAHGKVKSSVFDGSVSTSKTS

SEQ ID NO: 17523 - protein, 404 aa, Yersinia enterocolitica
FELANRSDDIDTLYANSGAKGRDLLQTLLIDSHDAGYARTMIDATSANEITKQLNTATDALNNIASLEHKTSGLQTLSLSNAMILNSRLVNLSRRHTNNIDSFAQRLQALKDQRFASLESAAEVLYQFAPKYEKPTNVWANAIGGASLNSGGNTSLYGTSAGVDAYLNEKVEAIVGGFGSYGYSSFNNQSNSLNSGANNANFGVYSRIFANRHEFDFEAQGALGSDQSSLNFKSALLRDLNQSYNYLAYGAATRASYGYDFAFFRNALVLKPSVGVSYNHLGSTNFESNSTHKAALKNGASSQHLFNASANVEARYYYGDTSYFYMNAGVLQEFAHFGSSNALSLNTFKVNAARNPLNTHARVMMGGELKLAKEVFLNLGFIYLHNLISNAGHFASNLGMRYSF

SEQ ID NO: 17524 - protein, 142 aa, Yersinia enterocolitica
FEQSEREQTSVGYALEHYINDTFKFRQNLRYSYNKQDYKYLVFMDLLADSRTMTRRPQIERQTTAEFAVDNQLQADFWTGQLNHTVLTGLDYKRTRIDSRFYMGTVQTKYNLDWVSPVYGLNIKDSDLSLNSSDLTKLDQVG

SEQ ID NO: 17525 - protein, 698 aa, Bordetella pertussis
DWNNQSIVKTGERQHGIHIQGSDPGGVRTASGTTIKVSGRQAQGILLENPAAELQFRNGSVTSSGQLFDDDIRRFLGTVTVKAGKLVADHATLANVGDTWDDDGIALYVAGEQAQASIADSTLQGAGGVQVERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGGVPGGAVPGGFDPGGFGPGGFGPGGFGPGGFGPGGFGPVLDGWYGVDVSGSTVELAQSIVEAPELGAAIRVGRGARVTVSGGSLSAPHGNVIETGGARRFAPQAAPLSITLQAGAHAQGKALLYRVLPEPVKLTLTGGADAQGDIVATELPPIPGTSSGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPRGSAATFTLANKDGKVDIGTYRYRLAANGNGQWSLVGAKVPPAPKPAPQPGPQPPQPPQPQPQPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17526 - protein, 677 aa, Bordetella pertussis
DWNNQSIVKTGERQHGIHIQGSDPGGVRTASGTTIKVSGRQAQGILLENPAAELQFRNGSVTSSGQLSDDGIRRFLGTVTVKAGKLVADHATLANVGDTWDDDGIALYVAGEQAQASIADSTLQGAGGVQIERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGAVPGGAVPGGAVPGGFGPGGFGPVLDGWYGVDVSGSSVELAQSIVEAPELGAAIRVGRGARVTVSGGSLSAPHGNVIETGGARRFAPQAAPLSITLQAGAHAQGKALLYRVLPEPVKLTLTGGADAQGDIVATELPSIPGTSIGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPLGSAATFTLANKDGKVDIGTYRYRLAANGNGQWSLVGAKAPPAPKPAPQPGPQPPQPPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17527 - protein, 693 aa, Bordetella parapertussis
DWNNQSIIKAGERQHGIHIKQSDGAGVRTATGTTIKVSGRQAQGVLLENPAAELRFQNGSVTSSGQLFDEGVRRFLGTVTVKAGKLVADHATLANVSDTRDDDGIALYVAGEQAQASIADSTLQGAGGVRVERGANVTVQRSTIVDGGLHIGTLQPLQPEDLPPSRVVLGDTSVTAVPASGAPAAVFVFGANELTVDGGHITGGRAAGVAAMDGAIVHLQRATIRRGDAPAGGAVPGGAVPGGAVPGGFGPLLDGWYGVDVSDSTVDLAQSIVEAPQLGAAIRAGRGARVTVSGGSLSAPHGNVIETGGGARRFPPPASPLSITLQAGARAQGRALLYRVLPEPVKLTLAGGAQGQGDIVATELPPIPGASSGPLDVALASQARWTGATRAVDSLSIDNATWVMTDNSNVGALRLASDGSVDFQQPAEAGRFKVLMVDTLAGSGLFRMNVFADLGLSDKLVVMRDASGQHRLWVRNSGSEPASGNTMLLVQTPRGSAATFTLANKDGKVDIGTYRYRLAANGNGQWSLVGAKAPPAPKPAPQPGPQPGPQPGPQPPQPPQPPQPPQPPQPPQRQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17528 - protein, 675 aa, Bordetella parapertussis
DWNNQSIIKAGERQHGIHIKQSDGAGVRTATGTTIKVSGRQAQGILLENPAAELRFQNGSVTSSGQLFDEGVRRFLGTVTVKAGKLVADHATLANVSDTRDDDGIALYVAGEQAQASIADSTLQGAGGVRVERGANVTVQRSTIVDGGLHIGTLQPLQPEDLPPSRVVLGDTSVTAVPASGAPAAVSVFGANELTVDGGHITGGRAAGVAAMDGAIVHLQRATIRRGDAPAGGAVPGGAVPGGFGPLLDGWYGVDVSDSTVDLAQSIVEAPQLGAAIRAGRGARVTVSGGSLSAPHGNVIETGGGARRFPPPASPLSITLRAGARAQGRALLYRVLPEPVKLTLAGGAQGQGDIVATELPPIPGASSGPLDVALASQARWTGATRAVDSLSIDNATWVMTDNSNVGALRLASDGSVDFQQPAEAGRFKVLMVDTLAGSGLFRMNVFADLGLSDKLVVMRDASGQHRLWVRNSGSEPASANTMLLVQTPRGSAATFTLANKDGKVDIGTYRYRLAANGNGQWSLVGAKAPPAPKPAPQPGPQPGPQPPQPPQPPQRQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17529 - protein, 685 aa, Bordetella parapertussis
DWNNQSIIKAGERQHGIHIKQSDGAGVRTATGTTIKVSGRQAQGVLLENPAAELRFQNGSVTSSGQLFDEGVRRFLGTVTVKAGKLVADHATLANVSDTRDDDGIALYVAGEQAQASIADSTLQGAGGVRVERGANVTVQRSTIVDGGLHIGTLQPLQPEDLPPSRVVLGDTSVTAVPASGAPAAVSVFGANELTVDGGHITGGRAAGVAAMDGAIVHLQRATIRRGDAPAGGAVPGGAVPGGAVPGGAVPGGFGPLLDGWYGVDVSDSTVDLAQSIVEAPQLGAAIRAGRGARVTVSGGSLSAPHGNVIETGGGARRFPPPASPLSITLQAGARAQGRALLYRVLPEPVKLTLAGGAQGQGDIVATELPPIPGASSGPLDVALASQARWTGATRAVDSLSIDNATWVMTDNSNVGALRLASDGSVDFQQPAEAGRFKVLMVDTLAGSGLFRMNVFADLGLSDKLVVMRDASGQHRLWVRNSGSEPASANTMLLVQTPRGSAATFTLANKDGKVDIGTYRYRLAANGNGQWSLVGAKAPPAPKPAPQPGPQPGPQPPQPPQPPQRQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17530 - protein, 683 aa, Bordetella bronchiseptica
DWNNQSIIKAGERQHGIHIKQSDGAGVRTATGTTIKVSGRQAQGVLLENPAAELRFQNGSVTSSGQLFDEGVRRFLGTVTVKAGKLVADHATLANVSDTRDDDGIALYVAGEQAQASIADSTLQGAGGVRVERGANVTVQRSTIVDGGLHIGTLQPLQPEDLPPSRVVLGDTSVTAVPASGAPAAVSVFGANELTVDGGHITGGRAAGVAAMDGAIVHLQRATIRRGDAPAGGAVPGGAVPGGFGPLLDGWYGVDVSDSTVDLAQSIVEAPQLGAAIRAGRGARVTVSGGSLSAPHGNVIETGGGARRFPPPASPLSITLRAGARAQGRALLYRVLPEPVKLTLAGGAQGQGDIVATELPPIPGASSGPLDVALASQARWTGATRAVDSLSIDNATWVMTDNSNVGALRLASDGSVDFQQPAEAGRFKVLMVDTLAGSGLFRMNVFADLGLSDKLVVMRDASGQHRLWVRNSGSEPASANTMLLVQTPRGSAATFTLANKDGKVDIGTYRYRLAANGNGQWSLVGAKAPPAPKPAPQPGPQPGPQPGPQPGPQPPQPPQPPQRQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17531 - protein, 689 aa, Bordetella bronchiseptica
DWNNQSIIKAGERQHGIHIKQSDGAGVRTATGTTIKVSGRQAQGVLLENPAAELRFQNGSVTSSGQLFDEGVRRFLGTVTVKAGKLVADHATLANVSDTRDDDGIALYVAGEQAQASIADSTLQGAGGVRVERGANVTVQRSTIVDGGLHIGTLQPLQPEDLPPSRVVLGDTSVTAVPASGAPAAVFVFGANELTVDGGHITGGRAAGVAAMDGAIVHLQRATIRRGDAPAGGAVPGGAVPGGAVPGGFGPLLDGWYGVDVSDSTVDLAQSIVEAPQLGAAIRAGRGARVTVSGGSLSAPHGNVIETGGGARRFPPPASPLSITLQAGARAQGRALLYRVLPEPVKLTLAGGAQGQGDIVATELPPIPGASSGPLDVALASQARWTGATRAVDSLSIDNATWVMTDNSNVGALRLASDGSVDFQQPAEAGRFKVLMVDTLAGSGLFRMNVFADLGLSDKLVVMRDASGQHRLWVRNSGSEPASGNTMLLVQTPRGSAATFTLANKDGKVDIGTYRYRLAANGNGQWSLVGAKAPPAPKPAPQPGPQPGPQPPQPPQPPQPPQPPQPPQRQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17532 - protein, 678 aa, Bordetella bronchiseptica
DWNNQSIVKTGERQHGIHIQGSDPGGVRTASGTTIKVSGRQAQGILLENPAAELQFRNGSVTSSGQLFDDGIRRFLGTVTVKAGKLVADHATLANVGDTWDDDGIALYVAGEQAQASIADSTLQGAGGVQVERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGGVPGGAVPGGFGPGGFGPVLDGWYGVDVSGSSVELAQSIVEAPELGAAIRVGRGARVTLSGGSLSAPHGNVIETGGARRFAPQAAPLSITLQAGAHAQGKALLYRVLPEPVQLTLTGGADAQGDIVATELPPIPGTSIGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPRGSAATFTLANKDGKVDIGTYRYRLAANGNGQWSLVGAKAPPAPKPAPQPGPQPPQPPQPQPQPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17533 - protein, 685 aa, Bordetella bronchiseptica
DWNNQSIIKAGERQHGIHIKQSDGAGVRTATGTTIKVSGRQAQGVLLENPAAELRFQNGSVTSSGQLFDEGVRRFLGTVTVKAGKLVADHATLANVSDTRDDDGIALYVAGEQAQASIADSTLQGAGGVRVERGANVTVQRSTIVDGGLHIGTLQPLQPEDLPPSRVVLGDTSVTAVPASGAPAAVSVFGANELTVDGGHITGGRAAGVAAMDGAIVHLQRATIRRGDAPAGGAVPGGAVPGGAVPGGAVPGGFGPLLDGWYGVDVSDSTVDLAQSIVEAPQLGAAIRAGRGARVTVSGGSLSAPHGNVIETGGGARRFPPPASPLSITLQAGARAQGRALLYRVLPEPVKLTLAGGAQGQGDIVATELPPIPGASSGPLDVALASQARWTGATRAVDSLSIDNATWVMTDNSNVGALRLASDGSVDFQQPAEAGRFKVLMVDTLAGSGLFRMNVFADLGLSDKLVVMRDASGQHRLWVRNSGSEPASANTMLLVQTPRGSAATFTLANKDGKVDIGTYRYRLAANGNGQWSLVGAKAPSAPKPAPQPGPQPGPQPPQPPQPPQRQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17534 - protein, 675 aa, Bordetella bronchiseptica
DWNNQSIIKAGERQHGIHIKQSDGAGVRTATGTTIKVSGRQAQGVLLENPAAELRFQNGSVTSSGQLFDEGVRRFLGTVTVKAGKLVADHATLANVSDTRDDDGIALYVAGEQAQASIADSTLQGAGGVRVERGANVTVQRSTIVDGGLHIGTLQPLQPEDLPPSRVVLGDTSVTAVPASGAPAAVSVFGANELTVDGGHITGGRAAGVAAMDGAIVHLQRATIRRGDAPAGGAVPGGAVPGGFGPLLDGWYGVDVSDSTVDLAQSIVEAPQLGAAIRAGRGARVTVSGGSLSAPHGNVIETGGGARRFPPPASPLSITLQAGARAQGRALLYRVLPEPVKLTLAGGAQGQGDIVATELPPIPGASSGPLDVALASQARWTGATRAVDSLSIDNATWVMTDNSNVGALRLASDGSVDFQQPAEAGRFKVLMVDTLAGSGLFRMNVFADLGLSDKLVVMRDASGQHRLWVRNSGSEPASANTMLLVQTPRGSAATFTLANKDGKVDIGTYRYRLAANGNGQWSLVGAKAPPAPKPAPQPGPQPGPQPPQPPQPPQRQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17535 - protein, 681 aa, Bordetella bronchiseptica
DWNNQSIIKAGERQHGIHIKQSDGAGVRTATGTTIKVSGRQAQGVLLENPAAELRFQNGSVTSSGQLFDEGVRRFLGTVTVKAGKLVADHATLANVSDTRDDDGIALYVAGEQAQASIADSTLQGAGGVRVERGANVTVQRSTIVDGGLHIGTLQPLQPEDLPPSRVVLGDTSVTAVPASGAPAAVSVFGANELTVDGGHITGGRAAGVAAMDGAIVHLQRATIRRGDAPAGGAVPGGAVPGGFGPLLDGWYGVDVSDSTVDLAQSIVEAPQLGAAIRAGRGARVTVSGGSLSAPHGNVIETGGGARRFPPPASPLSITLQAGARAQGRALLYRVLPEPVKLTLAGGAQGQGDIVATELPPIPGASSGPLDVALASQARWTGATRAVDSLSIDNATWVMTDNSNVGALRLASDGSVDFQQPAEAGRFKVLMVDTLAGSGLFRMNVFADLGLSDKLVVMRDASGQHRLWVRNSGSEPASANTMLLVQTPRGSAATFTLANKDGKVDIGTYRYRLAANGNGQWSLVGAKAPPAPKPAPQPGPQPGPQPPQPPQPPQPPQPPQRQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17536 - protein, 678 aa, Bordetella bronchiseptica
DWNNQSIIKAGERQHGIHIKQSDGAGVRTATGTTIKVSGRQAQGVLLENPAAELRFQNGSVTSSGQLFDEGVRRFLGTVTVKAGKLVADHATLANVSDTRDDDGIALYVAGEQAQASIADSTLQGAGGVRVERGANVTVQRSTIVDGGLHIGTLQPLQPEDLPPSRVVLGDTSVTAVPASGAPAAVSVFGANELTVDGGHITGGRAAGVAAMDGAIVHLQRATIRRGDAPAGGAVPGGAVPGGFGPLLDGWYGVDVSDSTVDLAQSIVEAPQLGAAIRAGRGARVTVSGGSLSAPHGNVIETGGGARRFPPPASPLSITLQAGARAQGRALLYRVLPESVKLTLAGGAQGQGDIVATELPPIPGASSGPLDVALASQARWTGATRAVDSLSIDNATWVMTDNSNVGALRLASDGSVDFQQPAEAGRFKVLMVDTLAGSGLFRMNVFADLGLSDKLVVMRDASGQHRLWVRNSGSEPASANTMLLVQTPRGSAATFTLANKDGKVDIGTYRYRLAANGNGQWSLVGAKAPPAPKPAPQPGPQPGPQPPQPPQPPQPPQRQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17537 - protein, 676 aa, Bordetella bronchiseptica
DWNNQSIVKTGERQHGIHIQGSDPGGVRTASGTTIKVSGRQAQGILLENPAAELQFRNGSVTSSGQLFDDGIRRFLGTVTVKAGKLVADHATLANVGDTWDDDGIALYVAGEQAQASIADSTLQGAGGVQVERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGGVPGGAVPGGFGPGGFGPVLDGWYGVDVSGSSVELAQSIVEAPELGAAIRVGRGARVTVSGGSLSAPHGNVIETGGARRFAPQAAPLSITLQAGAHAQGKALLYRVLPEPVQLTLTGGADAQGDIVATELPPIPGTSSGPLDVALASQARWTGATRAVDALSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPRGSAATFTLANKDGKVDIGTYRYRLAANGNGQWSLVGAKAPPAPKPAPQPGPQPPQPPQPQPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17538 - protein, 681 aa, Bordetella bronchiseptica
DWNNQSIVKTGERQHGIHIQGSDPGGVRTASGTTIKVSGRQAQGILLENPAAELQFRNGSVTSSGQLFDDGIRRFLGTVTVKAGKLVADHATLANVGDTWDDDGIALYVAGEQAQASIADSTLQGAGGVQVERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGGVPGGAVPGGFGPGGFGPGGFGPVLDGWYGVDVSGSSVELAQSIVEAPELGAAIRVGRGARVTVSGGSLSAPHGNVIETGGARRFAPQAAPLSITLQAGAHAQGKALLYRVLPEPVQLTLTGGADAQGDIVATELPPIPGTSIGPLDVALASQARWTGATRAVDALSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPRGSAATFTLANKDGKVDIGTYRYRLAANGNGQWSLVGAKAPPAPKPAPQPGPQPGPLPPQPPQPQREAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17539 - protein, 674 aa, Bordetella bronchiseptica
DWNNQSIVKTGERQHGIHIQGSDPGGVRTASGTTIKVSGRQAQGILLENPAAELQFRNGSVTSSGQLFDDGIRRFLGTVTVKAGKLVADHATLANVGDTWDDDGIALYVAGEQAQASIADSTLQGAGGVQIERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGGVPGGAVPGGAVPGGFGPGGFGPVLDGWYGVDVSGSSVELAQSIVEAPELGAAIRVGRGARVTVSGGSLFAPHGNVIETGGARRFAPQAAPLSITLQAGAHAQGKALLYRVLPEPVKLTLTGGADAQGDIVATELPSIPGTSIGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPRGSAATFTLANKDGKVDIGTYRYRLAANGNGQWSLVGAKAPPAPKPAPQPGPQPPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17540 - protein, 693 aa, Bordetella bronchiseptica
DWNNQSIVKTGERQHGIHIQGSDPGGVRTASGTTIKVSGRQAQGILLENPAAELQFRNGSVTSSGQLFDDGIRRFLGTVTVKAGKLVADHATLANVGDTWDDDGIALYVAGEQAQASIADSTLQGAGGVQVERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGGVPGGGVPGGAVPGGAVPGGFDPGGFGPVLDGWYGVDVSGSSVELAQSIVEAPELGAAIRVGRGARVTVSGGSLSAPHGNVIETGGARRFAPQAAPLSIILQAGAHAQGKALLYRVLPEPVKLTLTGGADAQGDIVATELPPIPATSSGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPRGSAATFTLANKDGKVDIGTYRYRLAANGNGQWSLVGAKAPPAPKPAPQPGPQPGPQPPQLPQPQPPKPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17541 - protein, 682 aa, Bordetella bronchiseptica
DWNNQSIIKAGERQHGIHIKQSDGAGVRTATGTTIKVSGRQAQGVLLENPAAELRFQNGSVTSSGQLFDEGVRRFLGTVTVKAGKLVADHATLANVSDTRDDDGIALYVAGEQAQASIADSTLQGAGGVRVERGANVTVQRSTIVDGGLHIGTLQPLQPEDLPPSRVVLGDTSVTAVPASGAPAAVSVFGANELTVDGGHITGGRAAGVAAMDGAIVHLQRATIRRGDAPAGGAVPGGAVPGGFGPLLDGWYGVDVSDSTVDLAQSIVEAPQLGAAIRAGRGARVTVSGGSLSAPHGNVIETGGGARRFPPPASPLSITLRAGARAQGRALLYRVLPEPVKLTLAGGAQGQGDIVATELPPIPGASSGPLDVALASQARWTGATRAVDSLSIDNATWVMTDNSNVGALRLASDGSVDFQQPAEAGRFKVLMVDTLAGSGLFRMNVFADLGLSDKLVVMRDASGQHRLWVRNSGSEPASANTMLLVQTPRGSAATFTLANKDGKVDIGTYRYRLAANGNGQWSLVGAKAPPAPKPAPQPGPQPGPQPGPQPPQPPQPPQPPQRQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17542 - protein, 678 aa, Bordetella bronchiseptica
DWNNQSIIKAGERQHGIHIKQSDGAGVRTATGTTIKVSGRQAQGVLLENPAAELRFQNGSVTSSGQLFDEGVRRFLGTVTVKAGKLVADHATLANVSDTRDDDGIALYVAGEQAQASIADSTLQGAGGVRVERGANVTVQRSTIVDGGLHIGTLQPLQPEDLPPSRVVLGDTSVTAVPASGAPAAVSVFGANELTVDGGHITGGRAAGVAAMDGAIVHLQRATIRRGDAPAGGAVPGGAVPGGFGPLLDGWYGVDVSDSTVDLAQSIVEAPQLGAAIRAGRGARVTVSGGSLSAPHGNVIETGGGARRFPPPASPLSITLQAGARAQGRALLYRVLPEPVKLTLAGGAQGQGDIVATELPPIPGASSGPLDVALASQARWTGATRAVDSLSIDNATWVMTDNSNVGALRLASDGSVDFQQPAEAGRFKVLMVDTLAGSGLFRMNVFADLGLSDKLVVMRDASGQHRLWVRNSGSEPASANTMLLVQTPRGSAATFTLANKDGKVDIGTYRYRLAANGNGQWSLVGAKAPPAPKPAPQPGPQPGPQPPQPPQPPQPPQRQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17543 - protein, 679 aa, Bordetella bronchiseptica
DWNNQSIIKAGERQHGIHIKQSDGAGVRTATGTTIKVSGRQAQGVLLENPAAELRFQNGSVTSSGQLFDEGVRRFLGTVTVKAGKLVADHATLANVSDTRDDDGIALYVAGEQAQASIADSTLQGAGGVRVERGANVTVQRSTIVDGGLHIGTLQPLQPEDLPPSRVVLGDTSVTAVPASGAPAAVSVFGANELTVDGGHITGGRAAGVAAMDGAIVHLQRATIRRGDAPAGGAVPGGAVPGGFGPLLDGWYGVDVSDSTVDLAQSIVEAPQLGAAIRAGRGARVTVSGGSLSAPHGNVIETGGGARRFPPPASPLSITLRAGARAQGRALLYRVLPEPVKLTLAGGAQGQGDIVATELPPIPGASSGPLDVALASQARWTGATRAVDSLSIDNAIWVMTDNSNVGALRLASDGSVDFQQPAEAGRFKVLMVDTLAGSGLFRMNVFADLGLSDKLVVMRDASGQHRLWVRNSGSEPASANTMLLVQTPRGSAATFTLANKDGKVDIGTYRYRLAANGNGQWSLVGAKAPPAPKPAPQPGPQPGPQPGPQPPQPPQPPQRQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17544 - protein, 250 aa, Bordetella bronchiseptica
DWLDLSARYNEAFRTPSMQERFVSGSHFGTNLMGRSFNNTFVSNPNLRPETAKNKEIAAKVHFDNLFVHQDKFIFNAAYFQNDVKDFIHLDIFRASQREMIPSLSQYRNVENARLTGYELEFAYQQERLALGLNYAQTKGKNRQTQEALSNIPANKLGFTIDYAIVPQTFMVGANITHYASQKRVPKTHAMTYPSYTLTDLKASYTPSGEWRNLRLDMMIENVFDKKFQPAFSLMEGAGRNIKLNASYQF

SEQ ID NO: 17545 - protein, 685 aa, Bordetella bronchiseptica
DWNNQSIVKTGERQHGIHIQGSDPGGVRTASGTTIKVSGRQAQGILLENPAAELQFRNGSVTSSGQLFDDGIRRFLGTVTVKAGKLVADHATLANVGDTWDDDGIALYVAGEQAQASIADSTLQGAGGVQVERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGGVPGGAVPGGFGPGGFGPGGFGPVLDGWYGVDVSGSTVELAQSIVEAPELGAAIRVGRGARVTVSGGSLSAPHGNVIETGGARRFAPQAAPLSITLQAGAHAQGKALLYRVLPEPVKLTLTGGADAQGDIVATELPPIPGTSSGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPRGSAATFTLANKDGKVDIGTYRYRLAANGNGQWSLVGAKVPPAPKPAPQPGPQPPQPPQPPQPPQPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17546 - protein, 682 aa, Bordetella bronchiseptica
DWNNQSIVKTGERQHGIHIQGSDPGGVRTASGTTIKVSGRQAQGILLENPAAELQFRNGSVTSSGQLFDDGIRRFLGTVTVKAGKLVADHATLANVGDTWDDDGIALYVAGEQAQASIADSTLQGAGGVQVERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGGVPGGAVPGGFGPGGFGPVLDGWYGVDVSGSSVELAQSIVEAPELGAAIRVGRGARVTVSGGSLSAPHGNVIETGGARRFAPQAAPLSITLQAGAHAQGKALLYRVLPEPVQLTLTGGADAQGDIVATELPPIPGTSSGPLDVALASQARWTGATRAVDALSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPRGSAATFTLANKDGKVDIGTYRYRLAANGNGQWSLVGAKAPPAPKPAPQPGPQPPQPPQPQPQPQPQPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17547 - protein, 680 aa, Bordetella bronchiseptica
DWNNQSIIKAGERQHGIHIKQSDGAGVRTATGTTIKVSGRQAQGVLLENPAAELRFQNGSVTSSGQLFDEGVRRFLGTVTVKAGKLVADHATLANVSDTRDDDGIALYVAGEQAQASIADSTLQGAGGVRVERGANVTVQRSTIVDGGLHIGTLQPLQPEDLPPSRVVLGDTSVTAVPASGAPAAVSVFGANELTVDGGHITGGRAAGVAAMDGAIVHLQRATIRRGDAPAGGAVPGGAVPGGAVPGGFGPLLDGWYGVDVSDSTVDLAQSIVEAPQLGAAIRAGRGARVTVSGGSLSAPHGNVIETGGGARRFPPPASPLSITLQAGARAQGRALLYRVLPEPVKLTLAGGAQGQGDIVATELPPIPGASSGPLDVALASQARWTGATRAVDSLSIDNATWVMTDNSNVGALRLASDGSVDFQQPAEAGRFKVLMVDTLAGSGLFRMNVFADLGLSDKLVVMRDASGQHRLWVRNSGSEPASANTMLLVQTPRGSAATFTLANKDGKVDIGTYRYRLAANGNGQWSLVGAKAPPAPKPAPQPGPQPGPQPPQPPQPPQRQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17548 - protein, 680 aa, Bordetella bronchiseptica
DWNNQSIVKTGERQHGIHIQGSDPGGVRTASGTTIKVSGRQAQGILLENPAAELQFRNGSVTSSGQLFDDGIRRFLGTVTVKAGKLVADHATLANVGDTWDDDGIALYVAGEQAQASIADSTLQGAGGVQVERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGGVPGGAVPGGFGPGGFGPVLDGWYGVDVSGSSVELAQSIVEAPELGAAIRVGRGARVTVSGGSLSAPHGNVIETGGARRFAPQAAPLSITLQAGEHAQGKALLYRVLPEPVQLTLTGGADAQGDIVATELPPIPGTSIGPLDVALASQARWTGATRAVDALSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPRGSAATFTLANKDGKVDIGTYRYRLAANGNGQWSLVGAKAPPAPKPAPQPGPQPPQPPQPQPQPQPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17549 - protein, 679 aa, Bordetella bronchiseptica
DWNNQSIIKAGERQHGIHIKQSDGAGVRTATGTTIKVSGRQAQGVLLENPAAELRFQNGSVTSSGQLFDEGVRRFLGTVTVKAGKLVADHATLANVSDTRDDDGIALYVAGEQAQASIADSTLQGAGGVRVERGANVTVQRSTIVDGGLHIGTLQPLQPEDLPPSRVVLGDTSVTAVPASGAPAAVSVFGANELTVDGGHITGGRAAGVAAMDGAIVHLQRATIRRGDAPAGGAVPGGAVPGGFGPLLDGWYGVDVSDSTVDLAQSIVEAPQLGAAIRAGRGARVTVSGGSLSAPHGNVIETGGGARRFPPPASPLSITLRAGARAQGRALLYRVLPEPVKLTLAGGAQGQGDIVATELPPIPGASSGPLDVALASQARWTGATRAVDSLSIDNATWVMTDNSNVGALRLASDGSVDFQQPAEAGRFKVLMVDTLAGSGLFRMNVFADLGLSDKLVVMRDASGQHRLWVRNSGSEPASANTMLLVQTPRGSAATFTLANKDGKVDIGTYRYRLAANGNGQWSLVGAKAPPAPKPAPQPGPQPGPQPGPQPPQPPQPPQRQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17550 - protein, 686 aa, Bordetella bronchiseptica
DWNNQSIIKAGERQHGIHIKQSDGAGVRTATGTTIKVSGRQAQGVLLENPAAELRFQNGSVTSSGQLFDEGVRRFLGTVTVKAGKLVADHATLANVSDTRDDDGIALYVAGEQAQASIADSTLQGAGGVRVERGANVTVQRSTIVDGGLHIGTLQPLQPEDLPPSRVVLGDTSVTAVPASGAPAAVSVFGANELTVDGGHITGGRAAGVAAMDGAIVHLQRATIRRGDAPAGGAVPGGAVPGGFGPLLDGWYGVDVSDSTVDLAQSIVEAPQLGAAIRAGRGARVTVSGGSLSAPHGNVIETGGGARRFPPPASPLSITLRAGARAQGRALLYRVLPEPVKLTLAGGAQGQGDIVATELPPIPGASSGPLDVALASQARWTGATRAVDSLSIDNATWVMTDNSNVGALRLASDGSVDFQQPAEAGRFKVLMVDTLAGSGLFRMNVFADLGLSDKLVVMRDASGQHRLWVRNSGSEPASANTMLLVQTPRGSAATFTLANKDGKVDIGTYRYRLAANGNGQWSLVGAKAPPAPKPAPQPGPQPGPQPGPQPGPQPPQPPQPPQPPQRQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17551 - protein, 680 aa, Bordetella bronchiseptica
DWNNQSIIKAGDRQHGIHIKQSDGAGVRTATGTTIKVSGRQAQGVLLENPAAELRFQNGSVTSSGQLFDEGVRRFLGTVTVKAGKLVADHATLANVSDTRDDDGIALYVAGEQAQASIADSTLQGAGGVRVERGANVTVQRSTIVDGGLHIGTLQPLQPEDLPPSRVVLGDTSVTAVPASGAPAAVSVFGANELTVDGGHITGGRAAGVAAMDGAIVHLQRATIRRGDAPAGGAVPGGAVPGGAVPGGFGPLLDGWYGVDVSDSTVDLAQSIVEAPQLGAAIRAGRGARVTVSGGSLSAPHGNVIETGGGARRFPPPASPLSITLQAGARAQGRALLYRVLPEPVKLTLAGGAQGQGDIVATELPPIPGASSGPLDVALASQARWTGATRAVDSLSIDNATWVMTDNSNVGALRLASDGSVDFQQPAEAGRFKVLMVDTLAGSGLFRMNVFADLGLSDKLVVMRDASGQHRLWVRNSGSEPASANTMLLVQTPRGSAATFTLANKDGKVDIGTYRYRLAANGNGQWSLVGAKAPPAPKPAPQPGPQPGPQPPQPPQPPQRQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 17552 - protein, 712 aa, Vibrio parahaemolyticus
MSYQNLDGKVRVRAGLSTTYSVLAIAIASATSMSAVAAPAAKNETTVMETVVVTGSVIGNSDIEDVKEYPGARTVITRDQIEKTAAGSIDNALQRVPGIKVQDESGTGVLPNISVRGLKASRSGHAQFLMDGVPLTLAPYGHTGQSIFPATLSMLDRIDIVRGGAAVQYGPNNVGGVINLVTKPIPHTWQTEISNRLTVFDGGDAPLNDFYLRTGGWLSDTFALQLEGNFLKGESFREHSDTDVKNFQAKAQWLLSDTQEIQAFLQRYDAETQMPGALSPQDYEQDRHQSKRPYDDYEGKSTRWSVKYIHDLPFADSAELEVLTFGHKSERLFKWGFNSAGGHWADPALPATDVRTSPREFTVYGIEPKMAMYFGEGKSVTQNWIVGTRYVNEDIDYKLTQTPIAGGATKVPRDWHLDTDAFAGYVSNEIGLFNDTLKVTPGLRVESVRMTFTDRGKEQTADNKVTEWLPGLTVAYNVTDQWVTYADAQKSLRAPQIAYIRGLGEEGSELAWNYEVGARYTQDATSFNAALYRIDFEDQLQWQSSTQTFDNIGKTLHQGLELSARYVPEVLPALSLGASYNYLDATLEEEGANKGNQLPYTSKHQLGWDATYAFYGMDTTLSGFYFSDSYTDNANTSAEDATGATGKVPSYMVWNFNLGTDLYKDDKGKLRMNVAVNNLFDEEYYFRGIDTSPVGRYPAPGRSYTLDLNYQF

SEQ ID NO: 17553 - protein, 678 aa, Vibrio parahaemolyticus
MNKLLTLTPLAVAIGSSLVVPSAVASEETNSTPSATETIQVYGHQYEGYAEHMPQSGTKTDVEWLDVPQAVSVVTKTEMQDRGAVRLVDALDGVAGVNNTLGEGSRDQFMIRGFDSLNDMYRDGMRDDGTLQSYRSLANVERVEIVKGPAGALYGRGSAGGIINLVTKRANGENFTHVKGSVGSNSQYVGQVDSSMAFSDKVNGRINLEYRQADSYVDHVDSNDFFIAPTIRVLPADGHTIDIDVEYAHQELVPYRGVPSKNGKPVDLPVSTYFGGTNDYQESDSLRVAVDYEWRLNDQWVWNNRAAFNHIELEQKGTRQGKVTGNEVSQTVNNFGYDPRTTTTLQSELIWETNDNQLMLGADFNQIDIDLTLASDKTLPPQNIYNPVVGPTPDPGFKPFRDNTTTTTGVYVQDVYTWGDLSVIGNVRYDSMELEQQKAGSGKEKLDDDKVSYRAGLVYRINYDTSVYASLARSWQLPYAGIYINPKLAEFFHTDLKEVGAKAYLLDNALMLNAALFQIDQEQPQTNVDGDVIDKIEVRHQGIELEARGQITKQWDISVGYSYLDAEDKATGKSRMMCQTTCSPFGALTNLDDNWRLGGGVKYVGDRYAGNDEAVALGDYTTVDLMAAYTTGRHKIQANAYNILDEKYILGATNGTSGLNQIGYGAPAEFMLSYGYQF

SEQ ID NO: 17554 - protein, 199 aa, Wolbachia endosymbiont
GPISDEETSYYVRLQYNGEILPFYTKVDGIKNVTGKEKDSPLTRSFIAGGGAFGYKMDDIRVDVEGLYSQLAKDTAVVNASETNVADSLTAFSGLVNVYYDIAIEDMPITPYVGVGVGAAYISNPSKADSVKDQKGFGFAYQAKAGVSYDVTPEIKLFAGARYFGSYGASFDKADKDDTGIKNVVYSTFGAEAGVAFNF

SEQ ID NO: 17555 - protein, 317 aa, Haemophilus parasuis
DVTLYGVIKAGVQTYRSVEHREGKVVGVVTGSEISDFGSKIGFKGQEDLGNGLKAIWQLEQGASVAGTNSGWGNKQSFIGLKGGFGTIRAGSLNSPLKNTGSKVNAWESGKFTGNVLEISGMAEREHRYLSARYDSPEFAGFSGSVQYAPKDNSGSNGESYHVGLNYRNNGFFAQYAGLFQRYGEGTKKMEGYAYNIPSFVEKLQVHRLVGGYDNNALYVSVAAQQQDAKLYNSHNSQTEVAATVAYRFGNVTPRVSYAHGFKGTVDSADYDHTYDQVVVGAEYDFSKRTSALVSAGWLQEGKGAEKIVSTASAVVL

SEQ ID NO: 17556 - protein, 117 aa, Haemophilus parasuis
CGGAFGYKMDDIRVDVEGVYSYLNKNDVTDAKFTPDTIADSLTAISGLVNVYYDIAIEDMPITPYVGVGVGAAYISTPLKDAVNDQKSKFGFAGQVKAGVSYDVTPEVKLYAGARYF

SEQ ID NO: 17557 - protein, 180 aa, Moraxella catarrhalis
MKTLKTLLAVSASSLLAMSANAAISYGNSADAQPYVGAKIGQVDAKQINGKNTAYGIYAGYNFDQNFGVEAEFVGSDAKEFNAGMSPVKGDVKSFGAYGTYRYNFINTPFYAKGKLGIAKTKVDVTSRNATTYSNKSDKTSLAGGVGVGFKPLANVGVEASYNYLSEDANAISLGAHLAF

SEQ ID NO: 17558 - protein, 411 aa, Pseudoalteromonas tunicata
MDRCPGVVATEANSAQCGGRWRPREFEYWGIEPRLDISHNLFGVESDAVLGLRYHRETQDRNQFRGADPRFQSLSYAESFYGVNGGTGHREQVDIDVEAKSYYAQNTFYLGNWSLTPGIRVEDIRISTNVKRAEGQPQNNPESDLTNNQTKVLPGFGVAWSGIENTTVFAGVHRGFAPPRPDRDISAGGANTAVVAKTKPEESTNWELGIRSNYLKGISYETTLFHTQFDEIVISDGFGSFRNGGESQHSGIEVGGRIDFGTIYNTSHNFYISGAYTNLFTAKFKKTSLDDDIRSGDRLAYAPKHIASLSFGYEHPIGFNARIGVDYVSEQYEDVPFREGRSEYDPLSGQSGKIPSYTLVNASLSYRPIGSKATFFVSGHNLGDKEYLATRVDGMHAGRQRQVFGGVRYDF

SEQ ID NO: 17559 - protein, 282 aa, Ehrlichia canis
MNCKKVFITSALISFICFLPGVSFSNTIQDNNIVGNFYISGKYMPTVSHFGNFSAKEEKAETKKTFGLEKNYDGAKIEDNQVQNKFTISNYSFKYEDNPFLGFAGAIGYSMEGPRIELEVSYETFNVKNQDNSYKNDAHMYYLLAREVDSSSPTKPQVNKSVLLKNEGLTDFSIMLNACYDIITDNIPFSPYICAGVGADLVSMFNSINPKLAYQGKLGISYSISPEVSAFIGGHFHKVIGNEFKDIATILPSGSSIKDNQYAIVTLSVCHFGVEIGGRVSF

SEQ ID NO: 17560 - protein, 287 aa, Ehrlichia canis
MKYKKTFTVTALVLLTSFTHFIPFYSPARASTIHNFYISGKYMPTASHFGIFSAKEEQSFTKVLVGLDQRLSHNIINNNDTAKSLKVQNYSFKYKNNPFLGFAGAIGYSIGNSRIELEVSHEIFDTKNPGNNYLNDSHKYCALSHGSHICSDGNSGDWYTAKTDKFVLLKNEGLLDVSFMLNACYDITTEKMPFSPYICAGIGTDLISMFETTQNKISYQGKLGLNYTINSRVSVFAGGHFHKVIGNEFKGIPTLLPDGSNIKVQQSATVTLDVCHFGLEIGSRFFF

SEQ ID NO: 17561 - protein, 282 aa, Ehrlichia canis
  misc_feature (37)..(37): Xaa can be any naturally occurring amino acid
MNYKKILVRSALISLMSFLPYQSFAEPVSSNNIGNEXAKEGFYISAKYNPSIPHFRKFSAEETPVYGKDSPTKKVFGLKKDGSITKYSDFTRTDISFEGQNNFISGFSGSIGYIMDGPRVEIEAAYQKFNPKNPANETDTSDYYKHYGLSRAETMTDKKYVVLTNNGVTFSSLMFNACYDITAEGVPFIPYACAGIGADLISIFDDINLKFAYQGKIGISYPITPEISAFIGGYYHGVIGNKYNKIPVKLPVTLTDAPQSTSASVTLDAGYFGGELGVRFTF

SEQ ID NO: 17562 - protein, 289 aa, Ehrlichia canis
MLQRLNFINIILAFLLLLFPFQSFTLYIHDHEITQNVGLYISSQYKPSIPYFKNFLIEENSHKTVELMGLANDVTHVTEYVLKDNTKFNTPYSAKFRNSLINLSGAIGYYSGQGPRLEIEGSYENFDVASCKNCPVKNANRYIALVRDKKPGNIYPQDHSHSNMSYYTFIKNNGISILSVMINGCYDIAFSNVKISPYVCAGIGGDFITLFETMHIKFAYQGKFGISYLVSPSISIFANGHYHKVMDNVFKNLHVKYIYKLQDAPTITSARAKLRIGYFGSEVGVRFVF

SEQ ID NO: 17563 - protein, 764 aa, Ehrlichia canis
MNYAHRSVGAVIAMASLVGVAAHAKGVGAKEEGYGTAAVETLEADAGDAIVVTAQRRVQKLQDVGIAVSAFSGEQLRTRQISSSIDVARMTPGVFASSSNGGQTASISIRGVTQNDSSDAVEGPVAVYVDETYVPSLQGQGFGLFDIERVEALKGPQGTLFGRNATGGLVNFVIAKPSDTVTGYANGSYGSFDSVKLEGAIGGPIAETVQGRISLLYNRNNGWLKNLYPGKPDVGGEDTLGGRAQLQWQATDALKVRATASAVRSDLSTGAYNSISTQPVFDGQGRVVGADRVSGPTALGFTPLPGSRLEVNHDFACSDCGRTRLYDAALHVDYDAGGAQISAITNWKRITKALLIDVDSSPVNLVDVGQNAQTESFSQELRATGKADRAVWNLGVYYLQIHTLAQMGFLARPNGILAGALGVSGTGADLANLQDLWTRSFSGFGQIEYKLAPRLSGTIGLRVIHEWQRYDFQSSQFQNQNDYKLDTAIAVATLQPSYANKRSDSFWAGKAALEYHANRDMLLYASINRGAKGGNYNSKLPDGSPPLSPDEFAYKGETLLAYEGGMKSTWLDGKATFNLLGFIYDYSNYQAFTFSNASGFVQNRDANLYGGEAEFTLRPVEGLELSGGLSLLHAKVKNVQVATGVYKDVRPTFAPKRQANGRISYRPPLEVAGGHINLAVDGYSTSSFYQNIRNFAAHKISGHTIFGAQVGWESASGFSLTGAVSNLFDKRYEITGFDLSTLCGCSEVAYGKPRWWTISAGFRF

SEQ ID NO: 17564 - protein, 884 aa, Ehrlichia canis
MCMPNHSNFRLRGIACYIALAISGGSVNAWADDSIQFDPRFLELKGDTKIDLGKFSKKGYVDAGKYNLRVFINKQPLSDEYDINWYVSENDPTKNYACLTPELVAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKNWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGVADGWSLYGGALADKHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSADGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNADEHMMVFWEGSAQCEIVLPKPLPADLFSGLLLPCEQKGTAAPDSSAPEIKPVIQDQTRQVTPTEAPTSISATQ

SEQ ID NO: 17565 - protein, 226 aa, Shigella sonnei
MKLKFLLLLIPLLSAATHAGYVDYRHEYYDDGRNYDRIYMSHRFATGFGVAVEAISRSDDAQSNDAWNNMESNGNEYTASYQFTWQGLVWQPGIAIETGDNISIYKPYIRVQYNINDNWWTAFRYRQEYMRRNSDGKDDRMVYRPEAWLGYNVNNWMFELNGIYKIADSEDLYNNKKEDYEYNFRVAYKIGSWVPFVEMGNVSSGYNTTTTDDRQTRYRVGLGYNF

SEQ ID NO: 17566 - protein, 1102 aa, Shigella sonnei
MNQIHKFFCNMTQCSQGGAGELPTVKEKTCKLSFSPFVVGAFLLLGGPIAFAIPLSGTQELHFSEDNYEKLLTPVDGLSPLGAGEDGMDAWYITSSNPSHASRTKLRINSDIMISAGHGGAGDNNDGNSCGGNGGDSITGSDLSIINQGMILGGSGGSGADHNGDGGEAVTGDNLFIINGEIISGGHGGDSYSDSDGGNGGDAVTGVNLPIINKGTISGGNGGNNYGEGDGGNGGDAITGSSLSVINKGTFAGGNGGAAYGYGYDGYGGNAITGDNLSIINNGAILGGNGGHWGDAINGSNMTIANSGYIISGKEDDGTQNVAGNAIHITGGNNSLILHEGSVITGDVQVNNSSILKIINNDYTGTTPTIEGDLCAGDCTTVSLSGNKFTVSGDVSFGENSSLNLAGISSLEASGNMSFGNNVKVEAIINNWAQKDYKLLSADKGITGFSVSNISIINPLLTTGAIDYTKSYISDQNKLIYGLSWNDTDGDSHGEFNLKENAELTVSTILADNLSHHNINSWDGKSLTKSGEGTLILAEKNTYSGFTNINAGILKMGTVEAMTRTAGVIVNKGATLNLSGMNQTVNTLLNSGTVLINNINAPFLPDPVIVTGNMTLEKNGHVILNNSSSNVGQTYVQKGNWHGKGGILSLGAVLGNDNSKTDRLEIAGHASGITYVAVTNEGGSGDKTLEGVQIISTDSSDKNAFIQKGRIVAGSYDYRLKQGTVSGLNTNKWYLTSQMDNQESKQMSNQESTQMSSRRASSQLVSSLNLGEGSIHTWRPEAGSYIANLIAMNTMFSPSLYDRHGSTIVDPTTGQLSETTMWIRTVGGHNEHNLADRQLKTTANRMVYQIGGDILKTNFTDHDGLHVGIMGAYGYQDSKTHNKYTSYSSRGTVSGYTAGLYSSWFQDEKERTGLYMDAWLQYGWFNNTVKGNGLTGEKYSSKGITGALEVGYIYPTIRWTAHNNIDNALYLNPQVQITRHGVKANDYIEHNGTMVTSSGVNNIQAKLGLRTSLISQSCIDKETLRKFEPFLEVNWKWSSKQYGVIMNGMSNHQIGNRNVIELKTGVGGRLADNLSIWGNVSQQLGNNSYRDTQGILGVKYTF

SEQ ID NO: 17567 - protein, 841 aa, Shigella sonnei
MKFLVAASTIAIGSVALASAAHAQSTGSVDVEEAIVVTGTRADAAVNGFKAPETPKAKAVLTQELVARQNPGKAIFDTINIVPGVNFTSTDPYGAAGGNLRIRGFDGARISATFDGVQVNDSGNYSLYTNQQLDSELIEQVNINFGATDVDSPTASAAGGTVNYRTRLPKEELGAAINYSHGTFNYNRVFGVIDTGVFTPFGTRAFFSASDTKYDQFRGPGGIHKQQYNVRVYQPIGENGDFVSLAGHYNENRNNFYRRVGINDMRTLLGSATIPASASITPASPLDLGNLTDAQQETIFNFNNDATCTLPSSSGGAGQQSDASSCANYYNTSINPSNTGNIRFNSRFALSEKLIATLDASYQYVLANGGGTSVFAESDANRSVSGVYSRQGTRIGGGVASGVDINGDGDTDDLVRLLFPSNTRTHRLGATLSLRYEASPENTFRVAYTWDRAKHRQTGEAGRLDQLGNPLNVFGGIGDDDSAVKDAAGNVLQKRDRLSYAILHQVAGEYIGKYFDNTLTVQAGVRAPFFRRNLTNNCWTIAGSSNDAYCTSESDAVVEAKYPAYAAPYAARKVAYSAVLPNAGFVYKITPQVNVFGNFSQGFSAPRTDNLYGFDGVKIQPTSLVKPERTNSFDLGARYTSRVVQAQASAWYIGYKNRIISSQVLLEDGSSLNLDRNVGRVRSYGFDASVAVRPVDMFSLYTFASYTNAKLRDDVVSPAGAILSPTKGKFVAETPKWQVGGRAQFDYEPVSIGAQVKYVGDRFLTDINDVIAPSYTTVDLDARVNLGKVNDKGSIYLQLNVINLFDKFYIGNLSTQAAASNNPQVEFGSPRTFVGSIHFEF

SEQ ID NO: 17568 - protein, 774 aa, Shigella sonnei
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDANRWQSTRPYDRFWGRRKLASLGYQFQPDSQHKFNIQGFYTQTLRSGYLEQGKRITLSPRNYWVRGIELRYSQIFMIGPSAHEVGVGYRYVNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 17569 - protein, 234 aa, Shigella sonnei
MLMIIKKSGGRWQLSLLASVVISAFFLNTAYAWQQEYIVDTQPGHSTERYTWDSDHQPDYNDILSQRIQSSQRALGLEVNLAEETPVDVTSSMSMGWNFPLYEQVTTGPVAALHYDGTTTSMYNEFGDSTTTLTDPLWHASVSTLGWRVDSRLGDLRPWAQISYNQQFGENIWKAQSGLSRMTATNQNGNWLDVTVGADMLLNQNIAAYAALSQAENTTNNSDYLYTMGVSARF

SEQ ID NO: 17570 - protein, 732 aa, Shigella sonnei
MMRKKYMPRALGPLLLVVLSPAVAQQNDDNEIIVSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLGQELVGQVYYRDESLRYYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYDNFLFNAGLLMHITERQQAWFNFSQGVALPDPGKYYGRGIYGAAVNGHLPLTKSVNVSDSKLEGVKVDSYELGWRFIGDNLRTQIAAYYSLSNKSVERNKDLTISVKDDRRRIYGVEGAVDYLIPDTDWSTGVNFNVLKTESKVNGQWQKYDVKESSPSKATAYINWAPEPWSLRVQSTTSFDVSDAEGNDINGYTTVDFISSWQLPVGTLSFSVENLFDRDYTTVWGQRAPLYYSPGYGPASLYDYKGRGRTFGLNYSVLF

SEQ ID NO: 17571 - protein, 1285 aa, Shigella sonnei
MNKIYSLKYSHITGGLVAVSELTRKVSVGTSRKKVILGIILSSIYGSYGETAFAAMLDINNIWTRDYLDLAQNRGEFRPGATNVQLMMKDGKIFHFPELPVPDFSAVSNKGATTSIGGAYSVTATHNGTQHHAITTQSWDQTAYKASNRVSSGDFSVHRLNKFVVETTGVTESADFSLSPEDAMKRYGVNYNGKEQIIGFRAGAGTTSTILNGKQYLFGQNYNPDLLSASLFNLDWKNKSYIYTNRTPFKNSPIFGDSGSGSYLYDKEQQKWVFHGVTSTVGFISSTNIAWTNYSLFNNILVNNLKKNFTNTMQLDGKKQELSSIIKDKDLSVSGGGVLTLKQDTDLGIGGLIFDKNQTYKVYGKDKSYKGAGIDIDNNTTVEWNVKGVAGDNLHKIGSGTLDVKIAQGNNLKIGNGTVILSAEKAFNKIYMAGGKGTVKINAKDALSESGNGEIYFTRNGGTLDLNGYDQSFQKIAATDAGTTVTNSNVKQSTLSLTNTDAYMYHGNVSGNISINHIINTTQQHNNNANLIFDGSVDIKNDISVRNAQLTLQGHATEHAIFKEGNNNCPIPFLCQKDYSAAIKDQESTVNKRYNTEYKSNNQIASFSQPDWESRKFNFRKLNLENATLSIGRDANVKGHIEAKNSQIVLGNKTAYIDMFSGRNITGEGFGFRQQLRSGDSAGESSFNGSLSAQNSKITVGDKSTVTMTGALSLINTDLIINKGATVTAQGKMYVDKAIELAGTLTLTGTPTENNKYSPAIYMSDGYNMTEDGATLKAQNYAWVNGNIKSDKKASILFGVDQYKEDNLDKTTHTPLATGLLGGFDTSYTGGIDAPAASASMYNTLWRVNGQSALQSLKTRDSLLLFSNIENSGFHTVTVNTLDATNTAVIMRADLSQSVNQSDKLIVKNQLTGSNNSLSVDIQKVGNNNSGLNVDLITAPKGSNKEIFKASTQAIGFSNISPVISTKEDQEHTTWTLTGYKVAENTASSGAAKSYMSGNYKAFLTEVNNLNKRMGDLRDTNGEAGAWARIMSGAGSASGGYSDNYTHVQIGVDKKHELDGLDLFTGLTMTYTDSHASSNAFSGKTKSVGAGLYASAIFDSGAYIDLISKYVHHDNEYSATFAGLGTKDYSSHSLYVGAEAGYRYHVTEDSWIEPQAELVYGAVSGKRFDWQDRGMSVTMKDKDFNPLIGRTGVDVGKSFSGKDWKVTARAGLGYQFDLFANGETVLRDASGEKRIKGEKDGRILMNVGLNAEIRDNLRFGLEFEKSAFGKYNVDNAINANFRYSF

SEQ ID NO: 17572 - protein, 753 aa, Shigella sonnei
MNVIKLAIGSGILLLSCGAYSQSISEKTNSDKKGAAEFSPLSVSVGKTTSEQEALEKTGATSSRTTDKNLQSLDATVRSMPGTYTQIDPGQGAISVNIRGMSGFGRVNTMVDGITQSFYGTSTSGTTTHGSTNNMAGVLIDPNLLVAVDVTRGDSSGSEGINALAGSANMRTIGVDDVIFNGNTYGLRSRFSVGSNGLGRSGMIALGGKSDAFTDTGSIGVMAAVSGSSVYSNFSNGSGINSKEFGYDKYMKQNPKSQLYKMDIRPDEFNSFELSARTYENKFTRRDITSDDYYIKYHYTPFSELIDFNVTASTSRGNQKYRDGSLYTFYKTSAQNRSDALDINNTSRFTVADNDLEFMLGSKLMRTRYDRTIHSAAGDPKANQESIENNPFAPSGQQDISALYTGLKVTRGIWEADFNLNYTRNRITGYKPACDSRVICVPQGSYDIDDKEGGFNPSVQLSAQVTPWLQPFIGYSKSMRAPNIQEMFFSNSGGASMNPFLKPERAETWQAGFNIDTRDLLVEQDALRFKALAYRSRIQNYIYSESYLVCSGGRKCSLPEVIGNGWEGISDEYSDNMYIYVNSASDVIAKGFELEMDYDAGFAFGRLSFSQQQTDQPTSIASTHFGAGDITELPRKYMTLDTGVRFFDNALTLGTIIKYTGKARRLSPDFEQDEHTGAIIKQDLPQIPTIIDLYGTYEYNRNLTLKLSVQNLMNRDYSEALNKLNMMPGLGDETHPANSARGRTWIFGGDIRF

SEQ ID NO: 17573 - protein, 360 aa, Shigella sonnei
MKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTDGQVAYGKSKFNASGKNAEVWAAGLKYDANNIYLATTYSETQNMTVFGNNHIANKAQNFEAVAQYQFDFGLRPSVAYLQSKGKDLGVHGDRDLVKYVDVGATYYFNKNMSTFVDYKINLIDDSKFTKTAGIDTDDIVAVGLVYQF

SEQ ID NO: 17574 - protein, 199 aa, Shigella sonnei
MRKVCAAILSAAICLAVSGAPAWASEHQSTLSAGYLHARTNVPGSDDLNGINVKYRYEFTDTLGLVTSFSYAGDKNRQLTHYSDTRWHEDSVRNRWFSVMAGPSVRVNEWFSAYAMAGVAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 17575 - protein, 374 aa, Shigella sonnei
MKVKVLSLLVPALLVAGAANAAEVYNKDGNKLDLYGKVDGLHYFSDNKSEDGDQTYVRLGFKGETQVTDQLTGYGQWEYQIQGNTSEDNKENSWTRVAFAGLKFQDVGSFDYGRNYGVVYDVTSWTDVLPEFGGDTYGSDNFMQQRGNGYATYRNTDFFGLVDGLNFAVQYQGKNGSVSGEGMTNNGRGALRQNGDGVGGSITYDYEGFGIGAAVSSSKRTDDQNFGLNGYGERYLGNGDRAETYTGGLKYDANNIYLAAQYTQTYNATRVGSLGWANKAQNFEAVAQYQFDFGLRPSVAYLQSKGKNLGVVAGRNYDDEDILKYVDVGATYYFNKNMSTYVDYKINLLDDNQFTRDAGINTDNIVALGLVYQF

SEQ ID NO: 17576 - protein, 663 aa, Shigella sonnei
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQERDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 17577 - protein, 217 aa, Shigella sonnei
MKKLTVAALAVTTLLSGNAFAHEAGEFFIRAGSATVRPTEGAGGTLGSLGGFSVTNNTQLGLTFTYMATDNIGVELLAASPFRHKVGTATTGDIATVHHLPPTLMAQWYFGDSSSKFRPYVGAGINYTTFFDNGFNDTGKSLGLSDLSLKDSWGMAGQVGVDYLINRDWLLNMSVWYMDIDTDVKYKSNGAVLPAGHYSDNVRLDPWVFMFSAGYRF

SEQ ID NO: 17578 - protein, 199 aa, Shigella sonnei
MRKVCAAILSAAICLAVSGAPAWASEHQSTLSAGYLQPHTDMPGSDDLKGINVKYRYEFTDTLGLVTSFSYANAEDEQKTHYSDTRWHEDSVRNRWFSVMAGPSVRVNEWFSAYAMAGVAYSRVSTFSGDYLRVTDNKGKTHDVLTGSDDNRHSNTSLAWGAGVQFNPTESVAIDLAYEGSGSGDWRTDGFIVGVGYKF

SEQ ID NO: 17579 - protein, 377 aa, Shigella sonnei
MKSKVLALLIPALLAAGAAHAAEVYNKDGNKLDLYGKVDGLHYFSDNSAKDGDQSYARLGFKGETQINDQLTGYGQWEYNIQANNTESSKNQSWTRLAFAGLKFADYGSFDYGRNYGVMYDIEGWTDMLPEFGGDSYTNADNFMTGRANGVATYRNTDFFGLVNGLNFAVQYQGNNEGASNGQEGTNNGRDVRHENGDGWGFSTTYDLGMGFSAGAAYTSSDRTNDQVNHTAAGGDKADAWTAGLKYDANNIYLATMYSETRNMTPFGDSDYAVANKTQNFEVTAQYQFDFGLRPAVSFLMSKGRDLHAAGGADNPAGVDDKDLVKYADVGATYYFNKNMSTYVDYKINLLDEDDSFYAANGISTDDIVALGLVYQF

SEQ ID NO: 17580 - protein, 687 aa, Shigella sonnei
MKIFSILYIAAVTSTAFAQEAPATSPDVVNLPTIQVLSERQEEVLKTPGAVTVVTQDELKKNKPTSAQDAVKRTAGANVIEAEGVAYIGMRGLSPDGSRKVLLLEDGAPLALGPYIDSSAYYAPIVERMERIDIRKGSSSLAFGPSTIGGVINYLTKNPTKDHGNAVTLTGGSRDYKALLIEGSSVKDGTGLLLNIFAKDGNGSRDNSHFKTQDVLVKYGGALSDKSYIGIKLSHYKSEAQLTYLGLTQKLYEEDPYQNPAKDDILYINRYEMNLTHDYQINGDSRLATLFYVNQTARDWWRQNFSKDGAGNISMTAGNKGRNRTFDVAGIDSRYFLNWNAGEVTNDLQVGLRLHTEDMRNVEVKGATSTSRSGVIDTDDKRFADAQTLYAENAFNLERWTITPGVRIESYRQSRMIYRKSSADFNQGSATRNTEYLGGMGAAYELTKQEFLFAGVHQGFAPPRVQDSIDNNGQAVDLSAERSVNVELGYRSQRDNFQMEAALFQLDFSNQLIQATESGGASSTLTNGGKTLHQGLELSTRYSPEFDRSLIIDVNATYLPVAKFNSTRIISSEDRNGNRLPYAPEYMFNAALGYKRQAWFTQLQYAFVSEQYADAENTVEGSVDGMRGVLPAYGLFHLTGEYQATRDLTLELSVRNLADTTYIASRAPQGIFPGMRRTAFLGLKTEF

SEQ ID NO: 17581 - protein, 96 aa, Shigella sonnei
MKLKIVAVVVTGLLAANVAHAAEVYNKDGNKLDLYGKVTALRYFTDDKRDDGDKTYARLGFKGETQINDQMIGFGHWEYDFKGYNDEANGSRGKNL

SEQ ID NO: 17582 - protein, 790 aa, Shigella sonnei
MKRVLIPGVILCGADVAQAVDDKNMYMHFFEEMTVYAPVPVPVNGNTHYTSESIERLPTGNGNISDLLRTNPAVRMDSTQSTSLNQGDIRPEKISIHGASPYQNAYLIDGISATNNLNPANESDASSATNISGMSQGYYLDVSLLDNVTLYDSFVPVEFGRFNGGVIDAKIKRFNADDSKVKLGYRTTRSDWLTSHIDENNKSAFNQGSSGSTYYSPDFKKNFYTLSFNQELADNFGVTAGLSRRQSDITRADYVSNDGIVAGRAQYKNVIDTALSKFTWFASDRFTHDLTLKYTGSSRDYNTSTFPQSDREMGNKSYGLAWDMDTQLAWAKLRTTVGWDHISDYTRHDHDIWYTELSCTYGDITGRCTRGGLGHISQAVDNYTFKTRLDWQKFAVGNVSHQPYFGAEYIYSDAWTERHNQSESYVINAAGKKTNHTIYLKGKGRLGIDNYTLYMADRISWRNVSLMPGVRYDYDNYLSNHNISPRFMTEWDIFANQTSMITAGYNRYYGGNILDMGLRDIRNSWTESVSGNKTLTRYQDLKTPYNDELAMGLQQKIGKNVIARANYVYREAHDQISKSSRTDSATKTTITEYNNDGKTKTHSFSLSFELAEPLHIRQVDINPQIVFSYIKSKGNLSLNNGYEESNTGDNQVVYNGNLVSYDSVPVADFNNPLKISLNMDFTHQPSGLVWANTLAWQEARKARIMLGKTNAQYISEYSDYKQYVDEKLDSSLTWDTRLSWTPQFLQQQNLTISADILNVLDSKTAVDTTNTGVATYASGRTFWLDVSMKF

SEQ ID NO: 17583 - protein, 421 aa, Shigella sonnei
MRKIVAIAVICLTAASGLTSAYAAQLADDEAGLRIRLKNELRRADKPSAGTGRDIYAWVQGGLLDFNSGYYSNIIGVEGGAYYVYKLGARADMSTRWYLDGDKSFGFALGAVKIKPSENSLLKLGRFGTDYSYGSLPYRIPLMAGSSQRTLPTVSEGALGYWALTPNIDLWGMWRSRVFLWTDSTTGIRDEGVYNSQTGKYDKHRARSFLAASWHDDTSRYSLGASVQKDVSNQIQSILEKSIPLDPNYTLKGELLGFYAQLEGLSRNTSQPNETALVSGQLTWNAPWGSVFGSGGYLRHAMNGAVVDTDIGYPFSLSLDRNREGMQSWQLGVNYRLTPQFTLTFAPIVTRGYESSKRDVRIEGAGILGGMNYRVSEGPLQGMNFFLAADKGREKRDGSTLGDRLNYWDVKMSIQYDFMLK

SEQ ID NO: 17584 - protein, 729 aa, Shigella sonnei
MLSTQFNRDNQHQAIIKSSLLAGCIALALLPSAAFAAPVTEETVIVEGSATAPDDGENDYNVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTMLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLTPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRSTIKMFTSYRLPVMLELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 17585 - protein, 362 aa, Shigella sonnei
MMKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQPLGNGKKAEQWATGLKYDANNIYLAANYGETRNATPITNKFTNTSGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 17586 - protein, 468 aa, Shigella sonnei
MRTFSGERSTLALAIAGITAMSGWIVVPQAQASGFFDDSTLTGGIYYWQRERDRKDVTDGDKYKTNLSHATWNANLDFQSGYAADMFGLDIAAFTAIEMAENGDSGHPNEIAFSKKNKGYDEDYSGDKSGISLYKAAAKFKYGPVWARAGYIQPTGQTLLAPHWSFMPGTYQGAEAGASFDYGDAGALSFSYMWTNEYKAPWHTEMDKFYQADKKTNVDYLHSIGAKYDFKNDLVLEAAFGQSEGYVDQYFAKASYKFDLGGNPFTTSYQFYGARDKVDDRSVNDIYDGTAWLQALTFGYKVAEVVDLRLEGTWVKADGQQGYFLQRMTPTYASSNGRLDIWWDNRSDFNANGEKAVFFGAMYDLKNWNLPGWAVGASYVYAWDAKPATWQSNPDAYYDKNRTIEESSYSLDAVYTLQEGRAKGTMFKLHFTEYDNHSNIPSWGGGYGNIFQDERDVKFIVIAPFTIF

SEQ ID NO: 17587 - protein, 378 aa, Shigella sonnei
MESLPNVLVNNTGGDLNIISSDSILNGATKLVSGTTTLKLSENTIWNMKDDSVVTHLTNSDSIINLSYDDGQTFTQGKTLTVKGNYVGNNGQLNIRTVLGDDKSATDRLIVEGNTSGSTTVYVKNAGGSGAATLNGIELITVNGDESPAEAFRQGDARIAAGAFEYQLKQQGKNWYLTSYQSVNEEDNSSEGNSEPTETPTPVLRPEAGSYVANLAAANTLFVMRLNDRAGEMRYIDPVTEQERSSRLWLRQIGGHNAWRDSNGQLRTTSHRYVSQLGADLLTGGFTDSDSWRLGVMAGYARDYNSTHSSVSDYRSKGSVRGYCAGLYATWFADDISKKGAYIDAWAQYSWFKNSVKGDELAYESYSAKGATVSLEAG

SEQ ID NO: 17588 - protein, 746 aa, Shigella sonnei
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQVLTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 17589 - protein, 294 aa, Shigella sonnei
MKKTLLAAGAVLALSSSFTVNAAENDKPQYLSDWWHQSVNVVGSYHTRFGPQIRNDTYLEYEAFAKKDWFDFYGYADAPVFFGGNSDAKGIWNHGSPLFMEIEPRFSIDKLTNTDLSFGPFKEWYFANNYIYDMGRNKDGRQSTWYMGLGTDIDTGLPMSLSMNIYAKYQWQNYGAANENEWDGYRFKIKYFVPITDLWGGQLSYIGFTNFDWGSDLGDDSGNAINGIKTRTNNSIASSHILALNYDHWHYSVVARYWHDGGQWNDDAELNFGNGNFNVRSTGWGGYLVVGYNF

SEQ ID NO: 17590 - protein, 1000 aa, Shigella sonnei
MHSWKKKLVVSQLALACTLAITSQANAATNDISGQTYNTFHHYNDATYADDVYYDGYVGWNNYAADSYYNGDIYPVINNATVNGVISTYYLDDGISTNTNANSLTIKNSTIHGMIYSECMTTDCADRADDYYHDRLALTVDNSTIDDNYEHYTYNGTYNNAADTHVVDVYNIGTAITLDQEVDLSITNNSHVAGITLTQGYEWEDIDDNTVSTGVNSSEVFNNTITVKDSTVTSGSWTDEGTTGWFGNTGNASDYSGKSNFVTVDTDGDGVADSTIASWDDVALAVVAHPNADNAMQTTADFSNSTLMGDVIFSSNFDENFFPRGADSYRDADGEVDTNGWDGTDRLDLTLNNGSKWVGAAQSVHQTGSIDVDGDGKGDIATYGVGTEATATLIDIEDNSLWPLSTVGVENDDTSYSEFDHITGNQVYQSGLFNVTLNTGSQWDTTKTSLIDTLSINSGSTVNVADSTLISDSISLTGLSALNINEDGHVATDSLTVDNSTVTISDEVSAGWAVGDAALYANNIKVTNDGILDVGNTAANALQVDTLNLTSTTDTSGNIHAGVFNIESNRFVLDADLTNDRTNDTTKSNYGYGLIAMNSDGHLTINGNGDNDNTASIEAGQNEVDNNGDHVAAATGNYKVRIDNATGAGSIADYNGNELIYVNDKNSNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYGSISGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 17591 - protein, 729 aa, Shigella sonnei
MARSKTAQPKHSLRKIAVVVATAVSGMSVYAQAAVEPKEDTITVTAAPAPQESAWGPAATIAAKHSATATKTDTPIEKTPQSISVVTNEEMQMHQFQSVKEALGYTPGVTVSSRGASNTYDFVIIRGFSSVGLNQNNYLDGLKLQGNFYNDAVIDPYMLERVELMRGPTSVLYGKSNPGGIISMVSKRPTTEPLKEIQFKMGTDNLFQTGFDFSDALDDNGEFSYRLTGLARSTNEQQKNSESQRYTIAPSFSWRPDDKTNFTFLSYFQNEPETGYYGWLPKEGTVEPLPNGKRLPTDFNEGASNNTYSRNQKMVGYSFEHGFNDTFTVRQNLRFSEMKTSQKSVYGTGIANDGHTLNRGTVVDNERLQNFSVDTQLESKFATGEVEHTLLTGVDFMRMRNDINASFGSAPSIDLYNKYHPEYFAFGNAEPYQMNESKQTGIYVQDQAEWNKWVFTLGGRYDWSKQATTVRENSYTPTEGYIERNDHQFTWRGGVNYLFDNGISPYFSYSQSFEPSAFDLWSNPRVSYKPSKGEQYEAGVKYVPNDMPVVVTGAVYQLTKTNNLTADPTNPLAQVPAGEIRARGVELEAKAALNANINLTASYTYTDAEYTKDTNLKGKTPEQVPEHMASLWGDYTFNEGPLSGLTLGTGGRFIGSSYGDPANTFKVGSAAVMDAVVKYDLARFGMAGSSLAVNVNNLLDREYVASCFQTYGCFWGAERQVVATATFRF

SEQ ID NO: 17592 - protein, 283 aa, Anaplasma ovis
MNYRELFTGGLSAATVCACSLLVSGAVVASPMSHEVASEGSGVMGGSFYVSAAYSPAFPPVTSFDMRESSRETSYVRGYDKSVATIDVSAPANFSKSGYTFALSKNLLTSFDGAVGYSLGGARVELEASYRRFATLADGQYAKSGAESLAAITRDAVITENNYFVVKIDEITNTSVMLNGCYDVLHTDLPVSPYVCAGIGASFVDISKQVTTKLAYRGKVGISYQFTPEISLVVGGFYHGLFDESYKDIPAHNSVKFPGEAKASVKAHIADYGFNLGARFLFS

SEQ ID NO: 17593 - protein, 282 aa, Anaplasma marginale
MNYRELFTGGLSAATVCACSLLVSGAVVASPMSHEVASEGGVMGGSFYVGAAYSPAFPSVTSFDMRESSKETSYVRGYGKSIATIDVSVPANFSKSGYTFAFSKNLITSFDGAVGYSLGGARVELEASYRRFATLADGQYAKSGADSLAAITRDANITETNYFVVKIDEITNTSVMLNGCYDVPHTDLPVSPYVCAGIGASFVDISKQVTTKLAYRGKVGISYQFTPEISLVAGGFYHGLFDESYKDIPAHNSVKFSGEAKALVKAHIADYGFNLGARFLFS

SEQ ID NO: 17594 - protein, 1300 aa, Escherichia coli
MNKIYSLKYSHITGGLIAVSELSGRVSSRATGKKKHKRILALCFLGLLQSSYSFASQMDISNFYIRDYMDFAQNKGIFQAGATNIEIVKKDGSTLKLPEVPFPDFSPVANKGSTTSIGGAYSITATHNTKNHHSVATQNWGNSTYKQTDWNTSHPDFAVSRLDKFVVETRGATEGADISLSKQQALERYGVNYKGEKKLIAFRAGSGVVSVKKNGRITPFNEVSYKPEMLNGSFVHIDDWSGWLILTNNQFDEFNNIASQGDSGSALFVYDNQKKKWVVAGTVWGIYNYANGKNHAAYSKWNQTTIDNLKNKYSYNVDMSGAQVATIENGKLTGTGSDTTDIKNKDLIFTGGGDILLKSSFDNGAGGLVFNDKKTYRVNGDDFTFKGAGVDTRNGSTVEWNIRYDNKDNLHKIGDGTLDVRKTQNTNLKTGEGLVILGAEKTFNNIYITSGDGTVRLNAENALSGGEYNGIFFAKNGGTLDLNGYNQSFNKIAATDSGAVITNTSTKKSILSLNNTADYIYHGNINGNLDVLQHHETKKENRRLILDGGVDTTNDISLRNTQLSMQGHATEHAIYRDGAFSCSLPAPMRFLCGSDYVAGMQNTEADAVKQNGNAYKTNNAVSDLSQPDWETGTFRFGTLHLENSDFSVGRNANVIGDIQASKSNITIGDTTAYIDLHAGKNITGDGFGFRQNIVRGNSQGETLFTGGITAEDSTIVIKDKAKALFSNYVYLLNTKATIENGADVTTQSGMFSTSDISISGNLSMTGNPDKDNKFEPSIYLNDASYLLTDDSARLVAKNKASVVGDIHSTKSASIMFGHDESDLSQLSDRTSKGLALGLLGGFDVSYRGSVNAPSASATMNNTWWQLTGDSALKTLKSTNSMVYFTDSANNKKFHTLTVDELATSNSAYAMRTNLSESDKLEVKKHLSGENNILLVDFLQKPTPEKQLNIELVSAPKDTNENVFKASKQTIGFSDVTPVITTRETDDKITWSLTGYNTVANKEATRNAAALFSVDYKAFLNEVNNLNKRMGDLRDINGEAGAWARIMSGTGSASGGFSDNYTHVQVGVDKKHELDGLDLFTGFTVTHTDSSASADVFSGKTKSVGAGLYASAMVDSGAYIDLIGKYVHHDNEYTATFAGLGTRDYSTHSWYAGAEAGYRYHVTEDAWIEPQAELVYGSVSGKQFAWKDQGMHLSMKDKDYNPLIGRTGVDVGKSFSGKDWKVTARAGLGYQFDLLANGETVLRDASGEKRIKGEKDSRMLMSVGLNAEIRDNVRFGLEFEKSAFGKYNVDNAVNANFRYSF

SEQ ID NO: 17595 - protein, 1001 aa, Escherichia coli
MYMKQSMKSKGFERRLLLIMWGLFLSLSAFAQQISIKGHVVDATGEPVIGASVVEGRTTNGTITDVDGNFSLSVPANSTLTISFVGYKTQTVPVNGKNSLKVTLQEDTEVLDEVVVVGYGTMKKSDLTGAVSSVGVKDIKDSPVANIGQAMQGKVSGVQIIDAGKPGDNVTIKIRGLGTINNSNPLIVIDGIPTDLGLSSLNMADVERVDVLKDASATAIYGSRGANGVVMITSKRGAEGAGKVTVNANWAIQNATKVPDMLNAAQYAALSNDMLSNNDDNTNPYWADPSLLGTGTNWLDEMLRTGVKQSYSVSYSGGTEKAHYYVSGGFLDQSGIVESVNYRRFNFQANSDAQVNKWLKFTTNLTFSTDVKEGGSYSIGDAMKALPTQPVKNEDGGWSGPGQEAQWYGSVRNPIGTLYMMTNETKGYNFLANITGEIAFTKWLKLKSTFGYDAKFWFVDNFTPAYDWKPNPVEESSRYKSDNKSFTYLWDNYFVFDHTFAQKHRVGVMAGSSAQWNNYDYLNAQKNIFMFDNIHEMDNGEKMYSIGGSQSDWALLSLMARLNYSYEDKYLLTATVRRDGSSRFGKNNRWGTFPSVSLAWRISQEEWFPKDNSPVNDLKLRIGYGVTGNQEIGNYGFVASYNTGVYPFGNNNSTALVSTTLSNPNIHWEEVRQTNFGVDMSLFNSRVNLSLDAYIKKTADMLVKASIPITSGFEDTTETFTNAGKMRNKGVEMTLRTINLKGLFSWESALTATYNKNEILDLNSETPMFINQMGNSYVTMLRAGYPINVFYGYVTDGLFQNWEEVNRHATQPGAAPGDIRFRDLNNDGVINDEDRTVIGNPNPNWFFSLSNNFSYKGWELSVFLQGVSGNKIYNANNVDNEGMAAAYNQTTAVLNRWTGEGTSNSMPRAIWGDPNQNCRVSDRFVENGSYLRLKNITLSYTLPKKWMQKIQLENARISFSCENVATITGYSGFDPEVDINGIDSSRYPISRTFSMGLNFNF

SEQ ID NO: 17596 - protein, 1046 aa, Porphyromonas gingivalis
MKRMTLFFLCLLTSIGWAMAQNRTVKGTVISSEDNEPLIGANVVVVGNTTIGAATDLDGNFTLSVPANAKMLRVSYSGMTTKEVAIANVMKIVLDPDSKVLEQVVVLGYGTGQKLSTVSGSVAKVSSEKLAEKPVANIMDALQGQVAGMQVITGSGDPTAVASVKIHGSGSLTSSSAPLYIVDGVPTDLGVVAGMNPNDFESFTILKDASSTSIYGARAANGVIVITTKRGKMGERGRITFNASYGVSSIINKKPFKSMMTGDEFARWQYGVGYAAADQYSTFEAWKDHIKEDAKQALINYSPYLEDQIKKGILDPINFDKDTDWLGYHFRTAPTTQGDVSIQGGSQGTSYFLSLGYFDQEGISRSESLLKRYTGRLNLESRVNDWLKVGANMSAALAKRRASGFASSAYISEGSFAALVAAPYLNPYTTSGDFAEAYYMDFQDKVIFGIPHRDSYRPYNREAYQATMSGYAQLTPIKGLTLKAQAGFDFLQERTSSKLLPNNPLALDPLGTSRERFYHYLTKTFTNTAEYKFSVEDKHDVTLLAGHEFIDYEYDMFGALGKGYENPKFMMLSQAKGDTYLTLPEQAKAEYAYLSFFGRGSYGFDKWLYVDLSVRNDRSSRFGANKRSAMFGSGGVMMDVFNKFIKESTWLSDLRFKMSYGTTGNSEMRNYTTGNPEYYAHLALVGSNPYTDNALGLSVATPGNPNLSWEQQSQFNVGVASSFFDGRLNAELDFYVRATDDMLIEVPLPYLSGFTAQLQNVGAMKNTGFDITVSGDIVRSKDFKVYGSATFNYNREEITRLFSGLKEYVRDGYSYSWIVGKPTVFYCAEYAGVYKGQAGPNYVDAEGKPFKGGDQMWYVPGEYNEDGSRKLTNKYSSSLEHALTDKALTPPVTGGFSLGASWKDLSLDADFSYILGKWMINNDRYFTENTSPGFNFTNKDKMILNAWTQQNSDSDVPRIGQSMHFDSRLLENASFLRMKNLKLTYNLPQNLFAGQNVLSGARVYLMARNLFTITKFKGFDPEAGANLSMNQYPNTKQYVAGIQLSF

SEQ ID NO: 17597 - protein, 798 aa, Ehrlichia chaffeensis str. Sapulpa
MSVKIRTFYKGLIACLAAAALPHAALAQGATDLGTVSVEAAAARGEGAGDRGAPLLAEQNGTAAATTLRREDIARQPGTANLAQRIGGIAGVNSYSRDPSGLFGGGYSIRGFDSTQIGLSLNGVPLNDPGTFSVLPQIYTDSENLCAVDVTQGTSAGTVAQHGAIGGQVSMEQCRPADAPAVTFSQSFGSYFLNKTFLRANTGPLFDEVLKGYVSYSHARSDYFAGPGEAERHHVDSRFDVKLDNGGSISFTSFYNEFANTFVRTVTKDQYQAFGYRNGWLRTPPTILTGPGAVFSAIGLAVTPTPANTGYSGYSWEPGRHAYASIDGRFPLSDGVELRLTPYFLHQESGSTSEIVLKEAGYAGKLLSSPIGAFSAYGTRGTNALLGQMSQSDFDRVGNVVSLTGRLDNHTVTGSLWTEYTYQHQMNPFQQIDQTNNTLPDIWFKSNLLRGFDGNIVTNRNWKTDYYNTTVAISDSISLLDDAMHVDLSLRQKFYSRSFHNLPSGTSTRTDSYLDYTVNRSYAFLLPAVGMRYDLDAANQVFANASMNARVPPNFADGRLVNGATNLIQVPTIKAERALSFDLGYRLKGDFLDVNATGFLIKYSDRIAQTANGDGSLSSKYTNIGSTTAVGAEVEVATKPYEGWSVLLSQAINHDTIDGNIVPDPKSPALRTKGKFYFNSPLSLTASTVMYENGPFFAFARAKYTSEVYATLTNDISLPGYATVDLGLGYKLKGTSLVEAIPGAQDGLFKLNVTNLFNKKYIYINPGNTTGFALSAANAPSFYLGSPFAVTASLTLDF

SEQ ID NO: 17598 - protein, 272 aa, Ehrlichia chaffeensis str. Sapulpa
MNNKKSHVICMLIFLLLPMKSFSVLIDTTEKDYASNVYISSQYKPSFSNFRSFSIQEINSKTKNSIALEKPIESNSNILKSNAHIIVPHNIQFQDNTISFSGAVGYSSKGLRLELESAYEEFYTKELNSSSLISSNNHYTQLYEANFQNFATSRLSITSFIINTCYDILIGSSPVMPYICTGIGGDIIRLFNTTYLKFAYQGKFGISYPLNNNIILFSDIYYHEIIGQEFENLYTQYVSGINSLQEITSVPASFNIGYFGSEIGVRFIFNKQ

SEQ ID NO: 17599 - protein, 796 aa, Ehrlichia chaffeensis str. Sapulpa
MTKKFIFLLLLMFTGLQIMQAQQTYSIKGIVKDAANGEPVSFANVVIWNTIEGTVTDSIGQFEITGVSPGSYRLQASFIGYKPTVTAEFRISNKDMFFPIELEESSESLQEVSIVASPFRKTAESPLGLRVIGFKEIEKSAGGNRDISRVVQSFPGVASTAAFRNDLMVRGGGPSENRFFLDGVEIPNINHFSTQGASGGPVGIINPDFIREVDFYSAAYPAARGNALSSVLDFKLQDGNKEKFSLRGVIGASDIGFSANGPAGKKTTYQVSIRRSYLQFLFDMIGLPFLPTFTDAQFKVKHTFDRKNELAILGLGAIDDMKLNTGMEDMSEKNQYILAYLPVVKQKTYTLGAVYKHYSGKNIYSLIVSRSQLNNKNIKYRDNDESSEENLTLNYRSDEIENKLRSENIFRFPFFRLNVGGNLEYATYTNRTYQKQFTTIPRVINYHTDLGLLKWGLYATAIYESDNERFTASLGVRADANDYSPEMNNLLDQLSPRLSLSYRLFGAVYLNGSIGRYYELPPYTVLGFKDNQGNYLNKANHLTYIRSDQAGLGLEYRPSSYLKFSAEGFYKKYDQYPMSLVDSIPLASKGTDYGVLGNEAVSSTATGRAYGLELTGRWYNYKGLTFIASYTYVRSEFKDGRGSRKYIPSAWDNRHLFTFSGTYALPKNWDIGAKLRVVGGAPYTPYDVEKSSLVEAWDASGSLYYDYSRFNSERLKPFTQLDIRIDKTFYLKKFMLGAYIDIQNILNSKYKEQDVYIKTGKILNPDAPLDQQRYELKPVERRTGTLLPSIGLMIEF

SEQ ID NO: 17600 - protein, 839 aa, Cupriavidus metallidurans
MTHSYSTTGNRVGAAARDYGRRGSMAALAAAVLMSVAVAPVAAQTPRGDVPIHIEAQPLADALLQLGRQTSLQLYFPPELVAGKRAPAVNGTMRPEAALDSLLKGSGIQYQRSGNQGFVLRPVSAAPAAAPPVPSDTLHATAQPTTVLAPVEVTASRTSSDLVRPTRQSTVLERTELEELKTGSDSLATVLSKVIPGMADSSHTVTDFGQTLRGRGMLVLLDGIPLNTNRDSARNLANIDPALVERVEVLRGSSAIYGGGATGGIVSITTRPAGGEPKADTTVTMSTPLSRLRADGLSANVQQHFSGSSGMLDYAFDLGARHIGNSYDAKGQRIAPEPSQGDLFDSNNYNVGGKLGLRFAPDQRIQLAFSHFDAKQDTRWASDPSVAKLPPGSVPARALDGLQLADQNQIRNTLVNLEYEHRDLLGSQLSAQFYYRNYYSRFTPFDARAVPVRGGNVDQAMQDSEVFGSRLTVKTPLGADKRTRVIWGMDFEQETSDMPIDIFDLKAYDASGGRIFNKIGTLTYMPPITTRSIGGFAQLQHKFNEQWSTEGGLRYQYARASFSDFVPLSQSRVTNPATVSGGAVDYSAVLGNIGVAYKPVKDHEFYAAFSQGFNLPDIGLQVRNARAGFDIGSSDLQPVKTNNYELGWRGAFGNTLGSLAIFYTTSDLGDVQSFNNGLILTRTAEKIYGVEASADYLSTDERWGAGGTFTWMQGRETPQGRDSQQMTGYRIPPLKLTGYVQYRPVPQWNNRLQATFFAGYDYRLNGVTSFGRRDVSSYTTLDLISSYQVTKKDTVTVGIQNLLNRYYYPLYSQLLRNSNNTSHLPAAGITLTATYQHRW

SEQ ID NO: 17601 - protein, 931 aa, Actinobacillus pleuropneumoniae
MKNKLNLISLALLSLFAVQSYAEQAVQLNDVYVTGTKKKAHKKENEVTGLGKVVKTPDTLSKEQVLGIRDLTRYDPGISVVEQGRGATTGYSIRGVDRNRVGLALDGLPQIQSYVSQYSRSSSGAINEIEYENLRSIQISKGASSSEFGSGSLGGSVQFRTKEVSDIIKPGQSWGLDTKSAYSSKNQQWLNSLAFAGTHNGFDALVIYTHRDGKETKAHKDAESRSQNITRVGVETNELDTSNRYTATTNNQHTYGWFLIKDECPTLDCTPKQMARVTKDTPSFRSYPEYTPEEKQAYENQKHITERLNAQDYTGEYRALPDPLKYKSDSWLVKLGYTFSPKHYVAGTYEHSKQRYDTRDMTYTAYWQPSDLLRTGRNWYPMNNAKGLYRDNALDGVAIDYFTEDGVKSSKGLRWAKARFIDEWHTRDRLGALYRYTNQDGNRLIDRLSLSFDQQKINLSTRLRENNCSEYPTIDKNCRATLDKLWSSTKNEQSSYEEKHDTIQLSLDKTVQTGLGKHQLNMLLGSDRFNSTLKRHEILSEFSVGTWHRIRGNGYKDTPYIYELKDQAIYSKNECDYSGTIAGRADCATSKIKGHNHYIALRDNFAITKYLDIGLGYRFDKHKFRSTHRWANQGDYKNSAWNIGIVAKPTSFLSLSYRASSGFRVPSFQELFGLRYDGAMKGSSDAYQKTEKLSPEKSLNQEVAATFKGDFGVVEVSYFKNDYKQLIAPAERMHQTQSMINYFNVQDIKLDGINLIGKLDWNGVFDKIPEGIYTTLAYSKMRVKEVKNYQGYMNIRSPLLDTIQPARYVVGVGYDQPDEKWGVNLTMTHSSGKNPNELRGNEQVGFANYERTATKKRTLSWHTFDLTGYITPWKHTTVRAGVYNLMNYRYTTWESVRQSSLNAIHQHTNVKDYARYAAPGRNYVVSFEMKF

SEQ ID NO: 17602 - protein, 898 aa, Actinobacillus pleuropneumoniae
MKNKLNLISLALLSLFAVQSYAEQAVQLNDVYVTGTKKKAHKKENEVTGLGKVVKTPDSLSKEQVLGMRDLTRYDPGISVVEQGRGATTGYSIRGVDRNRVGLALDGLPQIQSYVSQYSRSSSGAINEIEYENLRSIQISKGASSSEFGSGSLGGSVQFRTKEVSDIIKPGQSWGLDTKSAYSSKNQQWLNSLAFAGTHNGFDALVIYTHRDGKETKAHKDAESRSKSIQRVDLADNNPQGSNWFKVKNDCPSLNCEPRQQVGVSYDGQKYITEQLSAKEYTGEERALPDPVKYKSDSWLVKLGYSLSPKHYVAGVYEHSKQRYDTRDMTYPAYWQLSDLKNGDKWYPMNNAKGLYRDNALDGVAIDYFTEDGVKSSKGLRWAKARFIDEWHTRDRLGALYRYTNQDGNRLIDRLSLSFDQQKINLSTRLRENNCSEYPTIDKNCRATLDKLWSSTKNEQSSYEEKHDTIQLSLDKTVQTGLGKHQLNMLLGSDRFNSTLKRHEILSEFSVGTWHRIRGNGYKDTPYIYELKDQAIYSKNECDYSGTIAGRADCATSKIKGHNHYIALRDNFAITKYLDIGLGYRFDKHKFRSTHRWANQGDYKNSAWNIGIVAKPTSFLSLSYRASSGFRVPSFQELFGLRYDGAMKGSSDAYQKTEKLSPEKSLNQEVAATFKGDFGVVEVSYFKNDYKQLIAPAERMHQTQSMINYFNVQDIKLDGINLIGKLDWNGVFDKIPEGIYTTLAYSKMRVKEVKNYQGYMNIRSPLLDTIQPARYVVGVGYDQPDEKWGVNLTMTHSSGKNPNELRGNEQVGFANYERTATKKRTRSWHTFDLTGYITPWKHTTVRAGVYNLMNYRYTTWESVRQSSLNAIHQHTNVKDYARYAAPGRNYVVSFEMKF

SEQ ID NO: 17603 - protein, 935 aa, Actinobacillus pleuropneumoniae
MKNKLNLISLALLSLFAVQSYAEQAVQLNDVYVTGTKKKAHKKENEVTGLGKVVKTPDTLSKEQVLGIRDLTRYDPGISVVEQGRGATTGYSIRGVDRNRVGLALDGLPQIQSYVSQYSRSSSGAINEIEYENLRSIQISKGASSSEFGSGSLGGSVQFRTKEVSDIIKPGQSWGLDTKSAYSSKNQQWLNSLAFAGTHNGFDALVIYTHRDGKETKAHKDAESRSQNITRVGVETNELDTSNRYTATTNNQHTYGWFLIKDECPTLDCTPKQMARVTKDTPSFRSYPEYTPEEKQAYENQKHITERLNAQDYTGEYRALPDPLKYKSDSWLVKLGYTFSPKHYVAGTYEHSKQRYDTRDMTYTAYWQPSDLLRTGRNWYPMNNAKGLYRDNALDGVAIDYFTEDGVKSSKGLRWAKARFIDEWHTRDRLGALYRYTNQDGNRLIDRLSLSFDQQKINLSTRLRENNCSEYPTIDKNCRATLDKLWSSTKNEQSSYEEKHDTIQLSLDKTVQTGLGKHQLNMLLGSDRFNSTLKRHEILSEFSVGSWGLVRDIGYRNGSYNNPYVYELKDQAIYSKNECDYSGTIAGRADCATSKIKGHNHYIALRDNFAITKYLDIGLGYRFDKHKFRSTHRWANQGDYKNSAWNIGIVAKPTSFLSLSYRASSGFRVPSFQELFGLRYDGAMKGSSDAYQKTEKLSPEKSLNQEVAATFKGDFGVVEVSYFKNDYKQLIAPAERMHQTQSMINYFNVQDIKLDGINLIGKLDWNGVFDKIPEGIYTTLAYSKMRVKEVKNYQGYMNIRSPLLDTIQPARYVVGVGYDQPDEKWGVNLTMTHSSGKNPDELRGNEQVGFANYERTATKKRTRSWHTFDLTGYITPWKHTTVRAGVYNLMNYRYTTWESVRQSSLNAIHQHTNVKDYARYAAPGRNYVVSFEMKF

SEQ ID NO: 17604 - protein, 165 aa, Aeromonas salmonicida
MLKPEMIEKLNEQMNLELYSSLLYQQMSAWCSYHTFEGAAAFLRRHAQEEMTHMQRLFDYLTDTGNLPRINTVESPFAEYSSLDELFQETYKHEQLITQKINELAHAAMTNQDYPTFNFLQWYVSEQHEEEKLFKSIIDKLSLAGKSGEGLYFIDKELSTLDTQN

SEQ ID NO: 17605 - protein, 233 aa, Aeromonas salmonicida
MKMKLVTAAVMGLAMSTAMAATDATSLATDKDKLSYSIGADLGKNFKNQGIDVNPEAMAKGMQDAMSGAQLALTEQQMKDVLNKFQKDLMAKRTAEFNKKADENKVKGEAFLTENKNKPGVVVLPSGLQYKVINAGNGVKPGKSDTVTVEYTGRLIDGTVFDSTEKTGKPATFQVSQVIPGWTEALQLMPAGSTWEIYVPSGLAYGPRSVGGPIGPNETLIFKIHLISVKKSS

SEQ ID NO: 17606 - protein, 361 aa, Burkholderia cepacia
MNKTLIVAAAAASFATVAHAQSSVTLYGVLDAGITYQSNVGGKSLWSMGSGVDQSRFGLRGSEDLGGGLKAIFTLESGFNIGNGKLGNNGGMFNRQAFVGLSSQYGTVTLGKQYDATQDYLAPLTATGSWGGTYFAHPINNDRLSTNGDVALNNSIKYTSANYAGLQFGGTYSFSNNTNFGNNRAYSAGAAYQFQGLKLAAAYSQANLGDGSNTNGASSINAQGRVRTYGAAAGYAFGPAQVGAAWTQSRIDNQANGVGTLRADNYEVNAKYNLTPALGLGAAYTYTNAKVNNGSSHWNQFGVQADYALSKRTDVYAQAVYQRGAKGNNIVGTGIYNGNLDTASSSSINQTAATVGLRHRF

SEQ ID NO: 17607 - protein, 189 aa, Bacteroides fragilis
  misc_feature (5)..(5): Xaa can be any naturally occurring amino acid
  misc_feature (7)..(7): Xaa can be any naturally occurring amino acid
  misc_feature (16)..(16): Xaa can be any naturally occurring amino acid
  misc_feature (29)..(30): Xaa can be any naturally occurring amino acid
  misc_feature (33)..(33): Xaa can be any naturally occurring amino acid
  misc_feature (36)..(36): Xaa can be any naturally occurring amino acid
  misc_feature (47)..(47): Xaa can be any naturally occurring amino acid
  misc_feature (57)..(57): Xaa can be any naturally occurring amino acid
  misc_feature (60)..(60): Xaa can be any naturally occurring amino acid
  misc_feature (71)..(72): Xaa can be any naturally occurring amino acid
  misc_feature (76)..(76): Xaa can be any naturally occurring amino acid
  misc_feature (82)..(82): Xaa can be any naturally occurring amino acid
  misc_feature (84)..(84): Xaa can be any naturally occurring amino acid
  misc_feature (86)..(86): Xaa can be any naturally occurring amino acid
DEETXYXVRLQYNGEXLPLFTKVDGMTYXXGNXDVXPFKASFIAGGXAFGYKMDDIXVDXEGVYSHLNKNXXTDAXFTPDTXAXSXTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGA

SEQ ID NO: 17608 - protein, 1150 aa, Bordetella pertussis
MYLCNYNQKNVRKNTFLWAIGKIPLFMRFFIMFMFMSIGISYAETVHSQNAAMEFRFQDVTIEKALKEIEKKTGYNFFYNTKDFNVKQKISFSAKGMNLSEVLNGIFANSQVDYVINGTDIVLKRREEVSNVSNEKYQIKGTVRDGNGEPVIGASVVLKGHTETGVITDIDGNFVLTVPAKKVTLSISYIGYDPVNVEATVGTFVKVVMKESSQTLNEVVVVGYGTQKKESVVGSVQMVKPDELKVPSSQLSTGFAGRLAGVVAVQRSGEPGADGADFWIRGISTFNGTRSPLIIIDGVQASSGDLNAIDPEVIESFSVLKDATATALYGSRGANGVMIVKTKSGRESDKAIVNIRLENAYSTHTKTPKFVDGVRYMEMYNEAVLTRGTGEVLYSDNKIAGTRAGLDPLIYPNVNWYDELFRSGAMNQNINVTIRGGSKKLDYFSSVSVNHDSGVLRNTDDFSYKNNLNIMRYVFQNNFNLNLSKSSKLSLNLNVQLRDYSGPTSNTSDLFGMVMESNPVDFPVRFPDDPNVDYIRWGGKSGGKYNSGFRNPYAEMARGYQSQFESTVMANLKFEQKLDFITEGLSAEALFSFKNWSSTNTNRSAGYNQFQVINYNTDNLSDYTLNRIGSEQSTVLQTSNKSSGDRRLYIQAMINYNRTFNTVHNVSGMFLYNQDQYNGNAPEDLIESLPQRKQGFAGRVTYAYDYRYMAELNFGYNGSENFAKGNRFGFFPSVAVGYNISREKFFEKFSDVVSNLKLRASWGLVGNDQIGGERYIYLSNIELENGDLGYTTGRDQNISKNGPKYIRYANNDITWEVGSKWNFGIDLGIKNELNITFDIFKEIRKDIFMERQQIPDYWGTNGKDKWMNLATKMYGNLGKVENKGLDFSIDYVKRFNNDFDMSFKGTFTYAHNKVLEYDEPDFQKYPNISRVGHSVDQQLLYIAERLFIDDSEVQRNPKQNLGGWVSGGDIKYKNLPDVNGNYDNVIDSNDRQYTGMPTTPEIVYGFGPSFRYKKFDFSFFFQGAARVSIMMNGIHPFGAEGTRNVLQFIADDYWSETNQNIYAEYPRLSKRDNENNTKASTYWQRNGAFLKLKNLEVGFNHKFFRVYLRGSNLLTFSPFKYWDPEMGSGSGLSYPTQRVFNVGVQFSINK

SEQ ID NO: 17609 - protein, 357 aa, Bordetella pertussis
MSTPQLRVFCAFLAIVSFTSIAQQPIGVQLGGHLMVDYDHFDANFVDVANAANSHLELRRVRLALASQLSKSLSANYSVELTQDLDVKAAFIKYTGWDIANITIGRQKEGFGFERLMGARNFIMIERAMATTVISPGLSYGVNFAGSRGELSWQLGYFQKNDADNGESVTGRLAWTPWHTDNGLIHVGIASSQRRMHGDTYSINRKVEVGSADPIIKNRKIVADSVSQTGFEFMWQNNGFLNITEWQTSRVSAVDGSEYLYQGGYSLMAYSLSGKNRKFEEGILGGIDSSHWEVTMRYSQMALVKENDQVNTISIGLNYVVKNDLKFMVNFIKARISEDGAQRKSGEAISLRVQYHF

SEQ ID NO: 17610 - protein, 417 aa, Bordetella pertussis
MRRLLTRLLASTSVGFLSLLSPAQAGPIQTLLGLPDWVDFSVDYTTEPMGGLMGGLEPSAATWFQETVVGLSIGSGLNKPEANWQEIDHWQVNLELTNAAGDPNLNTELGSAFTLQTLVIPVGTWITEANISRDRGDSWWSAQAGLMSMDPEFLVAPAYNNYINSTLNNTLNLLVVGLPINPFVTPGVTVAAHSASLGELRYGYFYLNPETSIAASLGTDPEQPDVEGGMQALQWQINPLRKRQDLFEPIKIRNSKVTVARQLPLPLMQLGGYFASTKLMVNDAGTIGNGINRGIYGSLTWPIEFPVGLDNRVWIAGSLGLDPDNNPVPTYGAGGWLSQGVLPNRPLDVLALGLTRSSFSPTLTPGVTYEGVIELNYSIYISDVVQVQPVMQWLINPSGSGEVPGVWAGGVQINLNL

SEQ ID NO: 17611 - protein, 385 aa, Bordetella pertussis
MHIWWSKITMDVNMMKNTLKVVLLTSMLPFAASAAQELTPWYVGGGLGVNNYEPSCDQKTMKVCGEDDPYAWDVFGGYLFNEYVGIELGYRDLGRAEWTDYSNKRNDVGARGMSLGFVGFYPLADKWSLSAEAGAFNYLISNKKEYNTEYYSDSGIAPYLGAGIGYNFTDNLKLQAKYRRYENLDEEKWNTLSMESNYWGLELSYRFGTSTPAPVAAPVVVAPVVVPLGDDDKDGVTNNIDKCPDTPSTHKVDATGCSVYENVTTKYDLGGILFANDSAEIRAGSFADLEKLADHLTKYPQHTVSVQGHASNVGKAEYNMKLSERRAVAVASALNKKYGISISRISSVGYGVTKPVMQGSSAEANRVNRRIEAIVTGTEKRVVLR

SEQ ID NO: 17612 - protein, 774 aa, Bacteroides thetaiotaomicron
MIREGWKYAVSTSRARRPAVVNGSQPSGRGVPEMGDMMTKDQFRRSGRSGAAWYAHANHKITRTRFSRLWPLAFATPCLLPSPAAFAAEESSSLPALSVQGQAVTSEATGTLSLNQPNATGSRLGLTPMETPASVDTLEGDTIRARGDLRVDAAVSREAGITMIGTPGNGGTALSARGFTGQAAVMQLFDGVRLYPGAGTVTFPFDTWSTERLEVLHGPASVIYGEGAVGAVVNVVSRQPFEGKIRNEVAALLDTNLTRRLALDSGGSLSRTISYRLDIAGQMSSGYVQRGNSDSLDMKGALRYRPSQDFTVTVSHDHAMQDPMRYYGIPLVRGSLDRSLRDQNYNVQNSILHYEDDWTNLHAEWTPTASLTLRNIAYRLSTNRHWVNAENYRSLPASNMVQRDGYLDLTHQQEQYGDRLDGTWRHTLFGLGNTLGAGMEVNYISFSRFSNAPFGGMSQVPLDNINPGFFINLAGNRKDIQTTTWQVAPFLEDRLQITRRISILAGVRFDHLDLHNAMPTTGKPFDKTYDAPTWRVGVVYQPVQTLSLYGQYSTSVLPPTSTLITTNLANSAFDLSHGRQGEIGIKQDLADGRLQWTFAAYDITRDNLLSADPNNPGVTQQIGQQSSRGLELNVSASITPRWSVNANGSILQARFDDFTETSGGVPVSRNGNTPPNVPLQTANLWTEWAFAPRWQAQAGLRFVGRAFADNANANARPAYTVVDLGLNWQPVDQLSLAARVSNLFDTAYAVTTYGSQQWILGLPRTITFAANVKF

SEQ ID NO: 17613 - protein, 263 aa, Escherichia coli
MSNPIYRSGKVIAEMIEMNKVIAVSALAMAGMFSTQALADESKTGFYVTGKAGASVMSLADQRFLSGDGEETSKYKGGDGHDTVFSGGIAAGYDFYPQFSIPVRTELEFYARGKADSKYNVDKDSWSGGYWRDDLKNEVSVNTLMLNAYYDFRNDSAFTPWVSAGIGYARIHQKTTGISTWDYGYGSSGRESLSRSGSADNFAWSLGAGVRYDVTPDIALDLSYRYLDAGDSSVSYKDEWGDKYKSEVDVKSHDILLGVTYNF

SEQ ID NO: 17614 - protein, 1036 aa, Escherichia coli
MIEMNCMPFARNRSTLSAGIAIALFASAASSAAVAQQADGTPAPAGQAALQATDLDAVTVTGYRYAIEKSLEHKRNANAVVDVITAEDVGKFPDKNVADALQRVPGVVISRDGGEGKNVSVRGLSSELVLTELNGNYIATAESNGDPTRSFNYTLLPSNLLGSAELYKTPEARIDEGGIGGTVILQTRRPLELEPHSGFVSAEGTWSDTSKKTDGQFSGSYSWHDQDNRFGVFVGYTQQKRTARTLNASTESWQWYGRDEVGPAVDVNGNRSDFNANWWGGTGFWDQNGNYATGFMMPTAVSLGVKREERARKGGQLTLQFKPTDDLTLTANYVRFDLSQNSQTNTIKIPEWNIARYDGDGNWRGGRLLDRLQFDPSGTIVTGAAYSLRPGKTYYCSEAQAAAAGLPPGGWGSDDCTVPTPQITGSYNIEKSQSQTVDLGGEWRGEQVDVAFKAGRTWAKGGPELQFSLPIKPRRQNADGSWSNGNLASAWDLTGTPTMTFSPELMQNLRDGILQVDLGSTGSSWTRNTNQQQYAQIDTTWHIDGNFFDSLQFGLKRRDGGIHRNTGNNYWVCPGTDPSDYDNRYWNGRCNAIATQFSPGLLFAQDNLAGGVNASAFPAINFPGYIGYLNQTYGAMQTRSEDNFVYNVDEEIYSTYLQLNFHTERLRGNVGVRVARTGQRADSTDKVTAYNDYFFDGTDGNPLACQQGAATPSGAPADTYCGTEGYWRLSDSVQRTESFVVSGLDRDYTDVLPSFNLAYDLTENLLLRAAAAKVIARPSYNDIAAPGSLEFYSPEYVADRRLTGGSSEQGWYGSGSNKTLEPYKATQFDLGLEWYFHPGSVAGVGLFRKNVENFAVDVISDVNMMIDGQQVTVQNYSSQAGGQDAVSQGVELYAQHTLPFGLGVQFNYTYNDASKAAVRLEDGTEAGKTSMPGSARNQTNLTVFYETDRLLLRASYNRRGELVQGLVKGLNVYEEPYYQVDLNAAYNITPALSLTASVLNLTKQESRSHLGDDTRARFYTGGYAGRLAYLGLTYKF

SEQ ID NO: 17615 - protein, 246 aa, Escherichia coli
MNKVFVVSVVAAACVFAANAGAKEGKSGFYLTGKAGASVVSLSDQRFLSGDEEETSKYKGGDDHDTVFSGGIAAGYDFYPQFSIPVRTELEFYARGKADSKYNVDKDSWSGGYWRDDLKNEVSVNTLMLNAYYDFRNDSAFTPWVSAGIGYARIHQKTTGISTWDYEYGSSGRESLSRSGSADNFAWSLGAGVRYDVTPDIALDLSYRYLDAGDSSVSYKDEWGDKYKSEVDVKSHDIMLGMTYNF

SEQ ID NO: 17616 - protein, 1533 aa, Escherichia coli
MIEKKVSRFQKSTFSHSVVLAILVSTGMITNNDKLYGYVPASEVILDTLSMPKAELEVPSAGIFKKEKPIHAQGPKKGETDQETSLLDNTSTCVYKVLVAEDEQRQHLENTSTIFQTCNVLSWENLDTRSTNAEAEKGKTSPQYAVEDLQQGLAFCYKNAPEHLVDANTPGFLGIALKGTRMKSGLSFTNLKSTAAGAAVYSEEDVLFESFKEKLVFDGCESQAGGGAVSGRSIAIHGCHALTIANSKTDVELKPTSGESSDFSLGGGAFNANQVHPVHKSRFASGDVVFLDNQGSVLLSGNHADKANGGAVACGNFICSVNHSDIHYLDNYALSGGAVSSSKSMDFCGNLGSIEFLNNQALASSEGSLFLGGGALAAGERISFLNNHGILCSKNTAKCRGGALLSREVRIVENVGSSLFKENTAEVTGGAISSQHQVEIDQNFGNVTFEGNTSKFGGGAIYCLLPAQPDTDAQEPRIGSGDIKIVDNVGEVHFTSNANLLDSQETHSYLGGGALYGSNVLISGNIGAITFSKNQAGQCESSSTHIGGGAIFAHEVVTLSGNSGEATFSYNKGQILPLPLSPTPAEESSTSNAPIESSTPVNLGVRGGGAIFAKSISVEDNSAFVSFSENSMEIRDNQAQKENPLGGGALFGLDSVGLKNNVDLAFSNNRVSGGNSSGGAILSKEVAIAHNGKVQFTRNCAKFPGGAVCALGDTLRIENNESTVSFVGNRTIAAGGALASAAGAVSISQNLGKVEFKDNFVFGDPYIENLEKGQINSEGHHSGGGAIFAKTSVVIRGNDNKVLFSGNSAGCFGGAILTGSLTSTESQEHFAAKVESDNTKVVITENTGDVIFSGNSTTASKHPEHNLFGGGAIHTQDLIIKNNEGSVAFYNNYAPTGGAVRISEKGSVVLQALGGDIVFQGNRNSEDVSNGMYFSGKESKLVEVSAAGETSVIFSDAIVFEDLTLRKGTKDHEDALNDPTLIFNSKAKDDAEITHSGNVRFSHATSKIPQVALLESGTLMLSNKAQLWLCGLKQEKGSEILLSAGTVLRIFDPNAKPTEKIESPTSNVYYSAHESVKQPENKTLADINSIGIDLASFVSSDDETPVPPQIIVPKGMTIGSGSLDLNLLDSVGAGYENHALLGKETDITLLSFKSASSVLDTPDLDHALEELRVKVSVPTITEDTYGHMGRWSDPQVVDGKLMINWKPTSYKLNPEKSGAIVLNSLWGHCGDLRSLKQQQLAHNITAQRMELDFSTNIWGSGMGTFTNCATIGKVDGFTHRAGGYALGLDTQLIEDFLIGGSFAQFFGYTDSQSYSSRSDQSGYLGSGYLGIFTGSWLFKGMLIYSNMHNDLNTQYPQPNLGGSKGSWDSRGILADAHVDYRYIVNSRRLISSIVSAVVPFVEAEYVYVNFPKFTEIGSEARTFDEGHLQNVAIPFGVTLEHNYSRGQRSEVNSVSFSYAIDVYRQEPNVLIHLPEASYSWNGVGSNLARKSMKAQFSNDTEWNSYFSTFLGFTYEWREHTIAYDLNCGMRLIF

SEQ ID NO: 17617 - protein, 590 aa, Prochlorococcus marinus
MKLFQRLLVAPAALGLLAPLASDAIRPASATELNIEGVSEYTAKSKKGRSAASRDQVTSITQFSDVYPTDWAYQALSNLIERYGCVAGYPNGTYRGNRAMTRFEAAALLNACLDRVTEVTDELKRLMKEFEKELAILKGRVDGLEARVGELEATQFTTTTKMSGVATFVTGANTFGGNAKVDQQFGRQLTKAESGVGSKRTMAFQANNNLGAAVFNYDLKIDFDTSFTGKDLLRTRLRTGNFTNSAFGFSASSGIYDALSGGTFATASGLEVAFEEGPKSNAVSIDRLFYQFPLGSDFTVTAGGFVRQDDMLAVWPSAYPADTVLDFFTYAGAPGAYSLNLGPGAGLWWSNNGFSVSANYVSFNGNETDPTSGGIATDAAAGTGTVQLAYADSGWGVAAAYTYSSGNWGTLYQSTGTPLATQVGLLGNSNNVAVSAWWEPEESGFIPSISLGWGLNSTNGNDYFGGGDGADPQLLGYDFESATSQSWYVGLQWSDVFLKGNNAGMAVGQQGFVTSLGLSGDDVDGVSSSTAEDRFTRDGQYAWEFWYQFQVTDNISVTPALFYLSRPLGSVTQGDSFNQFGGLVKTSFKF

SEQ ID NO: 17618 - protein, 363 aa, Ralstonia eutropha
MKLRHLALAAALGLPAIANAQSVTLYGVIDTGIEYLNHVGTASNSVVKMANLSGTVPSRWGLRGTEDLGSGMKANFVLESGFAPDSGVSNQGGRLFGRQAWVGLSGNWGQVSLGRQYTMLFWATLDSDILGPNAYGSSSLDNYLPNARADNAIAYKGKFGGFTIGATYSFGRDTVNAGPSPSGTNCGGENPADKTACREWSAMLGYETNWWGILGAYDSQRGGPGAFGGLTSSSLKDDRATLGGYMLVDRAKIGAGWIGRRNGAIATPRSDMFYAGVAYDITPAVTLSGEAFYLKYHNSADKAWLGALRASYAFSKRTSVYTTLGYIDNGGKLALSVDSASTGASPAPGGSQFGAMLGMKHVF

SEQ ID NO: 17619 - protein, 411 aa, Ralstonia eutropha
MKKHYLAITIAMMTSNAMLSNPALAAAHLLPELGSLNASTAGAGSAALAESALTAWTNPAAMSQLENPELTVNLAGLYTDINYSDTDPTERFDSNIDAGGWAPVGSFYFVTPINDKFHAGFALASQGGSGIDYGDNFSGQRLLKNVEFMTVQLMPSISYKVNEQLSLGASVNAEYLTANGELNPFIGTGDIGSEHLFEADADDFTVGYSLSAFYQPNEQHRFGFIYRSELAHYGEGDLQHSASDTKRDVGLDFIMPQHIQISGVHAVNDQWDMLWSVTWYDLSTWTDLTLDINDNSVKVVDRNFDDVWNLAIGTHYQITPTLRLETGISYETSPQDDATHQYMDLPVGETKRIGAGATYALNKNWELRAYYDYIDLDEPELNYSKGQVINVQGAYDNSAHFFGMQANYRFL

SEQ ID NO: 17620 - protein, 699 aa, Ralstonia eutropha
MRLKPLARLIPAAALFATHGSVLAADQQLEAVEVFASDSAWRAGSIGVGTFRDTPAKEVPMTVNIVDRDLLDAQQANSLYEALKNTAGVTRAQLGATAYDNLSIRGLLVENRSNYRLNGGLPIVNLIDLPLENKERVEVLKGVGGLYYGFVPPSGIINLVTKRADSTPVTAVQLSTDDNGSAVVGLDVGRRFGSEGQFGARVNIVGGELESAVEDADGDRRLVAGAFDWNVTDRWLLKLDVEDITKDVVEQSSILALRPVNGEIPLPRIPNPEKLIAPDWANYDAEEQNVQLRSDFALNDNWIWTVEAGRSRLERDRNFSQMLNYDVATGEGTLQIFRGQDQEFINRNARTELAGRVETGPVRHDLTVGYARNVLSQSLGNTVTVNVAQNLYNPRDIPDTPVTHGANARHSHTYDRGWYVFDRAALGDWLLIAGARGSEFEFEHATDNRQDYTKRKVSPTVAAVWKLTPATNLYAGYLEGLEDGGIARPTALNAGTSLEPLVTRQWEGGVKTDWGGVQTNAALFQIERPMNGEINNIYQRLGEARLRGVELSAGGQISPRWGIFSSMQWIDAEFTKAENDQSIVGNRPANTPEVTASLFVEHRLAAIPGLALSAGAYYTGEREVNPQNQAEVNAYTRYDVGARYRTKVASNQLDLVATVENVTDKRYWAAAGDSKVNSNSALLAVGMPRTLRLSAKLSF

SEQ ID NO: 17621 - protein, 1290 aa, Ralstonia eutropha
MRIYRWLSASVGRHVGLATLFAGMALFLDAYGAAAQTCAAGPVFVDGTSCTVTAGSSITVSQAAVPGLDARNAGATITAQGITVQLGPGVVPRTFVGAQALSGAAVELSGSTIITSQAGTGQRGVISDGFGSNISATGLTITLGTGATTVNDNLAVLAQNGGMANFTNSAISTRGAANGIANHAVTATGSGSTVTLTGGTVSTASRGSFGVQAADGGRVVIGGGTQVTTTGVQDLTTTPVTGSHALIATGSGSRIDGANVTLGTSGLFASAARAENGGVVALTGATINTSSNSQADSDPSSATRVLSGGSLRLTNSTVDTTGQRGNGLSVQDAGSTATVTGTAISVSGTRANAAFVFDGGEASFSDSSLFSANSTAVNVQGAGSSIDLTDSNVRSGGAIGYGLRVGDGGTVTMTGGSSTTTGRDAPALAAGNATVVANNVTFSTAGPDNAMGVLADLGGNITLNGGSIVTTGDSVRLSAYPHGIAARNPGGIVRANGTSVRTEGLTAMGVVADDGGVILLDRNSITTLGTTSIGLYSTVEQSGPQFPAGIVGERLVVETFGTGAHGAMAVEHFLPADSTILLDDSLLTTHGDLASGLRSIMSASIDARNSVILTQGDRSSGLHSRDNGSEINLIDTTVTTEGTASHGALAEGGGLVNGLRTSVEAKGSDSYALYVAGAAGFVSEARFDASRLSNADGPAIAIGGEGVVSLTGSVVSSSGQWLSVGTIADFQPLTVPDAGLGGVTDPEGLETSPVFTPPAALPVVPGLANVTLSRSVVTGAAFTAPGSVSNLVLEDDSLWNMTGSSNLTTLLNDPSLIQFSAPTGDPTLLASYMTLTVVDYVGEDGNIGLNTYLDTDGSPSDRLVIDGGSATGSSGLIISNTTGGGALTTGNGILVVDAINGGVTDPTAFYLAAPAAAGPYDYLLFRSSVDGSGSENWYLRSELDGPPDPTPIYRPEVSLYAAIPSMAAIYGRHIIDTLHERVGEEEQLKGRTDIREDENFNGVWLRGIGQWGHRDGDARGVYDGAPEFDYRFGAMQGGMDFYREEEDGITDHAGMYLAYGHGRMDVTQNLLTTERDAGDSDFNAFSVGGYWTRFGENGWYLDGVLQATWYDVTTHSNRPTQIGFPDQSIDGFGFAASIEGGYPFDLGDGWQFEPQAQIIWQTIRMDDFNDGAADVRYDNLNSLVGRIGARVARTWQAEEATATDPARLATVWGRVNVWHEFTAKAQTEVSSSDGFVPFSSNLDETWIELGLGATRQVSNNTSLYGNVNFSTSFDGDNYAWNGKLGLRVNW

SEQ ID NO: 17622 - protein, 1749 aa, Ralstonia eutropha
MKWLSATAVFAAVLPSVSGFCFPEPKELNFSRVGTSSSTTFTETVGEAGAEYIVSSNASFTKFTNIPTTNTTTPTNSNSSSSNRETASVSKDSDSTTTTPDPKGGGAFYNAHSGVLSFMTRSGTEGSLTLSEIKMTGEGGAIFSQGELLFTDLTGLTIQNNLSQLSGGAIFGGSTISLSGITKATFSSNSAEVPAPVKKPTKPEAQTAGETSGSSSSSGNDSVSSSSSSKAEPAAANLQSHFICATATPAAQTDTETSTPSHKPGSGGAIYAKGDLTIADSQKVLFSINKATKDGGAIFAEKDVSFENITSLKVQTNGAEEKGGAIYAKGDLSIQSSKQSLFNSNYSKQGGGALYVEGNINFQDLEEIRIKYNKAGTFKTKKITLPSKAQASAGNADAWASSSPQSSSGATTVSDSGDSSSGSNSDTSKTVPVTAKGGGLYTDKNLSITNITGIIEIANNKATDVGGGAYVKGTLTCKNSHRLQFLKNSSDKQGGGIYGEDNITLSNLTGKTLFQENTAKKEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAYTCPDSFPTADTAEQPAAASAATSTPESDPVASTALSTPSSSTVSSLTLLAASSQASPATSNEKTQDPNADTDLLIDYVVDTTISKNTAKKGGGIYAKKAKMSRIDQLNISENSATEIGGGICCKKSLKLDALVSLSVTENLVGKEGGGLHAKTVNISNLKSGFSFSNNKANSSSTGVATTASAPAAAAASLQAAAAAAPSSPATPIYSGVVGGAIYGEQVTFSQCSGTCQFSGNQAIDNNPSQSSLNVQGGAIYAKTSLSIRSSDAGTSYIFSGNSVSTGKSQTTGQIAGGAIYSPTVTLNCPATFSNNTASMATPKTSSSSGNSIKDTIGGAIAGTAITLSGVSRFSGNTADLGAAIGTLANANTPRATSGSQNSITEKITLKNSSFIFERNQANKRGAIYSPSVSIKGNNITFNQNTSTHDGSAIYFTKDAKIESLGSVLFTGNKVTATQASSATSGQNTNTANYGAAIFGDPGTTQSPQTDAILTLLASSGNITFSNNSLQNNQGGAPASKFCSIAGYVKLSLQATKGKTISFFDCVHTSTKKTGSTQNVYETLDINKTENSKPYTGTIVFSSELHENKSYIPQNAILHNGTLVLKEKTELHVVSFEQKEGSKLIMEPGAVLSNQNIANGALAINGLTIDLSSMGTPQAGEIFSPPELRIVATTSSASGRSGVSRSIPTNPKGISAAAPSGSAATTPTMSKNKVFLTGDLTLIDPNGNFYQNPMLGSDLDVPLIKLPTNTSDVQVYDLTLSGDLFPQKGYMGTWKLDSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKMVGKTKAIKKMHNYFHKGSEYSYQASVYGGKFLYFLLNKQHGWALPFLIQGVVSYGHIKHDTTILYPSIQERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 17623 - protein, 379 aa, Ralstonia eutropha
MKRVPLKKRIAVASAVASLAAAIPQLAQAQSSVTLYGLISTGILYTSNSGGKSVVSMASGPEQLPRMGLKGREELGGGTAAIFTLENGFNSVNGSLGQGGRMFGRWAYVGLTNNTYGTVTVGRQLEEMAQQLYWSESGVIFAAFGTRIGDNDNIFNSNRFNNSIRYASPNIHGLTFAGSYAFSNQVGGFSNNNGYSFGANYVSGSLKLGAAFTQFNHPAVASNLNGAVDDGSWGFSNPFVKSLGGAVTAQQRIMGVGASYNFNIVQVAAGYTNVLYNYLDNTGLRLQNAELTVTKQITPTTLIGAGYIFTAGNYSADRQPRYHQVNLGSVYSLSKRTDLWLVGMYMHAAGDAHHAQIYTTTASSTQNQMAVVTGIRTRF

SEQ ID NO: 17624 - protein, 146 aa, Ralstonia eutropha
MDKQRGFTLIELMVVIGIIAILSAIGIPAYQNYLRKAALTDMLQTFVPYRTAVELCALEHGGLDTCDGGSNGIPSPTTTRYVSAMSVAKGVVSLTGQESLNGLSVVMTPGWDNANGVTGWTRNCNIQSDSALQQACEDVFRFDDAN

SEQ ID NO: 17625 - protein, 652 aa, Ralstonia eutropha
MAFQTHPGSVAALAALLASPVLAQDSSVTLSPVTIVSSADDETISETITAEEIETRQPATLNELFAQSPEVVVSGANRMAAQKIYVRGIEETMLNVTVDGAKLGGNMYAHSGNFGIDPDLLKRVEVEAGAGSALAGPGALGGAIRYETKDPEDLLLPGRDQGYMLKLSAQTNGRRVTPGLAFYGTPDERFGYLVYLTKSWADDYKDGEGNKVADTGNDPLDALVKLRFRPADGHELSFSTTYRRDNGRRAYRSNFGIPPGLPDAIPEDQKLGWRSTSVSYRYNPAGDPLVDMTVSAYDTHSRLLRDIEVRQVSEWDTRGLDIRNRSDFGQVALTYGYDYGWTRSRGESGAGLGGSERGENHGLYVQADYTPTEQWLLSAGLRYDRATLRDLNGNDYKGVHFSPNLRLRYEPTEGLALFASWGEAFRGVQPVEGLTLIWPLGLGPQTDTSLTGELARTAELGAEWDRDGWRAGISGFTSKIEDKIRSWQGRGSPWFRENDGEIESRGITAHLGRSWQNWSADLRFSHIDVKYNDEPVSPGDWLDGVTPGGDKIVLALGYQMPAQNLEIGWTSTVVLKQTDLPADFQLDELPGYDVHDLTVTWRPARNQSYSLALTNIFDEQYLDHSTAYYGVDGWSNLYETGRSLRLSGTIRF

SEQ ID NO: 17626 - protein, 458 aa, Ralstonia eutropha
MKKKVVVGAALMMMPLVSFAGGYLTNTNQHAAFLRSLSRGAAIDIDGALSNPAGLSFLPTDGFRVGVSIQSAFQTRDIDASFGTYSGFDPVNKVPTVSDVPYKKYYKGKAAAPVIPSVFAAYKKGDWTISGFFAITGGGGKASFDDGLPMFESAAMAGIFQESLGKYINGESPIVTPDMYTINSAMDGKQYIYSLQLGLSYKITDWLSAFAGGRMNYFSGNYDGYLDAKLKKDFGGTDLMNLALDCDQTGWGLTPVLGVDVKYGKFNFGAKYEFKTNLNIENNTKKLDYPDSAEDLIGPYKHGVNTPNDIPSMLSVAASYQFLPMLKASVEYHFFDDKKAGMAGGKQKELERGTNEYLFGIEWDVIKRLTISGGAQITDYGLSDNFQSDVSFSCDSYSLGFGAKVMLSEKMALNVGYMWTNYHDYTKKSENYCGTNLPGTNVYSRTNKVFGLSLDYAF

SEQ ID NO: 17627 - protein, 1014 aa, Ralstonia eutropha
MGGVGSAIAQTGTITGMVTEASSGDALPGANVVIVDSQRGTSTDADGAFRIPGLEPGTYQVRASFVGFRSRTQEVDVAAGETLELNFALAPDAMAMDEMVVVGYGTQERSDLTGSISSVPTEDLAETPIESAQEAIQGRVSGVTVTQNTGSPGSGFSIRIRGTGTTGNSNPLYVVDGVPVSDPTETGAGGISFLNPNDIESIDILKGASAAAIYGAQAANGAVIITTKSGSAGERSVSFSAYTGIQQTPRTIDMLEGPEYAALRNEANINAGQAPTFTSPSAYLGPEGSTDYQDLVFERGITQNYSLAVSGGTEDLTYRISGGYFEEGGIIDKSSLERLNARVNTEFEVNDLLTVGENLTFERRTRSTISESDNVRNLLIQTLQVDPTVPARDSAGNFTAQPRTNANNPLAALDFRNNEYNENRLVGNVFAELSFLPSLRVRSQLGFDLRNGNTYAFTPEYDISPSFRNVSPSTTQYSDFQSSLIWDNTLTFDKAFGSHDVEAVGGTTIETNYYRFINATTQGQPGNDPSLRYLGAGPEVVNIGGSLAESNLLSFFGRLNYNFSDRYLLTAVARYDGSSRFGANNRFAFFPSVSAAWRISEEPFFPDNELVTNLKLRAGWGQNGNQRIGDYPFAATIAGNQDYVLNGQLAPGSAPLQSPNPNVKWEETTQTDIGLDAALFGDRLNLSAGFYNKVTSDLLVSLPPIPTSGLVSASPENAGEIRNRGWEFSADYSLTPAEDLTVRVGGNLTTLSNEVVSLAQSTDFVINSGNYRNGSITRTEPGHPVGAFYGYKTDGLFQTPEEVANANELSDEGPYQSADTAPGDIRFKDLNGDGQITQADQTFIGNPTPDFTYGFNLDVEYKGVSLSTLFQGVQGNDLFAAYKFYTVFNTAFNMSEAVKNRWTGPGTSTRMPRLTSSDPNQNSRISDFYVEDGSYLRLKNVRLGYSVPSRLLSSLGAGLDRARLYVSAKNLFTLTGYDGYTPEIGVNNSTLDRGIDRATYPQPRVYTVGINLGF

SEQ ID NO: 17628 - protein, 587 aa, Ralstonia eutropha
MRGMKDRIPFAVNNITCVILLSLFCNAASAVEFNTDVLDAADKKNIDFTRFSEAGYVLPGQYLLDVIVNGQSISPASLQISFVEPQSSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVRLDCQPQGLNIWGVITILLTCVYPCRWGRGQRATVAV

SEQ ID NO: 17629 - protein, 330 aa, Ralstonia eutropha
MSQNTLKVHDLNEDAEFDENGVEVFDEKALVEQEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRE

SEQ ID NO: 17630 - protein, 1117 aa, Ralstonia eutropha
MKSRSNLNTRLLPLSILISSLISGAVLAAPSVAIPPSVQDLINQVQSYANAHVISPEQAETLIKRLTVTPEKLKEEEARVKQELAAVEKKQTEAKKEIITTSIEKDQFNKALNNTQKAKLAAETVFINANSKQNEAIKAVNKNWSLADENISTKLSVIVNGESKTQAILTEKIKLTEIANINQQEQIIKAQQLDADIQQIKSALADAESNGTTGTLVLRQKLAQAEEKLEIAKNNPKSKLFDAKAAHDRTSKNLEGPEGLAKRAAIQNKKVYEQELKVLQDPIDAAEEQLNTAQENTFALMDKQSALAGQKINSIALTNSLQEVFKQAKNAQLQAEQAAQQAKDATTAQQAMAEAAAAEKLLQEVEQKITTIAVIAQEAEAKLTAAQRAKADAELQLADKMEQLANINLDLTALNNLDPKVISQQTLAKGEAQPVADGELAMAIKVAGGEQNVTTGGVVLASVVTEDGVVNLSDNALAHDSQLINGTLNNTRAHDVNTQVGAQGKLLINGTQEAAATSEGATVAAGGSVTAGTNALVTKMVSAGTVTGNDGALFTETTLNDGQFSLNNGAIAQNTKVNGGQFNVNEGATAEGVTVKGGEFNLRARAQAMKLTIEHGEAQIAGTLTDVTLRGGNTTLASTADVAGTIHSISGSALKVYQGAHTAQADLNLAGRVVLFADDVAPMAALPSRAVRSADNRLSAPFTFRRVNMSGGTLDLRNVKNAQLVMDSLAGNGTFKLGSMLQQDASAPVNVTGNADGDFTLQIDGSGIDPTNLNVVSTGGGDARFTLTDGPIGLGNRVYNLVKDASGKVTLVANESTVTPGTASILAVANTTPVIFNAELSSVQQRLDKQSTEANESGIWGTYLHNNFAVKGRAANFDQTLNGITLGGDKATALADGVLSVGGFASASTSSIKTDYQSKGNVDSHSFGAYAQYLANNGYYVNGVVKANKFNQDIHVTSADNSASGNTNFSGMGVAVKAGKHINHNHLYVSPYVAMSAFSSGKSAVKLSNGMAAQSSSTRSMIGTLGVNAGYRFVLKNGVEMKPYVSASVDHEFAANNKFRVNQEMFDNNLNGTRISTGAGLNVNITPNLSVGSEVKLSNGKNIKTPVTFNLNVGYRF

SEQ ID NO: 17631 - protein, 719 aa, Ralstonia eutropha
MKSQLYLTALFFFIHLGVFSQTLISGKVLDEKNLPLPGVNVFIKGSYDGATSDQEGYFEFETEEAGDKTLVYQFLGFKSQELPIKCESDPIQTENVSLTELITEMNAVTISAGAMQASDASKAVVLKPLDIVTTPSAMGDIIGAFQTLPGTSTVGNDGRLFVRGGDASEVGIYIDGLRVGNAYGSTAGNVPTRTRFNPNLFKGTFFSTGGYSAEYGQALSSALALNTKDISPRSQGDLSVLSLGGGYSHTLSSDKQSITMSANFFDLDPYQDLVKQNIDWERGPHSWDLEVSTQKKLAKGGLLKVMARTESGGMELWQKQPGKEGRGVFIDLKNKYTFAQTNWKKAYDNGWTLFSGIAYSSNQDDTFYDSVNFQTSSKLIHAKFTGIKDFNDRISANSGIEYFQNDYSEGISEANMERDYVDNQIYAFSEWDFYLSKKLVFRGGFRAGSSSLNQEYWVDPRASFAYQVSENAQISLAGGTFSQAPTENLRVLNQKLENVESKHLILNYLYGNNGRTIRAEAFYKSYEGLVTFEGQPMNPINPINEGNGFAKGFDVFYRDSRSIKNTDFWVTYSFVDSERQFDQYSTQVQPAFAPKHNFSVVAKHMFQNLKSQLGMSYSMNDGYAYTDPNQPGEMNSKTKAFENLSLSWSYLPKPNLIIHFAVSNVLGRENVFGYQYSQTPNPSGVFESLPSGQAAPRFILLGVFLTLSKDKTANNLNNL

SEQ ID NO: 17632 - protein, 954 aa, Ralstonia eutropha
MNKLRSRKFLAAPFLILAVGLLPTLGFAEESAPAEESQDLVRLEKYEVTGSYIPYSAEAPAVPVRIVNTADIEATGQVTDLLEVIRKSVPQFVGNGNIGSSNSNIGGGSTNGGSRVQLRNVQTLVLVNGRRAAFSPVSAVGGFDFVDVNSIPVSAVERIEVLKDGASALYGSDAVSGVVNIILKKDYEGAEVGGHYAFAKQFGSVWEERSGRTTVGARTGDGKTSVTISAEWTRSDPLFQNERAFSFDQTGKTSSFAGVVNYYGAESGNFLLAPGATPPLNTDMTGAELVAAGIYTKPDVPISSLFNLSPYVTLALGNERNAVVAAVSHKLTDNIELFGDLLYSKTSTFYQLAAQPIVGMPIFAKDVDNFGVLPFAYTMPQQAQNPFDDYVLVRNRFVSNPRKYFSDTDTLRGVLGARGEFGAYNWEVGANFNDVDQLYRNENVINRVNLANAIDNNQVNLFARTQDPTLLQQANIFGTAYSKNKSSLISFDGRVTGEFANALPAGAIKFAVGAETRRETLSGKPDSGSFTVSDPASPLFGSPSLWDGATTSDNFNVDRSVDSFFAELRIPVVAPTQTVPGFYTLDVDAALRKDFYSDTDDPLVPKIMLRWFPVNDQFAVRAAYSESFSAASLYSLFGPTGVGFSEQPIGLEFVDGRVMDDNVDQAFLRVLSNPQLKPETAKNYNFGVIFSPKAVKGLNIELNYFLIKQDDISGSVNDLTILQDVETNGASSQYANRVRINSFNGSAITGPGQISAAFDEAGGSMTRVFITNFSENFVSAKQDGVDFTVDYVFDVPNVGKFNMVLNGLWFNRFSVEDEDYVGTTNGRSVLNGGTIPEWRGNFRTEMTRGNLLLGATIDYIPSVTDTGASETATDVAADRHVESYTSVDLYVGYNFKGRAGWTRYLDGLSVRVGAINAFNEHVPMSMASWTDANADTATYGALGRAFFVNASYKF

SEQ ID NO: 17633 - protein, 759 aa, Ralstonia eutropha
MARRPLRAALFGAFGLYAAAARAAGPASEPAAAASAASTSQVRHAAIAAARKDAPALDPITVTATRTASAASRTAASVSVITDSDLEEQQADNIKDALRYEPGVTVRRTAYRPANAALGGGRDGDSSINIRGLEGNRVLLMEDGIRLPSAFSFGPLEAGRGDYADLDTLARIEILRGPASALYGSDGLTGAVNFITKDPSDLLSIHRKKTYFSFRPSYDSVDRSIGATVTAAGGNDRVQAMLIASGRRGHELDTHGDDNSASTRRTRANPQDVYTESLLGKLTITPTARDTIKLAAETVRRRIDTNVLSAINPPTTLGLTANDRLERNRFSIDYDLRDATARGFQTAHVQFYYQESTQDQDAFETRGGRLQSRSRSNHYSERALGGSAFAESGFATGPLAHKLLYGVDGSIDRIKSLREGTVASPGESFPNKAFPDTDYSLFGAFVQDQIGFGKLLVTPGLRFDAYRLSPSSGDPLFTGKTVSSSDHELSPRVAMLYEVSPALIPYAQYAHGFRTPTPDQVNNSFSNPIYGYTSIGNPNLKPETSDTLEAGLRGTLGTGYGPLRYSVAAFAGRYRNFISQRTVGGSGRPNDPLVFQYVNFANARIHGFEGRAEWVMPNGFTLKTAMAFTKGTTQDNGAASEPLDTVNPFSAVFGVRYEPSERWFAQADLLWQAGKRGRDVSSAACQKKTCFTPPSSFVVDLRGGYRFNKHVSAYLGIHNLFDRKYWNWSDVRGIAADSNVLDAYTAPGRSVAVSMKVDF

SEQ ID NO: 17634 - protein, 370 aa, Ralstonia eutropha
MKKTLLAMALLAGFAGTAQAADSVTLYGLIDAGIGYEQVKFKGEKQSRVGGVQGVSSGSRFGMRGVEDLGDGLRAVFTLEAGFGPLNGESAQNGRLFGRQATVGLDSDNWGRLEFGRQTNIASKFLGSIDPFSLSYNTANLGTTFSSANTMRLDNMVLYQTPNMNGFKFGIGYSFNADDTQDDNGRSGFQTNDNNRVLTTGVQYLNGPLNVALAYDHMSLSNNLTGGKKADSVDAYVLGASYDFEVVKLAGAFGQTRDGWFVGQNLGTTPDGMNKFGSFVGADGFRANSYMVGATLPLGRSSVFGSWQRAAPNNSKLTGDDATTNVYSLGYTYDLSKRTNLYAYAAYADNYAFQRDAKDTAVAVGMRHRF

SEQ ID NO: 17635 - protein, 397 aa, Ralstonia eutropha
MKLKLAMLAATGAAALNIAAFAQEETGYYGALGAGYTFENEETTVSTDGAVRAGLTPFEFETDAEIEDAVNIYGAIGKYFPYAFRGELELSTRTQDVALVPGQAGVFAGFPNSGDDLGDITVTTLMANLYKDFPIDAAGRLRPFVGVGVGAAYVEANIENTIGSLPAVPSEPNSVSVDDEDYVPAVQGLAGLTLAFTEQLNVDLRYRYLWLSEGEFDGFVNDGGAALAYEYDAHEITAGLRWDFAPVAAAPAAPAPVQYKTCFDGSRIPVTQTCPPRPVDTAPEVTELEPLVVYFDYDKSNLTDAANTLIAARAEEAIDADVASVTVQGNTDTAGSASYNQALSARRAKVVSDALVANGVDQSAITVEALGESNPAKPTGDGVREPLNRRTEVTFGF

SEQ ID NO: 17636 - protein, 376 aa, Ralstonia eutropha
MKKQLITLATATAMTAPAAVLADSHDSHSPEIYGQVHMSMNHIDNDDTEGEDSALNISSNSSRFGIRGSEEIQPGLTGIYQLELGVHWGGQGSDKTSTTGDDSIWRQVRDSYVGLEGDFGTLRAGRLPAANQYIYDANFFINTIGDPGGLTGFDIAGNAGIGGRYSSAVQYTAPMVGPLGASVTVAPSNNGADEHSMILRGTYEEGPFFGAVNYISKPDATVEDPEDDDITSQHDLQFLVLSGGYEQNGLRVAGLYGLVLDDDDLTDGAPEIDGEDSFFSLGASFDITAQGTVKGQYTAYMADEGSEGDSNLFAIGYDHALSDRTTAYAVYAHMDNDEMASRGVDGYGHGGGPDDLAGPNNDADPNAFSVGVTHNF

SEQ ID NO: 17637 - protein, 444 aa, Ralstonia eutropha
MHSPVRYLSLSIALALPSLAAGEGFFEDSTFKVFNRNFYMRQDFRNDSGFRNPQTGESKHMRAEWAHGVTATFESGFTPGPVGFGLDVRGLFGWKLDGGDGQVGDSNAGNGLIPRRGYNFDGKPKDDFGKVDVALKLRLFEDTVLRYGDYRPASPVINASDTRLLPQSFRGAFFENTSIEGLTLVGGKVESGSDRSATAHNGDLGTAYGGRFKEADDFIYGGADYKYDGRFFFRLHHGRLDDVWNQTALYGDWIQPLGGGWGFNTGFKYIRTRDTGKSLLGDIDNDSWSAHVGATHGPHALTLTHTRIDDDSPFDYLWNTWDFFLNTGSQVSDFNNPNERTWMLRYDYDFAALGLPGLTLIARYLRGTDIDGSKVGPGYAAYQNIRDGRHWERNFWISYVVQSGPAKDLTFKILQATHRVNGDHTAEADIDELRLIVEYPLSLR

SEQ ID NO: 17638 - protein, 729 aa, Ralstonia eutropha
MKIRLACIFSLAMVSFAFAETPLLNVEVNAHKTKENTPSKLVKTKKYTKAKEKVEKPLINKLTSSGGGNVFQALELLPSVNFQTQDPYGLSGGQITIRGFNNNQIGLTIDGMPLMDSGNYALYPNEYMDLENLEAETITRGGTGKASPLYSDLGGRIALRTIPPKDKLGLELEQIFGSYAFEKSFVRLDSGLLPLMNSKFFISFSHAQADKWKGPGQNPKFRDHVAFGWVANLNRLHIDFYMDENDQVNYYYRGLSYQQAQNLSAYKDFDYNGSLTGNPAIDQYYYKFFHNPYQNYEFRGDISFDVSKNFYVDLKPYYWRGRGSGTSASYNSKGNYINYGISYNYTKRPGFIAQAVFHKNPFKVTAGFWYERADLENFEPYFKLNNFQNGNYNTTFNYYGYIDKVYTTTQTPYAIFDLKDFHRFDVELGLKYAQVKRDYKEFNTNNLPYLPDDDIYNYPLSIIPSESYVKTYRKFLPSINIGYKINRYLYPYFNYAKNFQVPESYQGSPPGTTTQEIINNLSPEEADSYDAGVNITLGKFLIKPDIYYVDYKNKIVDFAEPNNPNITYPQNVGKVKAYGGELEVLGNLIKNLTLISSFSYNRAKFDNGYYSSSGTFLNVAGNQLPNTPKYMGKLGLDYKLYGFDIFPYLIYEGPRYGDSTNKQEIPSYVVANLNVSRDFNIFGKKFYGFLNVLNLTNKTYIGYIGTGDTSGTYYVAPPITVSAGLRAYF

SEQ ID NO: 17639 - protein, 1036 aa, Ralstonia eutropha
MKRKRVLLLLCILSCTLQLFAQQINVQGIVYDPSGETVPGANVSMKSNPAVGTVTDIDGNFSLKASVGDVLVFTFIGYEPIEYKLTAADTNLKVRFTDSSELLDEVVVVGYGVQKKSVLSSAVSRVTSEELDKGNPTNIQNALKGKVSGVQIISNSGQPGAESKIRIRGTGTVNNSDPLYIVDGMPSESGISHLNPSDIESIEVLKDAASAAIYGARGANGVVLITTKKGTKGKATLNYEFTYGIQNPSKKVDLLGSADYQMLMNEMAANAGKDPYFPTVSSVNTDWQKELQNKNAPIMNHKVSLSGGTDNSTYYASFGYVKQEGIYAKGHADYERYNVRLNYNNVLLDTKSRNWLNKISFGAIASYSKSIQTGNTIGNSEAAGLITSMNMLPPTEPVYQTDPAILEQYAVTYPNHVIAPNGLAYNIIEMREITNPLAAMQVSHNQRTMPQNFGANFNLDVDLLPGLKFKTTYGAEWVFNSIKNVTPVYELNATSKNATSKVEDKKRESSYWQWENVLSYTKSFGRHNIGALFGTSMSSYHYSNLEAEDYNLLVVDIDKGYIDTATAPEEQSKVWGGAEDHRIASVFGRINYNYDEKYLFEAVVRRDGSSNFSREHQYATFPSVSLGWVLTREKFMENRPSWLDFAKIRLSWGQNGNERIGSFAYTSMMSQGKNAVINGKVYTGMLPSGYANADLKWETSEQTDLGIDLRFFNSALTFSADYFVKKTKDMLLSMPIPLYTSYGSMTVNSGTVKNEGIEFEASYRFKVGEVNLGINGNASYVKNTVTDQGPDRVGLNNIGGGMGGQVSWRENGRPYGFFYGYLHDGIFQNQQEIDSYTYVDSNGKTQLIQPNAKPGDIRFKDLDGENGLNGDDRTMIGKPNPDWTYGFTLSADWKGVDFSAFFQGSIGNDIYKLYRRSNVTFGNYDKSWLNRWHGEGTSNWVPRVIDGDNNNYQVSNFFVEDGSYMRLKVLQIGYSLPGQMLQRVGVKGLRFFVQGENLFTITNYSGYDPEVGTRDGFDGGTYPQARTYTIGANITF

SEQ ID NO: 17640 - protein, 802 aa, Ralstonia eutropha
MDSTSSSRVRHPATLALLLVPLALPAYAQQTPDGAASTPAAAEPDGGAQVSTLDQVQVVGQAMTYSKTTVSKEMLDRQFVLGSVNDALNELPGVVVTEADAFGSSDWGTQISMRGFVSNRDTQQIGTTIDGVPNGGSAYGGGSKANRFIDMPDLETVEVSQGTADIASRSNEALGGTLNYLTGEPLEEQRVRVIGGIGDNQARKYYARYDTGLLGGHTRAWVSGSSARNDDWIDGSGHTRRDHLAGKFVSSLDKWTLSGYLSYDDADESEYTSVTPAQFARDPEHDLLTGTLTGIPYLDQNYRSGSRALRENTFGYLRGAFDGGNGFRTTLTGYAHRMQGRGDWIPPYLVDVTNDGAGAPESEARGGNTVYAGSDLGKLYYLTPGGAAATQLAGCAGSDAVPAESNPACYPAGSVPVQSYRHSHYDNHRAGAMADVEWRHDLGPIDNTVRAGAWLERYDRSVTRDWHRLLNVGTNISFDHQPYWVQFKDNYQTDEQMYYVEDVMRYGAFAWRVGVKQFFVDQTRDRRIGDAQHVESDAHSDPLLSAGLTWTTPVQGLEAFAGYSQNFAAIPSGVLGETDPVALSRVQPETADNIELGLRISRWPLTGSITLYDIRFDNRIVYVPANFVSGIDYLGETDGVYENFGGVHARGVEAALGYGWDNGWRINGAYTYNKADYLGSGDAARDAALEITPGAQVIGQPRNTLVVSADWRGDAWRFGVSGRYLGKRYLDASNRAALNGVTTFDANLGLELSQLSAQLKGMQVALNVSNLTDKRYLEGVDGSDSAFIAAPRTLGLTLTLDL

SEQ ID NO: 17641 - protein, 195 aa, Ralstonia eutropha
MKKGACIMKKFAAGTLFAVLALAGSGRLASAATPYATGSVGLAMLQDSDVEFAADRSYNTGYTLTGAVGLRSGEYRLEGELGYQENGIESSGDDVSILSFLGNGYIDFEMASSSFTPYLTAGFGLASVDDSSGPGSVDDTVFAWQLGAGVGYRFADNMLVDVRYRYLGTGDPELAGGREYSIDTHNFMVGLRVEF

SEQ ID NO: 17642 - protein, 705 aa, Ralstonia eutropha
MTVKKGSFPLSTIALGVAAATTVFAAQAQEYTSEEKMVVVSSHMPKAISDIPGTVWYIDSETIEQEYRGGKSLDEILAATIPSLDVSSGGRTHSGQNLRGRSLMVMIDGVSLQSVRSLSRQLDSIDPFNIDRIEVLSGATSIYGAGSAGGVINIITKKASGEEVEFESFVSGTSGVSSSEDFDYKLAQSIAGGNEKVQGRASVAYTKTQGYFDADGEMVTPDITQGSTQFNETIDLLGNLQINIAEGQQLNLLAQYYDSQQDTPYGLYFEKDGSGNFQFVDVREGYSADREQGTERVMLSAAYSNNNFLSHQLIAELSYRTEDHTFMPYTVDGKSTLSTNSSRQSTDILAMKAALNKSFNAWNLTYGIDGYIDKFDSDKAIYDQTTTEATGGLVHVISEMQGRYPGIDTQSIAGFIQAEYNITDDWSVQTGYRYQKMDIDVSDFQATSSSDFIPGGSTDYAEGLFNLGTLYHINPTSQVWANFSQGFDIPQLYRYYGKSATQDVAASKLEGIKTDSYEIGYRNDLDNISLQSAIYYSHSSATVQYEDDLSISGLADPKRVYGAEAQISYWATDMLQLGLLGHYVVTETETDTGWEDHKAMEASTSKAGAWVGWYDNDYSLKLQSLTMFDYEDADQRELDGFTVVDFTGNYQLPVGSLGFGIKNLFNEDYYTTWSQRAQHWYTGSDALYQYKGRGRTFTLNYQVKF

SEQ ID NO: 17643 - protein, 888 aa, Ralstonia eutropha
MNPKVCVSALALLAMLGEGGLASAQTVQDDVITITAGRAPGAQSGDRPVVTLDAEALRASGLSDLGDALAFSPAIVGSEFNDDPGTQNDTSGTSSVNLRGLGLGATLVLVNGVRQAPASVASDDGASFVDMNALVPDIAISRVEILKDGASPLHGSDAVAGVVNVITDDLFEGVEVALEARGPDGFEGAGFTSILSARAGETFGAWSVMGAVSYRDTDGVEGFETDFIPGTGLSALGQPGAYYIQAPGGGFEVTTPSGGPQVIIDRDCAAAGGQPLVLGADTAFGTPGYCRLDYGQFFSLVPDETRLNAYGALTGDFGDTRVTLRAAWADTQLTRGNSPSLPALSFPTIPVDNPGNYFNRDVTWNGRPRGVSAGAARRSFDHDTLRLEAGLAHDFDAFGRDWTAEGVLAFSRNELEATITDHIGDRLDAALNGFGGANCQPGASAGDQSAGCYWFNPFGSGSLVTDPNDPRYNDPALLAWMLGEDVRTSSSELSSLDASLTTAHLFALPAGSVSLTVGAHLRNERLDVDHGQTFNDDAFLFIVGGPDYAGERDVASLYAESVIPLHARARLTLAARHEDLEDFSSTDPKVGLAVDLTDALTLSANWAQSFRAPSLHQQVSATTTLQSLTIGNQSLFRPVRTVGSQDLEPETSDSYSLGLSWRHEGWTARVDAWRLEVEDLIIEESANAILAADIADDGLYNDPRVELSQAGDVVLVRANFVNAPRVEAQGVDIAFGHDNIDLGRFGVMTAGLETVYIDEFTLYDPVLNTEIDAAGNRNFTNFARSLPQWRTSVRAGWMNGPWSVNAQARYISPYDDDENAGAEIDSWTAYDLQAGWTSNVRGHALTASVGALNLFDEEAPFVNTPLGYDTKVHDARSRVLYARISVQR

SEQ ID NO: 17644 - protein, 1155 aa, Ralstonia eutropha
MKSSPMFGLVFLLAASSAFGQVISASVNGAVLDPSGSAVPGAKIHAVNNSTSLEINTTTDSDGRYTIPSLPPGGPYSITATAGGFSTEERAGITLELNQAARIDFTLQVGSVTDKIVVTGDAPLVDATTSAMGQDIAKQSMEDLPLNERNTYSFVFLAPGIQGDVSFTYNNMNFSVNGGRPGTTDILVDGIPSSPGLANPNQGIAVFPSVESVQELKVQTNGYSAEFGRSGSGIINLIYKSGTNHFHGSLFEFLRNSDLDANSFFSNLNNSPLPSFKRNQFGASLGGPVELPKLYHGRNKTFFFAAYEGQRRGSATTLTTTAPTQAQRAGDFTSLLNSAGQLVTIYDPTTTVAQGSGFVRQPFPGNVIPANRIDRVGKNVAAYFPLPNRPGATNTGVNNYFASGTATLTTDIFDAKVDEVLNERSRFFVRYSRLRLNQPAPRLFPAEVAAGQRSPDTQAQLNNSTSIDYTLTLSPTNLVEMRYGFARIKLDYRSISLGFDPTSLGFPSYIAANADHLIFPGIAPANYYSLGAPGQGDTRDPSFESHLLSVENTRILAAHTLRFGVEGRLLRVNDTESGSSTGNFTFTNAITQGPNPNAASTTAGNSIASLLLGVGSGSMGIALKDAATQSHYYAAFVQDDWKITRRLTLNLGFRWDLDIPRTERFNRLETFDPGAPSPLAGPTGIAGLRGGMVFAGVNGNDRRQFEPRWRDFNPRFGFAFQASQNTVLRGGFGIFYAPTLRGAGATVGSTGFGATTNWAGSPDGLTPAVYLSNPFPTGLNVQVGNTQGLLTGIGSSFETPLMGDNNVPYTESWNFDVQHQLPGGILIDAAYVGNHGLHLNMAGENTWNMNQLTPDIIALGTRLQQSVPNPFYHIVTTGPEAAATVPLAYLLTRFPQFTEVDNMFPTGGYSEYHALQLKVQKRFSHGLNWLFSFTGQKTIDDFSILSNVGNSTGGIQNIYDGKGERSLSSNDRSRRMVISGTYQLPLGKGKALGQHWNRAVDALLGQWQVNGIYTYQTGFPISVTAQNTCTNCGINTLRPNNNGQSAKLDGPVAERLNKYFNTSVFSQPAAFTLGNVARTLPDVRAPSSESIDFSLFKMFRPVERLTVQFRAEAYNILNQVVFGMPNTTINSNQFGVISSQANSPRSIQFGLKLLF

SEQ ID NO: 17645 - protein, 750 aa, Ralstonia eutropha
MKKVEQRKMEWATGTRLRAIAAAASVAFGVAAGQAHAQAAPAVNAGAAASASSAQNGAAASASAGTLPTINVNAASEGDGTVGLVAKRSRTGTKTDTPINEIPQTINIVTAQQIEMTGATDVNAALRYVPGFSSYGSDNRSDWYSALRGFTPTAYVNGLQVPNTINLSSWRVDPYMIDSISVLRGPTSVLYGAGDPGAIIDVQTKLADGERVREAGVQIGNYARKQFMIDVGDKLDPDGKYAYRFVGVARDGNAVTGPNNDQRVALAPSFRWRPNADTSLTLSATYLQDWGDISSNFLPAQGTVLPNPNGQINKDIYEGDGNFNYYRKKQWSVGYQFEQNLTPAWTFRQNVRLMHLSLDNGSVWGAGFSDDTLTTVNRWAGVFQMNYSRFDIDNNVEGRFATGPLQHTLLLGFQYNRQTATDSEWLAAAPTLNLYNPVYAPVTTAVFSDPNTTYRTNTYTTMNTFGLYAQDQIKWNRWTLTLGGREDWVNMRMDDRAAGTSTKADVTAFTGRVGLTYQGDYGLSPYVSYATSFNPLIGVNLLGGGLPQPTRGKQIEAGLRWQPPGKNLMLNAAIYQINQTNVITPALLSQDDTGTKSVQTGEVRSRGIELSATGKVTRNLSVIASYVYQDVKNVKANDVSLNNWPVDVPRPRQMASLWTDWTWHTGPLAGFGLGGGIRYQSASAGGADNALTVSSVTLFDAGVHYDTRNWRFAVNGTNLANRHYISGCQSTSVCIFGTDRTVIATAKYNW

SEQ ID NO: 17646 - protein, 743 aa, Ralstonia eutropha
MKFYSSHPMPESLAAAIAVPLLGLLPAAQAASTAVQLPSVTVEGEYSSYQPESAQSPKFTAPLADTPRTVQVIPERLIQDQGASDLEAVLRNAPGISMTAGEGGRPASDLPFIRGQNSASSLFVDGLRDPSTQSRDTFNLEQVDVVKGPDSVFSGRGGAGGSINLVTKTPRNQDFTEVQAGIGTAETYRGTIDGNWVLGENTALRLNLLGTRGTVPGRDKAVEFSRVGIAPSLRLGLSGPTRVTLGLYHYRHRRVPDYSIPYDPRTGTPITETIGVSRRNFYGLVRRDSGDTEDYAATVKWEHDLANGFKVENLARYSRATVEQITTMPELKTADLAKGLVYRNLRASYQVNDSFANRTDLRGTFDTGQWRHTFDLGGEFATSRRSRDRYKQEIPDAASPCSPVTDGNNPALCASLRAPDPHVDFPGTVRRNHNPARYHTDILSLYGFDTIAFDEQWQLNLGLRWDHYKTSGRNLPVRGAKPPVYERAARTDNLFNYQLGLVYKPRPDGSVYASYGTASTPSAVSDYAPADSISGTSQQLKPERSEAIEIGTKWQVLDRRLLVTGAMFRETRKNTSIEVAEGLRAPAGKSRVTGMELGVAGSLTPRWDVYGGYALLDSKLVRASHKSGAQGQPLPSAPRHAFSIWSTYKLLPELTVGAGAFYRSKVYGNADAGYNKDGTPKARWVPAYWRFDAMAAYQLNKHLTAQLNVYNLLDKTYYAKTYRSHYAALGPGRSAMLTFKLSY

SEQ ID NO: 17647 - protein, 240 aa, Ralstonia eutropha
MKKSLALLAFATLLPSAWTHADSAYINYRHQYAESTRMHADRVKFGSRLDSGWGFEGELKYKTAGDRQDVAFDNTVGNGHELTTSYQYRLNDKWMLTPSLALESIEKSTAYKMGLKLGYKVNDQLSVSGRYRYDSIKLDRDKVNHDMPDNQMDDQSINRYDVWVNYASKGPWAYEYQFTYFDADYIRYDNGRTDYEQNAAFKYRWDKHWVPFFEVGDIKVDSEDDKRQLRLRVGVQYNFL

SEQ ID NO: 17648 - protein, 74 aa, Ralstonia eutropha
TSGSRYYGTVINAGYYVTPNAKVFAEFTYSKYDEGKGGTQTIDKNSGDSVSIGGDAAGISNKNYTVTAGLQYRF

SEQ ID NO: 17649 - protein, 869 aa, Ralstonia eutropha
MKHKKKNRLVVAISVALIPYIGVTGDIPDSFRDLWGEQDEFYEVKLYGQTLGIHRIKTTPTHIKFYSPESILDKINLKKEKEKELSVFFTNSFSRNGNMSCQGNTTIQYNCNYIKTKSVDVIVDDVDNVVNLFIGNEFLDSEAHNDEYHQLSRNVKKAFIQSQTINLSDSGKYKRLSISGNSALGITDTSYAVLNWWMNYNKSNGYSNNEKTINSLYFRHDLDKRYYYQFGRMDRTDLSQSISGSFNFNLLPLPDIDGIRTGTTQSYIKNTDKFIASPVTVMLTNFSRVEAFRNDQLLGVWYLDSGVNELDTARLPYGSYDLKLKIFENTQLVREEIIPFNKGRSSIGDMQWDIFVQGGNIVNDNDRYIEKQNNHKSSINTGLRLPITKNISVQQGVSVIDNKSYYEGSLKWNSGILSGSLNSEFSFLWGDNAKGNYQSISYTDGFSLSFYHNDKRVDNCGRNYNAGWSGCYESYSASLSIPLLGWTSTLGYSDTYSESVYKSHILSEYGFYNQNIYKGRTQRWQLTSSTSLKWMDYNFMPAIGIYNSEQRQLTDKGGYISVTITRASRENSLNTGYSYNYSRGNYSSNELFVDGYMTSTNNGDYHEAGMRFNKNRHNAEGRLSGRINNRFGDLNGSFSMNKNRNTNSTNHSLTGGYNSSFALTSDGFYWGGSTAGLTKLAGGIIKVKSNDTKKNLVKVTGTLYGDYSLGSNDNAFIPVPALTPASLIIEDNNYGDNNISILAPTNNDMFMLPGNVYPVEIETKVSVSYIGRGFDPNGTPLSGAHVLNEPHVILDEDGGFSFEYTGNEKTLFLLKGRTIYTCQLGKNKVHKGIVFVGDVICDINSTSSLPDEFVKNPRVQDLLAKNDKG

SEQ ID NO: 17650 - protein, 387 aa, Ralstonia eutropha
MKLRSMALATLLACSGSAFAQSTVTLYGVADINIEYVNHVGAIPTAANQFNPGAAHSVFRMDSGGVSGSRWGLRGTEDLGNGVKALFVLENGFSLDSGALQQQSRLFGRQAYVGVQSSSLGQITLGRQYTSIFEALANFVPGAYATQYEPAALLTGANFREDNTVKYTGQFGPVTALAHYSFGTGLALPAFVGVATPIGGNGEVPGQARRDSAYGAALAYTQGPFGVTAGYDQWNPTIGTSSGTAKKAVIAASYTYGPAKVMGGYRWGQSKNAADVLIGRDDFYWIGAAYQVTPAVALSLEYDYDNLKNQFGNTSLANPWQVAFIANYAFSKRTDVYLSTAYAKNAGLALDSASNFYATSLATGNSYALPNGKNSMLGAAVGVRHKF

SEQ ID NO: 17651 - protein, 115 aa, Ralstonia eutropha
AGGGAFGYKMDDIRVDVEGLYSQLNKNDVTGAAFNPDTVADSLTAISGLVNVYYDIAIEDMPITPYVGVGVGAAYISTPLKDAVNDQKSKFGFAGQVKAGVSYDVTPEVKLYAGA

SEQ ID NO: 17652 - protein, 801 aa, Ralstonia eutropha
MPHRSISSHYRSLANTLGCAAAVLIATSSPVWAAADNSVQHYEIPPASLGTALNQLGQQAHLLLSFPNDLIAGQNSPGLSGDYTVDGALQVLLAGSQLIAVRQPDGRYTLQRAPASSALELQSISISGKAPGSTTEGTGLYTTYSSSSSTRLNLTPKETPQSLTVMTRQRLDDQRLTNLSDTLDATPGVIVLRDGLGAESDGYFSRGFEIQNFEIDGVPTVKRMDNYTQSMAMYDRVEVVRGATGLISGLGSPSATINLIRKRPTAEAQASVWAEAGNWDRYGTGFDVSGPLTETGNVRGRVVADFKTERSWVDRYKQDSQLIYGITEFDLTEDTLLTMGFSYQRTDVDSPMRSGLPTRFTDGSRTNLKRSLNSAQTWSYNDHEQTSFFTSIEQQFANGWSGKIELTHSENKFDEVFNYVNGGLNPDGSGTTQLPVRFSGIPRQNNIDAYLTGPFGLLGREHELIAGVTLSNYYENVPSYGGWKYDYSGSPAGAIDNLLNWNGNSVKPEFNVTGKSTNDETQYAAYLATRLHATDALSILLGSRVIDWHREIEDKPYNAEKTKTKESETGVYIPYAGVVYDVNDTWSLYASYTKIFNPQSSWVRDINNKPLDPMEGTGYEVGIKGSHFDGKLNSSVALFKIEQDNLAIWIDTPGGNTYKSEQGTTTKGAEFTLDGELAEGWQASAGYAYAVSTDADDQRIVTTLPRHSLKTFTSYRLPGILNKVTLGGGVNWQSKTGADLHTFTQGSYAVTNLLARYDFNQHLSASVNLNNVFDREYLSYAGDHGMYGAPRNIMTGIKYNF

SEQ ID NO: 17653 - protein, 668 aa, Ralstonia eutropha
MQKNIMLFVVFLLSISVFSQEDLEEVKITKKQKGIKKSYTLTSNTSLITSKELLKAACCNLAESFETNPSIDVNFSDALTGTKQIKMLGLTSPYLMITEENIPSVRGASQAYGLSFTPGTWIESVQITKGAGSVINGYESISGQINTELLKPLSDIPFFLNAYSSTDSRFELNTHFNKKLSDKWATSLFVHGNARVAKNDMNHDGFLDNPLGKQINVLNRYQYYDPESGLVSFINFRYMNDKKQTGEVDFDKDRDRGTTNHWGSEINTERFDVSTKIGYVFKDMPYQSIGFQNAFNSHKQDSYFGLNLYDIKQNSFYSNLIFNSIINNTMHKFTTGLNFSYDQYQEFVNANDYSRIDNSVGAFFEYTYDNTDNFSIILGGRVDNHNRLGFFATPRLHVRYNPWKNGVLRFSAGRGKRSANIFAENQQLFASSRTFSILDKNGKIYGLNPEIAWNYGISFSQKFKIFNKNAEAGFDLYRTDFQNQAIVDIMQSPQDVLFYNLKGSSFANSLQVEFNYELIHNLNLRTAYKYYDIQTDYLRGTFQRPLQAKHRFLGNLEYETTLKNDKQWKFDYTFNWSGKQQLPYTASNPAEDQFPDFSPSYAVMNAQVTRVFSPVFEVYAGGENIGNYKQQKAILGANDPFGPNFDASVAYAPIFGQMYYAGLRFKIK

SEQ ID NO: 17654 - protein, 783 aa, Ralstonia eutropha
MKARQTIRAFALASAAWSGLVALPALAQDAAPPPAASEEDSAAIVVTARRREETLVSVPIAVSAFSGAALERSGAIDISDLANVTPNTTLEASRGTNSTLTAFIRGVGQQDPVSGFEQGVGIYLDDVYLNRPQGALLDIYDVERIEVLRGPQGTLYGRNTIGGAVKYVTRMLPQEFSLKVKGTYGSYDQADGIISASAPIGDLIRVGGAFARLSRGGFGKNLTTGEDNYNKDIWAGRATFEMGGYGEPVLMRITGDYTKDNSNARGGHRLIPGQVSGAPVLDDVFDTRGGLADPKQYVKSYGLSMNISAELSDAVTLRSISAWRKDDSASPIDFDALPAVDVDVPAYYFNEQLSQEFQLLYDNGPLKGMVGFYYLDASADTQFDVRLFTTVPGLTAFTQANVDTETYAVFGDFTFDISQQLSVSAGGRYTWDKRRADILRQNYLGGGSPVFGGEGTAFGAPSTNFRGESEFKKFTPRLSVSYKPTPDHNIYASWSKGFKGGGFDPRGVGVNAPDLNGDGIRQDSEVASFLSFAPEEVDSYEVGYKGNLMDGALYVALAGFYADYKDVQIPGSVACDVGGIPSFCGVVSNAGKATFKGVEFESNARLARDLMTPGDRLNLQTAIGFIDAKYKEYITNIGGVPTDVADFREVQNTPKWTASGTLSYQTPVGDGNIYAGTTVSWRSKTYQFEIPNPYIDQKGYALWDASIVYTAPDDRWSIGLHGKNILDKEYKTSGYTFVLADPTTGAIVNNAAGFPTPSLGREGTLTAFYGNPRQVFVTGSIKF

SEQ ID NO: 17655 - protein, 431 aa, Ralstonia eutropha
MPVNTSQRHSPTARLAGGCIAAALCAEATAEVEAGFIEGASATLQARNYFFSRDYADIKGASTQSRTQEWAQGFILNATSGYTQGPIGVGIDVTGLLGFKLDSSPAHARSGLLPSLDSGQSADDYSRLGAAVKFKVSRTELKVGELMPNLPVLLFSDLRLLPPTYQGAMLESREFAGLTLSAGQFRSTSLRDSSNSQKMYALVNDPINPSRLARFTSDRFNYVGADYAFNDNRTQVGVWQAQLEDIYQQRFYSLKHAEPLGDWTLGVNAGYFDAQEDGRQIAGRYDNHALFSLFSAKTGGHTFYVGYQQIGGDDGFIQVGANTNPMGNTLPTYEFAAPGERSWQARHDYNFVALGIPGLTSTLRYVKGRDVETGLGFEGRDRERDLDLAYVVQSGPLAGLGVRIRNVMARSNYRTDIDENRLILSYTVKLF

SEQ ID NO: 17656 - protein, 364 aa, Ralstonia eutropha
MKLARIAAGLAAAFPLLASAQSSVTLYGVIDTGVEYVSNVGANGDGLVRMPNLTATVPSRWGIRGTEDLGGGLKSIFVLESGFSPDSGTSNQGGRLFGRQALVGLSNQYGQLSFGRQYTMLFWATLDSDVLGPNVYGSGSLDSYLPNTRADNAVSYKANFSGFVVGATYSFGRDAVNAGPSPSGTNCAGENATDKKACRQWSAMLGYDNKTWGVTAAYDSQRGGPGAFGGLTNSNLTDDRLSLGGYMLFQRTKIGAGWIRRDNEGSPTPISDLYYAGASYDITPAVNLAGQVYFLNYHGSDNQAMLYTLRAMYSFSKRTSVYATAGFINNGGQLAMSVSGGSPGSNPRPGENQWGSMIGIKHVF

SEQ ID NO: 17657 - protein, 255 aa, Ralstonia eutropha
MQAIARHSRAATAFAAAVGSLIPALPAQAQAQTQTQQSAQAAQAAQAAQAAATRTPSADLSAPSPWRIYAGAAHIGFSTSAEVRAGGQLVPGANAEADSNISLGFGAIYDFHPGWSAEIALGLPPTTALKGTGTLSSAGTLGKVKYGPAVLSVRRHLWEDGPVRPYIGAGINYTLVLESRDGFVSNLDVKNGVGPVLQAGFEVPIDPRWSFFVDAKKIWLKTTATGTLPALGGAPAHAKVRLDPLVVTAGVSYRF

SEQ ID NO: 17658 - protein, 187 aa, Ralstonia eutropha
MKSNVVTLVGLFSLTTFSTLSYAADSKDHGVYVGANYGYLKVDGQDDFDDDSDAMQALVGYRFNRYLALEGGYIDFGSYGNNLANAETDGYTAALKVTAPITDRVDVYAKGGQMWYSTDYNVAGFHGNKDDEGVFAGAGVGFKVTDNFLVNAEYTWYDVELNAENVFDGANTNTDFKQASLGVEYRF

SEQ ID NO: 17659 - protein, 385 aa, Ralstonia eutropha
MRRPSTWATKISQSVDKESVDMKMKLFAAAVAALAAGGAYAQSSVTLYGVADVGLEYVSKANAAGDDLFRMSSGNQSGSRWGLRGVEDLGGGLKGVFVLESGFDLDDGRSAQGGRLFGRQAYVGLQSNYGSLLLGRQQTAFYDFGLIYDPMAISSRYGILSQDAAFASRADNTVKYIGKFGGLTASAFYSFNSNGQETPGAFRRGQEYGALLNYAAGPFSVGAAYDEIHGTTTGPATAPVDASGQRIRRATVGANYAFGPAKVYAGYRWAKAADGASLPGQVATTANPLGINGTSNLYWLGLGYQLTPAFSLSGAAYYQDFRKSDADPWQFVVTADYALSKRTDVYTSLSYALNDNGSLLGVNGFNTVQSGKDQFGAVVGLRHKF

SEQ ID NO: 17660 - protein, 339 aa, Ralstonia eutropha
MKKSLIAIAAMAAVGCASAQSSVTLFGVLDVGVAHLTGTGISKTGVSTGGANISRWGFRGTEDLGGGLAASFWLEAGLDVDTGSGKGAGGGLSFNRRSTVSLSGPFGEVRLGRDDSATFLSTLIFDPFLTNGVGGNMAFIMLGAPIQISNAVSYFLPGNLGGFYGQVQYAFGEPPATATNTHQGNYAGARFGYRSGPVNAALAAGKLKGATAAQDIEIRNVGASYDLGMVKPMLLWATEKTGTAKITALELGLTAPVGAGEVRAQVSRYDTASSNADWRKYAVGYGYNLSKRTQVYGSYGHLSNKAGAQKSIGVQGLTATGTTLGGKSSGYEVGIRHSF

SEQ ID NO: 17661 - protein, 872 aa, Ralstonia eutropha
MSLKKRVLASTMLSAAMGVVMGGAAVAQVDRIVVTATKTEQDSQDIPVAVSAIGENDLEELDVDVFADYLVQLPGVTAGGSGPGQNTIYIRGIASTTPNMTTAGVAGLAPNVAFYLDEQPLAQPGRNLDVYAVDLERVEVLPGPQGTLFGASSQAGTVRMITNKPAIGLYEAAANFGVSFTEGGEASYKTDAMVNLPVSDNFALRLVGFWDQQGGYIDNVQGTVNTSESARFRPAGTVRANGVPVSARRAGFQAGSDLSGVTFIDADNSALVEDDFNDTTYSGFRISGRYEFNPDWRLTVSAMSQQLDSDGVFFQDPELDDYEVSRYSDETLQDDFVNAAWTLEGRVAMLDVVYTGAFTDRDTDQIIDYTEYMFVGQYFPYYTCEGSVTYPGAAAPSGTCYSPQSLVDSTTNTQVESHELRFNTPQSERLRVTAGGFYSSTEVEERNDFTYFGMIQADPFGPFAPNFPFTTGFTSDPGPFPEGVIFRNDVRRTDEQLGVFGEVSYDLVPGVFSVTAGARYYDIEVDLAGSANASFCNSGGTDANAFGTDISDLYNGDGQYTFRGTCDTSRHITYNDTQSIADIMAIDPALSMSQAQQIFNATRAPDVAATDGAIYKLTGTWTPAAGVLLYATYSEGFRPGLLNRPGGAPGPNGYTVPFAIDSDELTNYELGWKLDLFGDQLRFNGNAFFVEIEDLQTTIFDPSIVNLFFSDNAADAEIMGVEGDVTWAPADVPGLTVSGAFSVLDSEITEVLTPTDDVVEGEELAYAPSLQLNARARYEWQLENSWTAHVQGQVIYSSDSRSDIIEINAIDVDSYATLGLRTGLTSDNWTAEIFVDNVTDENAELANNFVNDRERVTVMRPRTYGIRFGISY

SEQ ID NO: 17662 - protein, 908 aa, Ralstonia eutropha
MNRRFLRLLLFLGFFFCDDARAGVFEVSLSSDDGDEHSLRWAVEQVNASVDADNVIRFTTETVTLSKALPVLTNNVAFEAPAGGVSISGGVYKSALFKWESPVEIAVSESAELSAAASSLISVLRSTDDLVVNGGFSSTISVEAESQYSFGIRSDKSLVINGDVTGSVDATAGKRGANALYSKKAGLIDGSIAGTITATAGTYNASGVNFSSGLVITGDLGGVITATAGEYGAYGLKLSGGLTVGGDISGAINATAMAGNKAYGITAESGVNLIGGVSGCIVASAGGTDAAGIYVSGSSLDGGSLSDAAEISGTITASSSGASAAIMAWTEMNLNVTGTLSATGASAYAIRSGNFDGAGGFVDNTEERVDRVVLGSGAVLTGSVFLGDGDDVLTLSGTADISGVPELLGGTGDDRLVFSGWNGAYSSAMQGWEHLDVGIGSSVGMDALGSFSGEVSVLEGAVLRAGGAGHGDRIAGSLANSGLIELRDGNAGGSLRVDGGYAGGGSVGLDVGAGSADLLSLSGTVSGTTTLLLSVAPSVTELAAAEPSLLVHTRSVVAEDAFVVVDETDYGPYAASLSVVEDGTGATDWYYAVRGLDDEAVMAQALMPFLAGPIESFVPRFLERRAYGGEKGVSPEIGGAWVRAGKLWNSKELRGDAGSVAEGSFRFVQLGWDVLYRRSGKLLYGAGVFAGTGTETGSVSTPGGKALGELEGTFYSGGAYGFVSRPGLYRCELAAGSGLHELDVRYETAPKERVAAGSIFVSAELEVLLPLGHGVALSPRLQGLWRHVDGFSLAPLTTGRLVVDDDERIMGIGGLGVVLNTDCPGWYLVAEGTVRFEPNPLNSVSYPETGVTLETSGDRYRFGGSVTIGNRAGGVLDPVYWVKAGTMLASGSTDSFSHTVEVGVKVPF

SEQ ID NO: 17663 - protein, 355 aa, Ralstonia eutropha
MQKQYKPALKLAAVAATLFSGAAMAQSSVTLYGQADMFVGGVKSPGSGERAWVANSGGMQTSYWGIKGTEDLGGGTKAIFDLNGFFRTDSGNSGRFNGDSMFSRNAYVGLQNDKAGTIKLGRNTTPYFISTILFNPLVDSYVFSPTIFHTYFGAVSGAVADPGIIGDSGWNNSLVYSTPNFGGLTANFIYGFGEQPGAAGKQKFGGNVLYFNGPFAATVAYQQVRFNNVPTDMSDIGLSRQDAAQIGLSYDFKVVKLFAQGQYIKTRATTAPSGDIKHIDGQFGASVPIGAGNLLASYAYGKVDNSLGDFKRNTFAVAYDYNLSKRTDVYAAYYYDKITGIEHGDTFGVGVRHKF

SEQ ID NO: 17664 - protein, 796 aa, Ralstonia eutropha
MKLRSLFAASTAVGGAWLWLMASPAFAQDNRPATGDAAGAVAAEADPSDNGGLGEIVVTAQRRSENLQRAAIAITAVPAEALVRLGVSDTNQITRVAPALQVSTLAGTSTQLYLRGVGNFTTNSLSDAAVSVNLDGVAIARSSAIQGFFYDLERIEVLKGPQGTLYGRNATGGAVNIITAKPVFGETSGYVNAEYGNFDAKKLTAALNIGVDERSAIRVSGYFSNHDGYYSDGTSDDRTRAGRIQFASQLTDTFKLTLGADVAHVGGRGAGATVNGLDRDKRIGLADAPAQAIFGSSFSFLAGNFLHPLPNDAYSDNTYFGFYAQADINTPIGTLTILPAYRRADIDTLGYGGGFAFLEGLKADQTTIEARLASDGDAPLSYIVGLYYLGEHAVERANFNQQYFAAYGLFDSNTDSYAGFGRLTYKVTDSFRLTGGLRYTIDDKRALIDSYNPIVVCPAVFAGGNCIGNTPALPVQSLVPSSLILPNGDPIPVLPWGTAGAIIQDSRPVLTPSKKFKKLTYRVGVEYDLGPQSLLYASYETGFKSGGFFSSIDNPVYQPETINAITLGSKNRFLNNRLQVNIEGFWWNYKNQQVSHFRLNSQGGTEFVTENVGKSRIRGFEVEVRGRLGGGTTVSGTVQYLDAKYRNFTYANPSNLGPPVTGCAFAPNGDGSQFIVNCSGRRAINAPELSLTGGIEQIFDLGDSSRIVINLDGRYQSKIFTGFEQLPQQSQKGYFMADAQVSLELRNPGITISGFVNNLTDRNVVSFSTPHPRASQLVVESLRPPRTYGVRVGYKF

SEQ ID NO: 17665 - protein, 742 aa, Ralstonia eutropha
MAVSTSAYANETTIEEVTVVAKPTSYANNVIEPAMLEQQSTVSSVLSVIDNLPGISINEGDAFGGDDWSTTITMRGFSIDGNQQQLGMTVDGIPNGGSNYGGGAKANRYLDSENLATVQVGQGTSDIKSASLEALGGTFNFVSKAPSLEKSTTFAYTSGSHDATRYYLKHETGTLFDNTQAYVSYSQTDTSRWIGSGSNGGKDNQHAEAKFVTTLTDLTITGRISYDDVSETNYNSVSLAQFEQTPDWDQLTWNWTGVPHFDQMFAEGWGTLRENTLAYLKFEYAISPTSLLTVSPYYHKNSGRGDWIPPYLTTPVDENGNPTTEGGSNAGSYGFTDSEGNPLEPNADCTASLSWPWESGPGLNPACYDAGATPVMSYRHTHYNKDRLGVTAHYAATFGMHDIEAGFWYEQSDRDESRDWHKVIDARIYHHYDSTPYWTQYKNTFEADTLKWYAQDSMAFGDLTLNVGVKKYLVDIEKFDHYQNATTAKVNSDSDILFSGGIVYQLNNSTELFTSYSENFAAIKDGVLERDSSDLSAIEPETAENIDLGVRYQNDALKLIATAYSIEFDNRITFIAPGSDTGGIDYTIGTNGSYLNVGGIESQGLELSASYMLSPEWSFYSSYTNNNSEYKGDAPGFEAGDKVIDSVDDLFVLSTDYYSGDFRFGLSAKYTGERGDVDSYTVLDLNAGYATQVDAGPFKAIDIAFVVYNVTDESYLAGGTGNGSTYFIGSPRTAAVTFTATF

SEQ ID NO: 17666 - protein, 354 aa, Ralstonia eutropha
MLARCVLGAAVAFGAGGHSIYAAAQSSSVNLYGVADVGLVHENGAAAGSVTKVTSGMMSGSRVGMRGREELGGGTAAFFTLEAGILMDTGASGQGGLLFGRQAYVGLDASPGRITMGRQYTTLALAQVEFDPFVTGLAGTSANLISAGGRGGSNRVDNALKYNLPGTLGGLDGELSYSFGEVPGSAATNSQFGASLGYSGGSFMGRVAYADAHDANGPGKNAREVFFGAKYDFGLATGYLNYVINRGAIIPGTPNFKSEDVLVGASIPVGAGRVVTSYIYKNDRTDADNDAHQFAIGYVHNLSKRTRLYTSYAHIWNRAANTAKSGFYRVWNANDVGNPLAGNSAFNVGINHTF

SEQ ID NO: 17667 - protein, 1118 aa, Ralstonia eutropha
MTKEQSYTRFWEGSKRMWITFLFFSFIMIGFVQAANTAFAQTTVTVNVQDATLSDVLWEIQRQTDFTFIYSTNDVKNVKVRNLRVTNGKIAAVLDECLKNSGLAYVVKDGAIAIRPANEVNAVKAVEQANVISGTVVDETGEPVIGANVLVKGTTNGQITDLNGGFSIKVEHASATLLVSYVGYVRQEVKATSGKILKIVLVPDANMMEEVVVTGYGTFKKSAYAGSAASVKNEKIADVPSVSFQDLLQGNATGVQFTSASGQPGSSASLSIRGMGSFNASNSPLYVIDGVPVTSGSINSISSDGGLDAMSTVNTSDIENITIIKDAAAASLYGSRAANGVVLITTKKGKTGKASISLKADWGFSDFAMDYRPTLSGAERREYIYNGMVLGQQRSGKSDADAIAYADKNIDKYAPVPWCGYTDWGDYLFKKGSHSSYEASISGGTDKFKYYSSLSYLNQEGIVKTSGLERITGRLNVDFQATDKLKFGANIMFTNLNQDVYSEGTGYTAPFYSSVSKLTPSDPVYNEDGSYNQDLISLSRRNPVLAQEYNYQREYVTRMFNTINAEYEFIKDLKLKSILSYDYNISKGKEWKDSRTSDGEKNNGGAEKAYSEYNKLVWSNQLTYKTTIQKDHNLDALVGYEIDSKYNDFLSGYATNFLTPIKNDIANGQTLESIDGSSKRSRMVSYITRLNYDYKNKYYLGGSYRMDGSSRLHRDNRWGSFWSVSGAWRIIEEDFMKPTSKWLTDLKLRASYGVNGTLPSDLYGYMGLTSLSGGYMENPALIQSQIENRDLEWETNYNLNIGLDFGFFNRLNFTLEYYTRTTKNLLMDCPVSMTTGFSSYLMNIGEVKNQGVELEINSKNIVSKDFDWSTSFTLSHNKNKIVKLDGEQTQIISGSQIHMIGKSYRTFYMIEFAGINPETGAPQFYTNDVDENGNYIKEITENNKDAKAIPLKKHAEPNVTGGLSNTLRYKWFDLSFMFSYQFGAYGYDNWAQKTEHGGKDFTLNIPAYYRDNWKQPGDISKYEVFIEKPAVAMNGVTTTRRLHSTDFIRLKTLTFGVTVPKTWTRKIGVNSLRLYASANNLWTWAAYDFYDPESVSAGTAGWGTPPLKTVTFGLNLNF

SEQ ID NO: 17668 - protein, 844 aa, Ralstonia eutropha
MPAMPTTDIRIASGLRRAPLCLCLSLALASTLAGPALAQQTTASPPARAADDGIFSLDRMIVTGAGQAQSQFEASYAITSMTAEQIDKLAPLNLTSLIGSMPGIYAESTGGEVQNVYRIRGIPDEGSFAVIQEDGISPYPDNNGYFYKTEGLVRPDVMVESVETVRGGPSPIFASNAAAIVNFVTRQGGDTPEGAVRTTVGDTGLYRLDGYWSGKLAQDWYLAAGGFVRRNDGYRDVGFPADEGGQFRMNLTHTLDHGKITFTAKHLDDKNAFYMPIPLYDPRDTTRSLDPLIDRFTGTLSAPQLQHATLISSDANGQPQREARDLSDGRHMKFNHLGANLDLAFDNGWSLSNKAVVNRLDMTFDALYSSNAPQDATAYANSRRAAASAAFPGLSRLGYVYTDDGSRFDPASTDGLVIQGQYRAMDVRADSIADDLRLHRSFDWGGDTHDITLGLYGAYYARSYNSRYQSYLFEMRQNPRSIDLLGYDANGAVVGGVTQDGVVIYGADRTQGKAYTSMLAPYIADTWQVTDKLRLEGGVRHERYRYRAWAMARTTGTLGMPDTLADDAARLFTGARTQTALDVGVTNWTAGFNYDLTPIVGVYGRASRAHRAPSEGANEGNVNIPTAEQYELGTKLNFATLDVFATAFYTKYDPYNIGTSAVNPLTGAAESKDYRGSVTNPGVEVAAVWTPAQWLRLDANVTYNDTKVSDLTEVVANGAVAVVDVDGNMPNRQPKLYGNVGPTLLFSTGTFDWETSLRYAYVGKRYADLENTTELAAYHTLAANILVRNGPWDVQLAVDNLTNTFALTEGNPRTDTISGQGTREPIYGRPIYERNTRLVVTYHF

SEQ ID NO: 17669 - protein, 367 aa, Ralstonia eutropha
MKRKGMAVALAGIATAAGAMHAHAQSSVTLYGVVDSGITYTNNQNGHAAWQATGGNEQGTRFGLLGKEDLGGGTRAVFRLENGFNIESGAASQGGRLFGRRAYVGLENDRWGTLTMGRQYNAAQEVLEPLQIGATTALTQYALHPFDTDDLNNTFRTNNSVQYQTPTWYGLRAVGLYGFSNSTSFAQNRVWSLGTSYENGPLQLGAAYVRVDHPALDTTGAAASDNYYTFIKGVTRQQIWGAGGAYAWGAATFGLLYTSSLFNLQTGGAMRFNNYEGSVRYLMTPALQFALGETYTQVLASQGPKPSSHYLQTSVGAQYFLSKRTDVYVNAFYQRASSNAVAAIEGISNPSSTRTQIVAVTGIRHKF

SEQ ID NO: 17670 - protein, 673 aa, Escherichia coli
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNIPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 17671 - protein, 673 aa, Escherichia coli
MKMTRLYPLALGGLLLPTIANAQTSQQDESTLEVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSLSDGSPDPYMRRCTDSQTLSGKYTTDDWVFNLISAWQQQHYSRTFPSGSLIVNMPQRWNQDVQELRAATLGDARTVDMVFGLYRQNTREKLNSAYNMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 17672 - protein, 673 aa, Escherichia coli
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIFNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 17673 - protein, 1028 aa, Ralstonia eutropha
MKSFSDKTNIGTYVTLKTVYMIRFYLLLLLTGGILVIGATQVYAQQSRTISSVVKNSQGETIIGANIVEKGTNNGTITNVDGLFTLRVSPNAVLKVSYMGYIEQEVSTRNKSKLEITMVEDARLIDEVVVVGYGSVKKRDLTGAVTSVKSAEVLAAPTSNVMEALQGKIPGMDITKTSGQVGGEVSILLRGSRSIYGNNEPLFIIDGIPGSYSQVNPSDIESVDVLKDASSTAIYGSAGANGVVIITTKRGKEGKATINFDAYYGFSGSPNYKHGMTQDEWVTYQKEAYRYKNGDFPSDMSALLGKQAFTDAYNAGKWIDWVDEVSGNTATTQKYSLSVSSGTEKTRIFASTSYNREEGLLSNENLNRYSLRLNIDQQLFSWAKVGFTSNLVYRDLNSGVKNTFTRSLSAFPLGDAYDEEGKINHEYITGQYSPMGDFIENQYANNTRSTYLNMSGYVELTPLKDFTFTSRINGTLNHSRRGQYWGNQCNANRPSYAGSPHASITNDNAWNYTWENILAYSTTLAKAHTVGGSLITSWNKNQSESNMAAASGQMVDQWSFWRLTSGSSPHVESDFAQTQKMSFAFRLNYSYKSKYLFNFSTRWDGVSQFSAGHKWDAFPAGAIAWRISDEAFMEKTRSWLDNLKLRVSYGITGNSGGTDAYSTTTQAYVYSASGVSVNGKIVPFTQYSETYGSADLGWEKSYNWNIGLDFGILNSRIDGSIEWFRTTTKGLLFKRILPITSGLTGWGSPLSIWQNIAQTSNQGVEVILNSHNIQHKDFTWNTTLSATWSKEKIDKLPDGDLISENLFTGEPIHAIYGYKYAGIWGSDTPKETLDAYGVNPGFIKIETVDKNGDGGVHKYSTDDRQILGHTNPDWIIGLNNSFTYKNFDLSVFAMARYGQTINSDLLGYYTAEQSVTKNQLAGVDYWTEDNQGAYFPRPGTGDEQKTVYPSLRVHDGSFIKIKNITLGYTLPANISRKVLMEKCRIYATAYNPFIFVKDKQLKDTDPETNGSDAFPTYRQFVFGVNLTF

SEQ ID NO: 17674 - protein, 704 aa, Ralstonia eutropha
MFLFRDKRSNPRLHPLAFATKVAVATLAGGMAAHAAAETLALAQPDRVKQSASTTLAPVVVTGEKIDRDLQESTSAVTVLDDLKVDSGETQSVFEVVDKVPNMIANPYGVPNIRGVEGSGAANGSFALVAGSRPKVSTSVDGVSESWFGQEYVDANLWDVQQVEVLRGPQSTTQGRNSIGGAIVVLTKDPTYHWESAIRAGYETADSKQQLALMTSGPLIDNELAFRLAASASQGEGYIDYPISDQEWPWDPSESKRYNLRGKLLWEPSALSGLSVKFTATHRSQEGEYLNFVNGDFFDYELNGDVSNTRYQDSDSASYALDVQYALNDALTAYLTLNHADTNAKFEEYASRVRDIDLRLDLEERSNSLEGRLVYDPASGSLSGVVGVYLFKRTQDLAVVPATFTGDDDVSTVAVYGDATFALTDRLDLILGGRVERESQERNILAWPDTSYEGRLLTDIGETMFLPKAGVSYQATPQTTLGLVVRKGYNPGGGSLDWDDSSFYEYDKEEVITYEASSRSSLWDNRMTVGVTLFANEYDGYQSILNRRFVNIPQGRSYGLEVETNAQVAAGLEVFGSVGLLKTEVTEAVAGGPDIKGNEFSYAPSVNANLGFTKYFDQGYFAGADVSYVGEYYSDVTNNDDLTAGDYVITNVNAGYENDDFTVRLYVKNLFDEEVLYRQTTTWATTEAQIGPPRTAGIVVDYRL

SEQ ID NO: 17675 - protein, 829 aa, Ralstonia eutropha
MISDTEPPFRPRPDDPGRPGAIIVARPCISGPAFVLILASSLALPGEGRAAPDHFAFNIPAKPRSEALIDLGVQARVTLGGVSACPGRSPAVVGTLTLRQALGALTAGAPCRFEILDNATVSILPARLAPRVVTPAASSTPPALAAEPVRAIDSVIVTATKRPMRLGAAAGGVSVIGAERLWDTGAIDTTSISQQAAGFITTNLGAARNKIMLRGLSDGTFTGRTQQTVGTYLDNIPLTYNAPDPDLRLIDVDRVEILRGPQGALYGGGSLSGIYRIVSRKPVLNEGSATALAGAAATESGSPSSRFEGVVNLPLITDRAALRLAAYNNLDGGYVDDVNLRLSNVDRTTRTGGRAALAVVLNDSWSLILSGARQDLHATDSQYTTPSLGGQRRANQVRETHDNVLQQGAVTVTGTGDWGRFESSTGYVRHRFASRFDATAALNGAGETAIDVGLFDEASKVRILVEDAVLSSPDAGRFRWLFGLYGLASLEDGDGELRARTAFDPSRLVYLEARRDRRREAALYGEASYDLGGGWTARLGGRAFSNAVHTISTIKAPAPGQSRAMDRKARFTGLSPKFSLQRSLGADGLLYLLTSEGYRSGGFNSGGLVAPSTLRGSFKPDHLRNYEIGASIRPLEGRLLLRAALFHDVWTDIQTDQYLSSGLSYTANVGDGRNSGLEIEGTLLATPSLTLEANALFNRPRLSKVDPNFASAAQSELPGVPDVSAGAMARYQKGLAMDRWLVLTAELEYVGRSRLTFDRRLSPSMGGYVTGRLSAEVAAPRWNLAFAVTNPANASSDTFAYGNPFSFGQVRQVTPLRPRTWSLDISRAF

SEQ ID NO: 17676 - protein, 630 aa, Ralstonia eutropha
MRSSLHRSTRPASPAVRPFVPAILAAMASFTLVPGTASAQAADSNAAQLAPVVVTSTRTAQAITEALPHTTVVTQQDIANAQAPDLRTLLRSQAGVEFATNGGMGSNTSLFMRGANSNQALILIDGVRVSSASSGTAQLANILPDQIDRIEVVRGNVSALYGSDAIGGVVQIFTKSGAGQPPAANAAVEYGSNNTRQGTVGYGGQVGDTSFNLTGSAFKTDGFSSINTKQAPRANPNDNPYENQSVSGQVKHRFTPNWDAGITGYYSKSKLSFDSAFGRPTDENRTNSELYTLSAFVNGKLGADWTTHFKLAQSEDRSDTFLNGRPNGTFNTRNRQFNWQNEYALAPSHTLLFGTDYLQQELDSSAYGAPTRNVFSVFGGYDGRFGKHQLQLNARNDHYSDFGNQGSFFAGYGYNLTDAFKLIANVSNAFRAPTFNELYYPNFGQPNLQPERARSLEAGVQYTTASAGLLRVTAFETRYRDLIVSAQQPNGMFLAQNVNDAKVQGIEASWRARVYGTDIGASVTFQNPVDEQTNTQLLRRARRHAALDVGRDIGNWRFGGEWLLSSSRMDAGSRRLGGYGIVNLNARYNIDKQWFIAARVENLFDKDYQLAYPYNTQGRAGFITLGWRQR

SEQ ID NO: 17677 - protein, 589 aa, Ralstonia eutropha
MTAETGIGCDQNPVLFSKLARFLLLFCSSSIFLGLSSSRILAEDADTLEQLQRYSQEGRKNTSLTQVTSVSQLSDVYPTDWAFQALQSLVERFGCIAGYPDGTFRGNRSLTRYEFASGLNACLERINELLNAAVEGSLTENEFIALQRLQNEFAAELSLLRGQITDLEERTEVLVTRQFSTTTKLTGEAIFAVTQAFGDDIAFQGTEENRNQVVFQNRVRLNFNTSFTGQDLLLTRLQMGNAQLFDLGFTRQGTQTFNFRGDTESKVELERLYYQFPINNQLQLTLAAKGVTWDDFVPTVNPYLDNFDGGNGSLSTFGQRNPIYRIGAGRGMGLHYRFNEQFLNGIFGSTSVSVGYLSANAGDASQGNGLFNGDYATLAQITVTPRDNLQFALTYNHAYSTPGNFGFDNGLRNGLVVDRNRGNIDGNAINGVTGSGIANSILGLSEGINSGGIASGVVSNSYGLQASWRINRKIVLSGWGGYTDARVINIGDGQIWNFAVTLALPDLFKEGSLGGIVVGREPYLNDIDAPDELTFEFPNDQSWHLEAFYRYPVNDKISITPGIIFITNPNQDSHNDNILIGTLRTTFSF

SEQ ID NO: 17678 - protein, 191 aa, Ralstonia eutropha
MQRCLRVAWGIVFIFAFSVRAETKIYGDQRVSSWWNWLKNDVSQTWSEPQNYDLYLPFLSWHNRFMYDKEKTDNYNEMPWGGGFGVSRYNEEGNWSSLYAMMFKDSHNEWQPIIGYGWEKGWYLDSRRDFRLGLGVTAGITARDDFANYVPLPIILPLFSASYRRLSVQFTYIPGTYNNGNVLFAWLRYGF

SEQ ID NO: 17679 - protein, 727 aa, Ralstonia eutropha
MPAPPGDTLTEVSVTARRQPVDPDTPAVVESITREQIDAHTNVTTEDALKYAPNLMVRKRYIGDRNSVFAGRDFNELQSARGLVYADGLLLSNLLGSSYAYPPRWSLIAPDDIERVDVLYGPFSALYPGNAIGSTVLLTTRRPDKLEASLSTQFFTQRYHDGYGLADSFGGNHQTARIANRIGKFWFSLSLDRLENDGQPMQYASPNSAYNPKLGAAVPVSGAATDIGPNGKPRTIVGAQNIERTEQLNETVRMGYAFTDRVDATLTLGHWENHYRQHGETFLRDAAGNPVYGGNVSIGGRNMTVAPSAFAPQRGDQENWLYALGLNGRLDSGWRLSGVVSAYDVSRDVLRAASTVQGGAGTLFQGDGTGWRTLDLKAEAPEVKGHAFTFGYHYDNYFLRNVTYNTADWLAGPTTSLASVYQGDTRTQALFAQDAWRFAPGWLATLGLRYERWDAYGGALGNAGGTVGYADRGANALSPKVALQWDATDVWRFRVSFATGTRFPTVGELFQGTISNNAIVNNNPSLRPEKAIDWDFTAERDVGIGVVRASVFQSDLRDSIYSQTTVSGASTVTNISNVDRVRVRGVELGFSGRNVGLRGLDVDANVSASNAQILADTANPAYVGSRFPRIPRMRANLLASYRFDEHWLASVGVRYSGRQFNTLDNSDVNPDVYGGTSTFTVVDLKARYRFDRHWTASVGIDNLTDRRYYVFHPYPGRTFFGELKWSL

SEQ ID NO: 17680 - protein, 428 aa, Ralstonia eutropha
MKKSRSRISRLIPSIAAAAFLPSVHAAEPGFLEGSSATLQLRNYYFSRDFSDIVGASKKSKSKAEEWAQGFIFNYRSGYTTGPVGLGLDALAVLGVRLDSSPERSGTGLLPVHDDGKAAGEFGRIMPALKVLASNSEVRIGGLQPELPVLMYSDIRLLPPTYQGASLVSNEIPGLTLQAGRLRSFSRRDSGDSQPLYATLTESANPSRIAGITSHRFDYVGLDYSFNHDHSLARVWQGELKDIYRQRFYGFKETHPLGDWVLSATVGYYDTEESGRARAGNIDNRALYTLLSARYKADTLTLGYQSMSGADGFVEIGDTLAPLGNTLPTYDFSQPGERSWQVRDDLDFAFLGLPGLSATLRYVEGGDVRTGRGFEGEDSERDIDLSYTMHDGPLKDVSLRLRHAMARANYRSDIDENRVIVSYTMKLI

SEQ ID NO: 17681 - protein, 231 aa, Escherichia vulneris
LSRSQRAPTADEMYWNGDHHATFSFQLDNPELDVETAHSIDVTWQYLGEGFEASSAVYYYDFDGYIYNDLKGLINPIHPDDPVYRNEQRDAWFAGAEWQLDYDVTDHWQWFVKGDYVRAQLKQGANKNLPRTPPLSIASGVIWSSEQWLMRAEAKHFAEQTDIAENESKTDGYSLLNIYGAYNHAFSQSELQLYVRAHNLTDELGRNHVSYLKDYSYIVGRNITLGVNYSF

SEQ ID NO: 17682 - protein, 794 aa, Dechloromonas aromatica
MMKQSEFSNLMRVLSFIVFWSLVTLFSFQGIYPESKTDSIEDKTNIITVTGTRRKNLLKDSTITTEVITRKDIDAMGARDLSQTLGNVPGIEVKPAQSGERGQTVRLQGLSAQNVLILVDGQRTTGRFSGSIDLTRFKAEDIERIEIVKGASSAIYGSDAIAGVINIITKEAQDPLFAEFRSLGGAGSERYFGPYMEYRNYASVGAKSDNVSTLFTVGWHKGEGYDLTPDATIGPRNGRYASLAPGYNPYTFETPLANQYILATRFPMYTPPLESTSGSAFNDMNLSNKTVYRPTDNLIFTGQFYYRHLDQSAVDASPPRTIFDRRNKTHDFMGAFNVDWIASQKINLNLNANYSRFQDLYVTDQRKADDLDSQQRTDNAVTEFRTRVDYKISENHVTSVGAENLQDQISSARIAPDCRRTYPNLCYEDFNPLLTKGQSINGNAYRFRNAFYLQDEWRVSDKPRIQIVPGIRYDHDSIYGGEWLPKLAIRYDVTDQFRIRVANGLGYRAPSFQDLYFNFLNPGVGYRVVGNSDLKPELSRSYNFGWEWDITKRIWYSSNLFHNNVDNLIGYRTNPVRDASGLMVYQTSNYQKAMTQGIESSINIRLTDIVTTGVGYTYTDSKDELTNLPLEGRGRHRWNLNLRVEEKSSGISLSVFAVVFGKQPYYCIKNSFWCNPDLPSNFDSLETILNQESQSSIQNLFGTLPTVLSDYCAEKNISYCTTSPTYGYRMVNPYSNLNLRLSQRFLGHFQWFVGVDNALDAWDLQYNPQRPKFYYFGLDGKFAFSDVKLKNGDS

SEQ ID NO: 17683 - protein, 737 aa, Dechloromonas aromatica
MGYQPKSRISKAIMGCLGLSVLPALPLNAKEVLGAPKVEPIEILQVHGQQYRRATTMTKPGEAIISMEQIEEMQATTFAEVIDDMAGAHIDGGTRSGGERINLWGFGETEDFNIYVDNAPVGFEQYRYGSFFLDPDLIKRVEVIKGAHDVRSGNGGFGGSMYVVTKSADDFLNYNQNVGARIKASYASNNDAQSYTGTLYGRANKQLSGLLHVTRRDAGDVTLANGDEFEYSGYEQNNYLGKLDYEQGDHQLMLSLTHYLDEGRKPWANRRGPMPAISDYNIRKYGSYEQALYATTAYNTYEDNTWSANYRYSPSNPLIDTQIVISHSANARHWIRPPIAWEKMTVSVGNFGHESWLDYKRDYIDINNLSVIGDHEITTGLQFRSLDRDSMVFNKSYEKNPEKNYGWYTPYYQPEGRQDTYAVYLRDAISVTDELTITPSLRYDFIYSIGRPNIAPDYNDIEAGHDYSSTHHSGFSPRLGIDYQLTANTRVNFDYAYSLQAPVVDEIYAVQYAKASITGTSRDIDVERLHAFKLGLMTQQISLFAAQDTLSTQVTLFANLGRDDIAQRRGAKSDPNQVIQSGYTNLDGYEIYGADLESQYRYQDFFSDLAVSWLQGEHRGSLRDSQGEDEYLANIAPLDIRLRVGMYITDDISVAWQGTWYDAQDNVPQGDIFNAESPSENYFLQNIYLAYEPQETLKGLSVRLMAKNLTNQQVTPFLSDGIPAPGRDVRLSLAYEF

SEQ ID NO: 17684 - protein, 823 aa, Dechloromonas aromatica
MTTVLSLFALTATGAKAEIADSRIGEASYTVTANWMAQTETAPVQIVGIQVEESETGLQITLETIETALNMRVTTASGNALIAEFSNAVLVDNPLEQFEPAEGIALVQVSALPDERVRVVVTGSNAPPIADFESTASGLAISIAPGAAQADDTSDTIRLVVTGEDDEGYNPSSASTAIGTDTPIRDTPFSIQVIPEAVLEDRNVTELGDALETAGGIVENGARGTSAFGPNLLIRGFRLNDTIFRDGISAFSLAPLSTNDVERIEVLRGPASVLFGQGNPGGVVNLVTKQPLSKPFHEVSGSAGSFESYDGALDLSGPLTGAGDVRYRLNLSYENYGSFRDFVDGERLQVSPTLAWDINENTSLDVFGQYTYDRETTDEGIPFDSNGEPIDVPRSRFLNEDFGEFTQDQFSLGYRLNHDFNDNLSLRHSSQYFQYEPERYYPFVNSFDEVTGEAERVEYFAEGTYQRFFTNAELVGQFNTGSVEHELLFGLEYRHDAEDPAFQFDNEFPPINAFNPVYTNEPFEKSPTFFRDDNVDTISAYIQDQITIIPELILLAGLRFDYVDEFRTERNSGEPRQEFEDQSEAFTPRLGIVYKPIEPITLYASYTTSFLPNGAGFLNGNGSTFEPEEGRQFEVGIKTDVTDRLSLTLAAFDIRRQNIVVSDPDDPLLSIQTGEVASRGIDLNLNGEILPGWNVTAAYNYLDAFVSEDTTDIQGNQLEGVPDNQFSLWTTYEIQQGNLAGLGAGLGLLYVGDRPGDIDNSFTLPDYFRTDAALFYKRDNWRAQLNVENLFDIDYFPSTSYGSSLYVNPGAPFGISASFAVEF

SEQ ID NO: 17685 - protein, 859 aa, Dechloromonas aromatica
MKIHKRSLLDSAIKHALFVGAVSMPMLSFAAEQSETTPSLDTDEVETIQVRGIRGSVIKSLNTKRYSNSVVDAVTSEDIGKFPDQNVAESLQRVTGVSITRNFGEGERVSIRGTTESQNRTLLNGQAVGSADWWTNSPANRGFNYTMLPSEIVSGLEVYKSPEADIDEGSIGGTVIVRTRKPLELESNKFAGSALAQYSEISGETDPQLSGMYSWKNYDETFGALISVVRQERNLRRDGIESWSWTDRDITLEDGTVYKDVYSPGGGGSAMFQQERVRTGINLSLQYRPTSNLDMTFNALDSTLQADNENQNFLWLPGYGDSQYTSVDLIEHPEVGTMLTGGTIGLSPTGDNILDETKVRNSKLKTKSYDFKIDHIGDLWSSSVHLGYTEGTGGSQADRSVGWGGNYVHSFDASSARDVKTHYGANPADGSKWDLNFLRYDRNDAKDDEFYIQADFERDIDLAIFSKIKFGAKYRDHSRFNTKQTTDNRTDLGWNLADYSLPMPSDFLEHQGSSGTLKDYAITDSDKVRSEGDALGWNYRTLEASTFDIGEKIYAAYVKADIDVEYLRGNIGVRIVQTNQSSSAFVGEEGQGVWTTTDKDYLEILPSLNLAVDLDDDVILRMSASRVMSRPNYVDMTSSTSYNLETQTGTGGNPDIDPYLATQFDLGVEWYFNEAGIFSAMLFHKDIQSFIEQKGNLEIHENTEILVNRPINGNGGTIMGLELGYQQELFENFGISANYTFVDGEAKDGEGNDVTIPGNSEHTVNLSSYYENEDFSGRISYNYRTGYDTGLGWPGYIDDYGQLDANISYQVTDNITIVLEAINLTDEQTFSYQQEGVDQALTGLYADGRRFVTGVRFNF

SEQ ID NO: 17686 - protein, 447 aa, Dechloromonas aromatica
MSVRIKNVVAMSCFLPGVVCCFEALAEAKSGFFEGSSLTLDTRQWYSKEIGRRNTIYRYKTDEGPQVSHDRVAWQQGFKLGFESGYTSWPVGVGLDLAAYSVVALERDTGDAAGGSNRMLVNSDGDVQPTWSRLGVAAVKLRAAETDVKIGRHQVATPVMNFSDTRTVPASFDGLSVENSSFDGLVLKSGYFSKMAPRYAAGTEDIGLQYAMRPVTSDWTAYFGGDHTSANGLKTSVYISRIQDIWDRQYFGLGQTFQSKGLTTSVKLSMYNTKSSGKEEAGHIDQQAFGLAITPRFKNHSVEFGLQKIVGDEFFDFVKESNAIELPNTMVSYFNGPNETSFQVKYINDWAAYGVPGFKSILWHTRGWGIDGTGYDGGPKGVYTASLLQDNERHNETGLLGSYTFQAGELKGGSILAGYAWHRASSHQAEGNFDELRVILRMPFSIF

SEQ ID NO: 17687 - protein, 393 aa, Francisella tularensis
MMRLKSIVIATTVLLGSATASIAAGSDNIDTSANSNSATTQSSGFAANNFIAPFANTYSALTNKDNTWGPQDRTGQWYLGVDANGLAGTPNSPSGAGANFTIGYNINKYFAVQYNQLVGRVFAGLGEGVVNFSNNTMFTPYAAGGAGWANLAGQATGAWDVGGGLKFELSRNVQASVDYRYIQTMAPSNISGANGRAGTNMIGAGLTWFFGGKDTTNNDTGNIQDNGATTAAQTVAMPTIDESKYVLPAGIKQCEGNFNLTEDGVACYTVNGDDVTVYLDTKFAYDKATLNAKGKKAIASFVNFIKDSNISSVTVKGYASQGQTGSEFDIYNQKLSEKRAQAVADYMKQLGLDSEKIITKGFGYNDTLGGIHKSDPRNQRVEASVSAPLKEAN

SEQ ID NO: 17688 - protein, 724 aa, Dechloromonas aromatica
MTTRIDHPRARRAATGRCSGAPLAFSALCLASSWANAQGTPAPVGDMPPVLTVVGTRDADATTEGSGNYASKWATIGGKVAQSIKETPNSVSVLTRERMDDQNITTIQQALRSVTGVSSIDYGDGTAYFRARGSQLGIEFDGVPTLSGLQYQLQFDLAMYDRVEILRGPAGSIDGMGEPGGVVNLVRKRPQDQFHVATETQVDSFGSVRQMIDVTGPLNKDGTLRGRAVLVGSTGTQSIERTRSKEMMAYAALDWDLAPRTTLSLSGGYQVSPISGIDYGAGGVLNSTRTALTGRVPSDYTRNFSPSWNYAYTSLQEVNANLVHRFDSAWQASTTLFYRHELSKAYYAYSGPGATANGLARFGDQRQRTSYDWFGADTNVSGPVRLWGQTHTLTIGANYAVMTSGAQSGYRALSGPYGGAYSLYDPNAVPAVDVPYTFGTNHRTVQYGVYAQARIKLATPLTLVLGGREAFLQDRTQSTLPSVADWTTNAQINHRFLPSAGLLWDIVPSLTAYANYARFLDAQTQGTYSGPGLPPRSGEQYEVGIKSSLLDGRLNANAALFRINDDNRAVADPAHQFYYVSAGKARNQGIELELTGQPTPDWNLYAGYTYLNAHYENDSPDLTDGTDPKHLFKLWTRYTLSQGPLRGFSIGGGMLAQTRISRGVEQGGYAVFDAQAGYRFNKHVMASLQLNNVFNRRYYIRPPSTYYSVFGDARNVMLTVRSDF

SEQ ID NO: 17689 - protein, 1071 aa, Dechloromonas aromatica
MRHLLACTAIAPVLAALAGTDAAAETQITSATTAPARTSTVASGSADDITITSAGSITLTSGTAVTVDSNNDVSNGGTITINDADNVTGILVAPGTTGDITNSGTITLTEDYTAKDDDDDGDTDGPFAKGSNKKGIWVQSGAGHSGDISHSGTISIEGNNSAGIRLDGALTGDWATSGSITVVGDNSYGVVANDVTGDVTLRGAISATGENSIGAALLGDVDGAVKIQGSIVSNGYRYTTRPSDTEDLDEDDLLQGGSAVVIAGNVSGGVIFDVPPVAGDDDDEDDTDIDDDGLTDSTEGSASIVTYGSSAAVQVGAADTDTMIGAVAAGGSGYGLIVNGTIAGYGIYDGVDANGLVIGGLGGNVDIAKGVLVNGSIGAVSYDSNATAIRLGSGARSDTIQIGGVVGASGSSKEGTAARGLVIDSGATVSNLVVGGTVAAAALDDEKGTAIAILDSSGTVSSLKNTGAITASGGATNIAIDMSANSSGVTLSQSLASETAKAPQITGDIRLGSGNDNVTVSAGTITGDLALGGGNDGLSLSGASKLTGDTSFGTGSASLTLSDTAAIVGAIDFGGGSGTLTMEGTSSLSGAINNAGGIDVVLNGGTLNATNGGTIALNSLAANGTSTIGVTIDADKGTSTLYDVSGAASFASGSQVKVNLAQVGGSEGDYVIVRAGSLNGAPAFDTETLLPYIFKGSVTGDNSAGTVTLSIAAKSVSELGLSGSTARAYDAIFNALDNDSDIADAYLGISDGSTLNANLRQMLPDHAGGTFEAVTSGSRATARILSDPNGIYRTKDGRLGFWLQQVAFGSAKSVGSTASYDINGWGAGGGVEYLTGLGAFGGSFAYIHGSDSSGSSNNAVDSDQYELAAHWRGQWGPLLAFARLSAAKINFSGTRHFENGDVTRTADGEWDGDLYSATAGLSYQLQFNRFSLRPAVGIDYYRLKEDGYAETGGGDAFNLTVLDRTSDETTANGTITAGYDFGSLNPADGWVRLELEGGRRQIIGGSLGDTTAYFKDGDQFTLVAEDRTNGWTGRARLYGGTDTFRVGGEFGAEEQQNHVAISFRATVNFVL

SEQ ID NO: 17690 - protein, 531 aa, Dechloromonas aromatica
MQKIWKYWLVNPVICSTMLFSGAAAFAGETPATTEINETSETSKIANAELATQQEVMSQVTSVSQFSDVQPTDWAFQALQSLVERYGCIAGYPNGTYRGNRALTRYEFAAGLNACLDRVNELIATATAELVTKEDLATLQKLQEEFSAELATLRGRVDALEARTSELEANQFSTTTKLQGQVVSVISDVLSGDRVNNADIVDTNTTLGVRARLELVSSFTGQDTLFTRIEANNITSPDINTPEGNLFFASAAPSTNAAIGTLWYGFPLGKNTQAKLIAVGGAADDLTSTVNIFDGDGAFGALTTFGTRNPIYGQIGGTGLGVTHQFSDKLALSLGYLSGTANNPSPQNGLFDGAYGALAQLTVRPSDRTSVGLTYINSYRQPLATGSNAATTFQGLDERFSSNSYGLQASIGLSEKLVLGGWAGYTNSRILTGDRGDVDIWNYAVTLGFPDLGKKGNLAGIIAGMEPKVTSSSVAGLDRDRDTSYHVEAFYQYKVSDNITITPGIIWLTSPDHNDNNDDVVIGALRTTFSF

SEQ ID NO: 17691 - protein, 1024 aa, Dechloromonas aromatica
MKKPDKLLNTKLWIALLFITGIQWAAYSQTTLKGIVTDEITKETIIGAIVQVKGTSVGTATDVDGYYEVRVDSFPCKIVVSYIGYVTRQIDVNAAATELNITLTLKTDESEIVIVGYDTQRKEDVVGSIVKIDPEETKNIPVASFDAQLQGKAAGVQVNSQNGIPGDAVVVRIRGASTINASADPLYIIDGVFINNESMSTVDLGGKATSPLADINPADIENIEVLKDASATAIYGSRGANGVVIVTTKRGNYEQKPTLTFTTTQGAAWADKSRLWKQTTGPEHATLVNEAWINSGVDNPSLNQNYANRPFRPVSEGGRGNPEDQQTYDRISDLFRTGYLQQYDLGLQGGGKNNKYYFGASYNKQEANIRPVFYERASFKANIDSKISERISFGVSNTLSYSFRNQTRAGTGTGTGIFQSALHTPTYQPKNNPDGTPSRQSPFDNLDILLSDVFIRTASLRYIGNSYATFDLLKNKDLKFRTSFSLDYNLYDESEYNTSRTLKGAATRGFGLSNISQNTTWINEQTITYRKSIRNKHTLGVLVGNTLQSNTLKGTYTTGTGFPNNTYTQISSASVRNANQEWTKSTLASFFSRVDYNYKHKYYVEASIRADGSSKFGENNRWGYFPSVGASWRIKQENFMQNVKPVSDLKVRTSYGILGNQNGINNFAAQGLWTGGANYPNTPGTADQPGTTPLQLANKNLRWEKTQQLDFGIDIAFFNNRIALTTDFYYKRTTDLLLPTQVPATTGFTTYLTNSGEISNKGIEIAIQTQNIKSKKFSWNTSFNFTRNVNKVEKLENPYVYGSRDMVRNEEGYALYSFWMYNQLYVDKQTGQAVFEDVNGDGQITVADRKIMGNANPKFFGGLTNTFKYAGFDLNVFFVYQYGNKVVSFDRILNEGGGTKDNNRGIFEYNMNRWQKPGDDTDVPRVTSVGNNYGIEQNSRFLEDGSFIRLKTLTLGYTVPVDFTKKYSVQSVRFFVTGTNLLLFTKYKGPDPEAVHTSEQNARGIDVGTPPQPVSVQGGLTITL

SEQ ID NO: 17692 - protein, 1135 aa, Dechloromonas aromatica
MKKKRDDSVSLSLKVTRIMKITLILILVGVIQVSATTYAQEHRISVSVKNGTFYDVVSQIERQSEFMFFYKSEEIDGNQRINLNAKNKLVSEILDEITKNNNLTYKVTGKHIIITKTAITSQITKEIVGVVTDERGEPIVGANVVEKGTSNGTITDLEGKFSLTVSEKSVLIVSYIGYNTQDVTVTSKTVYNIQLEEDSQALDEVVVVGYGTQKKVNLTGSVASVSSDEIKDRVQTDVLSSIQGTVPGVTIVSRPGKDVSINFRGRGNLGTSEPLYVIDGAIADATFFSNLDPNSIESISFLKDAASSAIYGSRAAYGVVLVTTKQGKDGRMEVSYSGMVGMKAPTYTQDLVNSWEYAELYNEALYNTNPSAGKNQGYSDEEINLFRNGTKPDLYPNTNWVDLLFDDWTATTKHSLNFSGGTKKLRYFAGLGYVYDTENIRNRDTRRYNLNLNVASDVTDWLTFRGSVKYIQRNKDVDGGTPSFDNILIVPSTFVARQSTGEWGSVESGHEASGTFVGGNPLRAYSTNDWSKNTIENSMYELGFDLKPLKDLVITGQGTYKSYEYKNKAYVSLKDDVPSFLNPGTVIGGTGNTTNSMEVNWKKHSFLTYTGMANYSLTKNIHSLSVLAGVSYEHYQEETLMASRQDFPADSFSDLSAGATSGALYQNGSSMQEYKMFSYFGRINYTLMDRYLFEANFRADASSRFYADNRWGYFPSFSMGWRISEEPFMKSMRHIIDNLKFRVSYGTLGNINNVGNYDYFQNYSGTGYYSFDDTSAKVIKESKPANPSLSWEKVALTDIGLDFDLWNGKLSGTADYYIKNTSDILLAYNVPLETGISNAPSQNVAKVRNRGFEFALTHRNTIGEVSYMVSANIATNNNEITDLSSSNDIINNLENGHGVAKYILREGESIGSFYGFESDGLYTQEEIDAGHYYTYGGVTPNAGDTKFVPQRELDWGEEITDSDRTIIGCEVPDFTYGINLSVNYKNFEFSIFGQGICGADVAFEVYQVHPFFHGQDNPRRYHMGRWSEENPNPHAIYPRIYTASSPHTTYNRAFNDYHVFDADYFRFKTMTIGYNIPRNIVSRLGMSSLKVYLTGENLFTIRADHKMKDFDPEATSSTVRALGSKSLALGVNVSF

SEQ ID NO: 17693 - protein, 685 aa, Dechloromonas aromatica
MSLAAAFALASHAEETYELNPLVVNANRIESSDSKIQPPVSSLSLQEIDSDKFRDISDALSSYPGIASYRRTHPTSAHPATQGTRIRNSGANATSRALVLYNGVPQNDPFGAWVYWHQFDLSKIEAISIHPSGSGELWGNMASGGLVSVIAKDSLPGSAQAQASIGSSNRYDLRASSAHSLGEDVVFDIGIRHFSTDGFYTLREDQRGSVDEPANSEATSLNAQLSWGTSVTWKSQFVARGFEEKRSNGTAVAQNDTQAYDLSFITERQLADSDARLNINLYFQDRDFRNVFSSVADDRNSERPALDQYDVPAQSFGGAIVYRQDSDLPLSYSAGLDFRAIDGSINERYRNLGAGFTRDRYAGGKQQFIGLFGSVSSELDESNRLTATARIDQVDQTDGSRIETDTTTNTVIRNDSYADRENTILTGNLTWRHQFSDTTASHLSIFSGFRAPTLNELYRPFRVRNDITEAKPDLLNERQQGLDYTLSIQSDDHSSLRLSAFHYETDEMVANALLTTESGFDPRFGFIPSGGSGSIRANLDKTTVSGIELHAMRQLGESLKASLAAVYADTEITADELSQFVGNAFPQSPPWRVIAGLDWQASEAINFWSRYSWTDRSFENLTNTTRLGASGGLSIGGSYQIDESSSISFTLTNALDEENVTGIATNGLVTMDEPREFLVTYTWRR

SEQ ID NO: 17694 - protein, 677 aa, Dechloromonas aromatica
MTPRARTSGLATALAALLSTAAAAGEEILVIGQRIGPLDSADVVASVDVLGAEELQKQSAAEPLELLRRAPAVTIESFNQGIINADVGLRGFNTQGDVAHTKLLIDGIPSNHHVGLPDMKAVFPLEIERMEVVKGTNDPRYGLNNVAGNIHVITRKTGNERIARLLTGSFWTVEPQVLVASESDTLSQTYFAGYRGSDNRRDHARTDKVAGSAKWFYEPSRELRVGLILRGMLLDADAPGYLSAEDARSRPTASPAQSATDGGRQTTLHASVHLDHELTRGLSWQLKGYGQAFLRDRWVKFDPDLDQQLRIEDDRQYGAISVLTYRTRDPRALDLTVEWGVDYQLQDNRYQRIPTVARERRGPAFRDEDFMLHAAGSYVQASASPIKPIKLVAALRADRLAGAGSFLEQPGGEAARRVDYDLNDYGFIWQPKASVMVTPVKGQSLYANYGRTFQIGTGKGAYAVQGTPLDPSINDGWEIGYRSSVFPWITSHLAFWEQRASGEVRDKGDGSGDLENVGETVRRGFDVELTLRPYDFLSVWGAFSRTFSEQVEPGPALAANKGKELNHVPSFSAKGGIDVHPARDLLVSLFFHAQGDYHLNKENFTPEQGARKVGDYVVVNASAAYDVTEAISVGAEVSNLLDQSYDTSIWYKDFGATGAQHNPGNARSAYVTGTLSF

SEQ ID NO: 17695 - protein, 176 aa, Dechloromonas aromatica
MKRASMLALCLASLIASGSAMAVADIKGYYLGAMAGHSTLEAGEFDESAISYGLYGGYYFSKNFAVESTYVRTDNFVDVGDVKANQLSIAAKFHHYFNNTYSMFIKAGMAATKVEADLDYDGNGWLWGTGFNMAFDNGINVRIAYEMLYTDLDATGLDEQVESDWGNVYLGVHYQF

SEQ ID NO: 17696 - protein, 790 aa, Dechloromonas aromatica
MPRPCQRRSRRHRSLLIGLALLSPVHAADYLAGLPPPQPAPSGGGNVLYYLELVINGRDSGQVVPVNAADGHYLLDAAALREAGVRLPGNPAGQVAVDALPEVRADYDSASQQLHLQVPPDWLPEQRFDDPGLVARAPARSSLGALFNYDLYYSDPADGATPWLSALLEQRLFDGFGVISNTGVYTRYFGDADNLDSRYLRYDTYWLYNDERNMHSYQLGDYVNGALNWTTPVRMGGFRFARNFGVRPDLVTYPLLRFDGQAAVPSTVDLFINGYKASSADLQPGPFAISNVPYINGAGEATVVTTDAQGRQVVTSLPFYVSNTLLARGLSDFDLSVGRLRDDYGLRNFSYADNAASGIYRYGVSDRLTLSTHAEAASDLRLLGIGGDIAVATFGTLSLAASGSDGQGDSGQQYLLGYSYYSRRLGLSLQHIERSAGYGDLGTLDGEYQLSRRTDQATASLTFDEQGTIGTGYFDIRARDGSRTRLANLSYSRPIGSRSSFYLALNKDLDGDGYSALMQLVIPFDINGLLNIGVTRDSDRRYSERVIWSRSTPSQGGLGWNLGYGGGASRYQQADLTWRMQNVQLQGGLYGETGNYTRWADLSGSLVWMDNAVFASNRINDAFVLVSTKGYPQVPIRYENQLMGSTDDNGHLLVPWVAAYYPAKFQIEPLDLPANVSAPEVEQRVAVRQGSGLLLDFPIRAVVAASISLVDERGEPLPLGSQAEETGSGQRASVGWDGQVYFEGLQSDNQLRVVRPDGRACQARFRLDTRKPTVSQVGPLTCSAPIGDTP

SEQ ID NO: 17697 - protein, 639 aa, Dechloromonas aromatica
MSKTFWYCLILSPAVLGATLVASSYALATENKQTNTVIQPQAATTENISINNNIDIQEPDLLAQVTATNSTNSVGNTPATTIRQINRYGREGRNLRRPGLRNITNNRKPIKGQVTSVSQLSDVQPTDWAFQALQSLVERYGCIVGYPDGTYRGNRALTRFEFAAGVNACLDRVMELLQAAIEDTVSREDLAILQRLQEEFSAELAILRGRVDALEARAAELEANQFSTTTKLRGEVIFALVDNFEDQGKYGAFGDTIQDEDQTVFQYRVRLNFNTSFSGEDLLFTRLQAGNAQAFNQKIAESEGQQTFNILDRTDDTLQLDKLFYKFPVRDNIRVTIAANKVSWYDFVPTLNPYMEDFDGGSGSLSAFGQRNPIYRLGGGKGLGVEYDFGCKDQYACTYSPFSVSFGYLAAEGENPSQGKGLFNGDYAALAQLTFTPIRNFQVGLTYNKGYFGPGNFGFDDGAATGLGDNGSLNSGFVGTGIANSVYGLNAGLNDRRPGSVNINKSVSTNAYGVEMSWRAADWVTINGFGTYLDGKLIGKGDFEIWTYGATIAFPDLLKEGSLAGIVVGREPYLNDLELPSGLDSGLRQDMSWHLEAFYKYQLTDYISITPGVTVITNANQDDDNDELIIGTIRTTFQF

SEQ ID NO: 17698 - protein, 223 aa, Dechloromonas aromatica
MHKLSKSMLALGLLVCAGSAMAHQPGDMVLRVGAAMVDPQDDSSTLRVNGTSVDGTSVSVDNDTQLGLTFTYMLREHIGLEVLAATPFSHEVTAHGLGDDLKTAEVTHLPPTVSVQYYPMEAGAAFQPYVGVGVNYTLFFDEELTSDFKGAMGDGKIKLDNSFGAAFQLGVDYQLTDNLVVNAAVWKIGIDTTATIDLDSGAQIKTDVDIDPLVYMVGVGYKF

SEQ ID NO: 17699 - protein, 1134 aa, Dechloromonas aromatica
MKNSLYQELFIENKQLFRIMKIIVYVCFLCVGNLLAIGSYAQTAHVTIVSNHITIGQVINEIEKQTDYLFVFNVKDINIKRNVKVNAKDKAVNEVLNDIFKDTGIRHAIEGKNIMLINSTDKEKGAQQKDFLVTGIVKDENGEPIIGANIQVVGKSAGTITDMNGRFSISASANSTLQITYIGYQTQTVNIGEQRNINIILQEDNAQLDEVVVVGYGTMKKKDLTGSVTAVKGDELAARRTTQLSTALQGALSGVMVSRDNGAPGSSASIQIRGVTTIGDSSPLVIIDGIPGDINSVNPEDVESMSVLKDAASASIYGSRAAAGVIVITTKRAKSGDVALSYNFEYGWEIPTKLPTYVGAQRYMEMVNETRYNDNPDGGWYQTYTEDEITNWSINNATNPDKYPMTDWGDILLKSSAPRQTHTLSIVGGGKIIRTKASFRYDKTDGLYVNKEYDRFMVRVNNDFNINKYISANLDLNFSRSKALSPNSNPMGAGGRNIPPIYAATWTNGLWGDVKDGENMLAKITDGGTFTNWGTNIGGKLGIDITPVNGLKISAAVAPNFNNVKKKTFVKQIPYTRSEDPNTTVGYMGGYRTTNLTENRNDSHDITTQFFANYAKTLGRHDFSVMIGYEDYYAFWENLDASRDQYQLTSYPYLDLGSEDYRDNGGNAEEYAYRSLFGRMTYSYADRYLIQANLRRDGSSRFASNCRWANFPSVSLGWVISEEKFFKNINMDWFSYLKLRGSWGKLGNERIGAYDDDGNFIYNYYPYQAAIDYSTALFQNSQGIVSSVTTAAQQKYAVRDISWETTESWDIGLDANFLDNRLHFSADYYRKNTKDMLLALEIPHFIGYDNPEVNAGNMHTTGYDIEVGWRDKVGDFTYSISANLSDFTSKMGNLNGTQFLGNQVKMEGSEYNEWYGYVSDGLFLTQEDVDKSPKLNNSVKVGDIKYKDISGPDGVPDGVISPEYDRVLLGGSLPHYMFGLTFNAAYKGWDFGLTLQGVGSQKSQISAAMIEGLRDNWLNFPTILDGNYWSPKNTDEQNATAKYPRLTRTNRDANFCMSDYWLYNGRYIRLKNLSVGYTLPKAWTTKACMNTVRLYVSGSDLFTISNAPKGWDPEVSTEGYPITTSLIFGVSINF

SEQ ID NO: 17700 - protein, 799 aa, Dechloromonas aromatica
MQKYLWVCACICTLFVNAQECEYTLQGTIVDFHDNSPLIGATLIVAGLEKAVLSDFDGNYTIKGLCDGSYTLQVSHPECDTKAVQVTVSGNTTLDIKLEHHLEELGEVTIKGAVFKKNVLSAQEQVLDSEILDAKTSGSLGDALKSISGVSTLNTGNTVAKPVIQGLHSSRVLIYNNGTKMEDQEWGAEHAPNVDLNAAGKVAVIKGANALQYGGGAVGGIVIVEPEKAPLKDTIYGKTIITGSTNGRGGTLTSNLTKAFKSGWYTRVQGTYKRFGDFETPDYILSNTGQDEKDFSLGFGLNKFSWGFDAYYSYFDNEVGILRASHLGGAEDQVRAINSDRPFIIDDFTYDIIAPRQDVNHHLAKLKLFKRFENFGKISAQYDFQLNNRLEYDIRRDSEDNRPSVDLELATHHFNADLVYDAKIDYEIKTGFSFGYQDNFADPSTGVRRLIPDYERYDLGAYAALTYNLSPTLTVESGLRYDFQNIDAFKFYRLSRWEERGYDETYPEFEIDRNENQILTNPNFDYHNVSATAGFSLALNNTYKLLGNYSLASRSPNPSELFSEGLHHSASRIEIGDLSFNSERANKFSVTLEHDTKHISFSVSPFANFISDFILIEPTGIEQTIRGNFQVWEYRQTQARLLGVDVDARLQLTKSFSTNHQLSIVKGRDTSLDRALINMPPVNTTNSLTFKNEKLNNLKLGITSQYVFRQNEFPNNNFEVFIPETETTEVVDLSTPPDAYHLLGFTSSIDFSVFNKSTLNVGLDVSNIFNTEYRDYLNRLRYYADDLGRNVTLRLKLNY

SEQ ID NO: 17701 - protein, 1055 aa, Dechloromonas aromatica
MKKRILLDLFHVGQVGNLKRKLALPLMLAAMVSPGYAFDTHKPAFESGSYRFDVQITGTVSASTGETLPGVSVSVKGGGRTAITDVNGKYSISVPDNATLVFSYIGYTTKEVAAGANPVINVTLEPSSTALDDVVVIGYQTIRRKDLTGAASSVKTANTERLVSRSLPEALQGQTPGVAVRNGGAPGQEAVVNIRGLATFGNASPLYVIDGMIADPNTTVSPNDIEDIQILKDASAAAIYGSRAGNGVILITTKKGKEGPAKITVTSRYSVSQVPKTYEMMDAAGYAATNTLAYQASGMAVQPGVANYNGAVNTDWVDETLRTGAVQDYNASVSGGGNGSKYLISAGYFKDKGVLISREFERASFRINTETTRGRFKFGENIAISSSTARSPFQGGAFAGNPWYDMFTSVPLIPVQDNSLISTNNPGGWGYGSNGSINTFSRNQIAIANITSVKSNFAKLLGNAFMDFKIIEGLNYKFNVGLETSFDKSKSVRKDGSWYQNQSPDFSQLSDNRSQFLSYLFEHTLNYNYVLGKHSINGVVGYTQQTTQTDNTFGSGIRLAQFGGDYFTTLQSTSGEGRNSSGSLYKSLLDSYLGRLNYTYNDKYLVTFTFRADKDSRFSPQYRTGYFPSGALGWRISKEDFFKVDWVSDLKLRASYGVLGVNTLSPYQYIGFLNQAPDVVLGTGQNTNAGAIQAKLASGDLKWEKKKTTNLGFDASLLNDRFTINFDAFRSISEDVLLSQPLPGYLGNLQGDPIVNIGSIQNQGLELNLGYRPQSDGAVKWDIAANVSVIRNKVLELGSLGIDLDTGLPKNYIQSGNTRTQVGRSIGEYYVLKTDGIFQNQAEIDAHRAQSAYAKPGDIRYVNVLDGGTNDDINDKDRVYAGSPFPKFTTGLQFNSRYKDFSLSVQLYGAFGQKLYNDVLRELDSYGNSNYRTAINPWTPTNTDTSFPRLGYQFAANDRGINENARGNTDRWIEDGSFLRLRNVELGYNLPSKLISKANISNARLYVSGQNLFTITNYSGLDPDVVGANPNLEPGVDNGNYPSSRIISFGLSVGF

SEQ ID NO: 17702 - protein, 358 aa, Dechloromonas aromatica
MTKHLFSLGLTTTFVSGVLLATSSFAAHSEEAQADNFNFNNWYVGGEFGRKRQDDLCKKSLSSCDSSDNAWSVFFGYEFSKHWALEGGYTDLGEYSTTGLVNGLTNHAVTSMTGLEFAGVFRMPLTEQAGLFTKLGAMYYDGEEKNSIAKFDDKGWSALFGLGLSYDFTQNLQGRVEYNFLHDLGDSEFAGDHGHLTTLGLAYRFGSNAKKAPRAPAPVTPVAKVVEPVVVAPVEVAPVEVAPVVVPAVNAFALFDFDKSAVKETQALKDLAAHLAANPQAQAAVTGYTDSQGSKEYNEKLALRRANAIAKYLTANGVNASQLTVKSVGETDLFASNATIAERLNNRRVTIDVAEFTK

SEQ ID NO: 17703 - protein, 855 aa, Dechloromonas aromatica
MKRPSLWAAASALAIVATGQAIAQEDTESTEVKRLEQVTVTAVKREQSLNDVPVSVTAFTEDMRQDLALDSLSDFARFTPSLAFSAGDDRVFIRGIGRQTNTNGSDPGVATYADGIYDSSTSAVSKSDFFVERVEVLRGPQGTLYGRNSIGGAINVISKRPTDTFTGEARVGIANYQTSEVEAAISGPIAKNIRAKLGGSFRNQEDGYYKNVAGGPSEGGANETTYAEFQLDMDPAENFNLWLKADYLDADLRNRSTNLASPYDPFPFPPGYLTPGNAFGYLMPGFTQTGSTTTNPGATDIRKFNANTPTESTVDGNYGFAAIATWSLPTVDIKYSGGYRIFDYVSNRDDDNTDMLSYSYPLDSANIAAGEVFTGGPNCAWLLENLGPVCAAATVNPARTFGYIEDRSYSSHELTVQSTTDSDLWWIAGAYAYYEDAHQESHFGNAAQPEMLAPVGGPANPSGDYVTAISDLNTKSYAVFGQADYAVTDTVTLTGGLRYSKDEKYGSEQLRVLGYGIVPGFTLGGSGNLAPVLDLTAATASYTDAEGVDSPVVIDPVTGLASRRLAHDWSALSGVAGIQWQPDAATNYFARYSRGYKSGGFNAGGISQFPLTDKELLDAFEVGAKKSIGDQLQLNATYFYYAYDGLQAPLDVVENGVRLTRFFNIEDSRAQGIELEALWTPTDQLRIMASYAYNDSEIRNACCFIDVVDPLGLQPGAQPVGPIDANGNQPQNLKGQTLPRTVPHKLGLNASYDIPLGSIGDLTVSGNYSWQDATYHGVFNRSYTETPAFDQVDLIGVWKSPQDRYRVVGYVKNVFDEQGYDGATGTQTAIPAGGFANTLYLTPPRTYGVQLQMSF

SEQ ID NO: 17704 - protein, 178 aa, Dechloromonas aromatica
MNKMLLAGSTGIVLLSAAASPVWADDNASTFSLGYAQSHTNHAGTLRGVRLANSYEMSPDWGLTTSFAWLNGSQCYSDESSNGRVTTRYYSLLAGPSWKINNQLSLYSQVGPVLLHQRDHGINESDSKVGYGYSAGVAYTPVSNVAITLGYEGADFDATHNSGSLNSNGFNLGVGYRF

SEQ ID NO: 17705 - protein, 741 aa, Dechloromonas aromatica
MSAHATSRVRLVAYACALCCSGFAASQSASAQSTDNPPSAKPTEATLPTAVVTADSPMQTKELPSYKFVAPLLDTPRSVTVIPEEVIKQTNATTFAEALKTVPGVTFLGGDAAANPSADRPVIRGFESRNSIFVDGMRDSGVQNRETFAVEQISVVKGPDSVYAGRGAVGGSIDIVTKMPRLDDFTNASLGLGTEAYKRATVDMNRKINDETAVRLNVMGYDANQPGRNNVYSKRWGVSPSVAFGLNSPTTVYVSYYHLNSYDMPDFSVPFRSTGGTPGANSGIERSQFYGLSNRDYRRGQTDTGEIRVEHRLDENWKLRNTTMFGRSTLDYVATNPQFLSTNPNILQLQAKSGKYATNSVANQTEVSGKATLFGMEHSLSAGMEFSWERSTYEGYLVSDNAGNNIRSGGPCTVAYNCTPIGGWNSNAPWTGSIVLNGDKGFPGAPTYTHTNVASAYLFDSIKLSERWLFNAGTRFDRFDVSSTQAGAPDLNNISNLFSYQLGLVFKPVQTVSLYASYGTSANPPGANSGLGGGTDQITATNQNLSPERSRNIEVGAKWDVLDRRLSLTSALFQTDKTNARVSDGLGGTVNAGSQRVRGAELGFAGNLTNQWRVFGGYSYLDAITTDAGPANPTASGLPMVMVPKHNFVLWTYYDVLPKLSIGGGATFSSLTYASVTATTRKWTPGYARFDAVATYRLDKTMDLQLNLQNIFDKKYYSSAYPIYATWAPGRSAVLTLNVHM

SEQ ID NO: 17706 - protein, 735 aa, Dechloromonas aromatica
MARPKTAQPNHSLRKVAAVVATAVSGMSVYAQAAEQPKQEETITVVAAPAAQESAWGPAPTIAAKRSATATKTDTPIEKTPQSVSVVTRQEMEMRQPTTVKEALSYTPSVFSTRGSSTTYDVVTIRGFTTSTTVNTNQYLDGMKLQGNNYSEVSMDPYFLERVEVMRGPTSVLYGNSNPGGIVSMVSKRPTTEPLKEVQFKMGTDNLWQTGFDFSDAIDDAGVWSYRLTGLGRSQDAQQQMAKSTRYAVAPSFSWRPDDKTDFTFLSNFQNDPDAGYYGWLPREGTVVPYYDANGKAHKLPTDFNEGESDNKISRRQKMVGYSFSHQFDDTFTVRQNLRYADVHTLYRSVYGNGYVAPGYMNRAYVRSDEHLNTFTVDTQLQSDFATGAVSHTLLTGVDYSRMRNDVDADYGTADPISMSNPQYGNPNIQVTFPYAVLNRMEQTGLYAQDQMEWDKWVMTLGGRYDYATTSTLTRATNSLAENHDQQFSWRGGINYLFDNGISPYFSYSESFEPVSGSNSRGQPFDPSRGKQYEAGVKYVPKDMPVVVTAAVYQLTKDKNLTADPANQAFSIQTGEIRSRGLELEAKAAVNANINVTAAYSYTDAEYTHDTVFNGKRPAEVPRNMASLWADYTFHETALSGLTIGAGARYIGSTVSYYKNDTSTGKKNDAFSVAGYALMDATVKYDLARFGLPGSSVGVNVNNLFDREYVSSCYSEYACYWGAGRQVVATATFRF

SEQ ID NO: 17707 - protein, 637 aa, Colwellia psychrerythraea
MKFSPKKLAVAVALTAAGGAHAQTTVLEPLVVTAKPVIEEVEVDMFSSTSAVVTEEQIRDQNAVDLTAALRRTPGVQISRYNPVGAFGGDQGGAVFIRGMGVTRPGSEIKTYIDGLPLYMGLWGHPLLDLLPVNAMQSMTVYKSPQPQINGNNFASIDLHTKRATEDGTHGAARISAGTYHTLVQQAELTSRNGDLDFTLAQGYATSDGHRKNADGELKNLFGRVGAQLNEHWAASFNGLYVDNESTDPGKEGDPEPDVAPEYNTQAFMLATTLSHEHGDWSGEFSLHHSSGEGNWYHQSGDDGDTLSDFTMSGLRWREQFSPWMDGTLVAGLDYDRVSGEAHFNRDDPARRAHLDAPTFKLWSPYVGLSHLFMLNDEWMLSPSIGVRYYDHSEFDAQTAPYAGLSLMSDSLTLFVNASQGVNYPGLEAPTLAAAMPFLSDSWKQLEAEELDHLEAGAKFSLTATTQVDFSVFKDKVKNRYVFAFPPQVSSPQFINFGDYSMRGVELSVSQTLPAGWSLFGGLTLLDPDIDNLPYTPERAVTAGLNGQIGPFRLALDAQHQSEVWALTRGRNSSDVNAEKVSGFTVANMRVSYPLSPLGQDGEVFVAVENLFDREYAYRPGYPMPGRWAQIGLSASF

SEQ ID NO: 17708 - protein, 644 aa, Colwellia psychrerythraea
MKISVFPVRLSVLVLSLPAVSAVLAQTGPAPALNEVVVTGSRVAGPRESQPFGTSVITDVDIQRIGAATVNDAIMRLLGVVGRQDFYGGGDYALDLRGFGSTASSNQVVIVDGVRINEADLSGTRLAGIPIESVLQIEVIRGSGAVLYGEGATGGVIIVTTKAGAGAARKNAASLYAGAGSYGLREGRANATLASGGFSLDVNAMNRKADNHRDNFRSETDAVSAVAQWSNEWLRLGASRAQDSLDTGLPGGLTAAQYQNNPRQTTTPQSKASIDNVRNGLFAEAALGDWQLLADAGWRDKKLRSVSAFGAFDYDVKATNYGLRAVHSAKQSVFSNRLVLGTDYASWQREVLGGSTATQASRAFYFRDELTVASIGTVLSVGARTERIKKDIAGTSSGLADRQNAWELGLNQPLNKEVSVYGRVGRSFRLANADEFNFTSPGVTLLPQRSTDVEIGSRYASGRVKMEARLYRSSLTNEIGFDPNAAGPFGRGANVNFDPTRRSGLELDGSYAYAENLKLRVNAALRKSTFSSGPYAGKDVPLAPNRTFAAHADWTPVAGHLVSGGLNWVSSQHPDFANQCSIPAYTTADARYAYQWQKAEVSLGITNLFDRKFYTQAFRCAAGVTNSIYPEAGRAIVAAVRIKF

SEQ ID NO: 17709 - protein, 700 aa, Colwellia psychrerythraea
MITSPKLLWRMSMEKGKWFSKLSPSLCALLLAGGVSALAQEEADKLNNVLISEEIPTNYASKEKSAIMRSNIKPDESAKSVQIFNETYMQDTQAQTINDVIKMSSNTTYLGDNNGRESLFAIRGFSGVPILRDGLSLTNAAPFPEVFNLESIEVLKGPDSLQYGQSSPGGIVNLVVKKPLYETYAQIELETTSNTSYSPKVDLGGALNDSKTLRYRLVALARHDEGFRDSHVNSDRVFIAPTLAYDISDDHTFTLVSEYLDERTPSSFESYVNSKGELVADIKTIMSHPDEKFDKTQKIIGFDLDSRFGTWKSNLKYRYVDYLRDNYNVHIPYAYVEATNQVRRFFATQKYDFTEHALQYTLNKELEIFNLKNKITMGADFGRASTTFTGWMDMGTIYALNLSNLKYEALTDLSDHPSAVTYGNTGEKITTTKKGIFAQDNLYLSENLILSTGVRYSTVKSDTSDKSSAWTPQIGLVYKLTPETSLYANYSESFTPQSATDINGKILDPEEGEGVELGIKQKLFGDRLALTAAVFKIEKVNVAMPDPINPLKSVASGKQESKGFEFDVSGDITSDWSMAASYGYTSTEDKATNQGKELSGIPKHTANLFTTHYLTAFGLPHFYVGGGVRYLGERYANSTNTIKLDSSLIYSAMVGYRKGNWRGALSVQNITDEVYVESASNSRVSVGTPRTVVATLGYLF

SEQ ID NO: 17710 - protein, 957 aa, Colwellia psychrerythraea
MKSLHKRQLSLAVTAALATTLTSGLAFGQDEDIDGAVDDTVEEVIVTGTRIKTEDGFGATSPVTVVNAENIKNLGFVNIEQVLNSLPSIETSQNANISNGATGTATVDLRGLGTNRTLVLINGRRMQAGGIYSQAPDVGQVPTIALERVDVLTGGASATYGADAVAGVVNFVTRKMDGIEIRGGWSGYRHDNDNSYIQPLLDARNFDYPSGTEGPDGENYQIDFIMGSDFADGKGNATVYGTWREQKELRQESRDYSSGALTGAATGVGGSANAIIPNYFLAPTVVGGQGPAGTNGRNYDYDQEFFGNINSSGGLTPWDGTNRYNYAPINHFLRPIEQWSIGAFAEYKLNDHFTPYFETMYASNESRAQIAESGSFFVEAYILDLDDFPAPFQDALVDLYGPGYDEFGVYVGKRNVEGGPRSSNTTHDSFRMVTGMKGDINDTWSYDISYLYGQTRSTATYINDFFAPKITKNIDPDTADILWDVFTYQGVTPEQAAGLTGVGVLNGTTSTEVINGYVTGDLFALPTTSNPIKVVVGYEWRGEKFERIADTVFEEGQLLGQGGPTPSLGGSYNVSEFFGEASVPVLDSLVLDLAYRYSDYSTVGGQDTYRIGADFQPIDLLRIRMGYNRAVRAPNVSELYSQQNLGLWAGVDPCGGIVANGEAPEYSQAQCANTGVTAGQYGNIALSPADQYNQITGGNPGLDAEEADTITFGVVLTPTDNLTISADYWSIEIEETVTSIGAENIVRQCAENGLFCDAITRSGNGSLWQGETGSVLNASLNGGKNTWEGVDVAGAWGIDALGGSFNLSLIGTYMLTKEVEIPGADTYDCVGLISSRCYPSPEWRHTATASYDSNGFWAASIRWRHFGGVDYDGGLTNGRSEGIDTIAQDESDGGENYLDLNATIRFLGDSEILVGINNVLDEEPPLVGGSLSSNANATAGFYDTLGQYLFAQVTFRL

SEQ ID NO: 17711 - protein, 330 aa, Colwellia psychrerythraea
MNKTLIALAVSAAAVVTGVNAGELYNQDGTSPEMGGRAEARLSLKDGKADDASRVRLNFLGKVAINDSLYGVGFYEGEFTTADEGTADNKGDLDNRYTYAGIGGNFGEVTYGKNDGALGVITDFTDIMSYHGNKAAYKIVVADRVDNMVAYKGQFADLGVKASYRFADRQESTSAITDNNADGYSLSAIYAIGDTGVKLGAGYADQDTAANASSDQYMLAASYAISDFYFAGTFVDGQDKAASKTDKTGYELAAKYTMGQAVFTSTYNYLESKNSGAKKDKADSFAVDATYFFKPNFRSYISYNFNLLDSDKVGKAKSEDELALGLRYDF

SEQ ID NO: 17712 - protein, 814 aa, Colwellia psychrerythraea
MSFRTPSRLQAAAIRTGLLRTSLAAFCSALALSTAHADPAAQPANGTPATTGTPARKAPAAAPRLTAAPAVEQIISTARRTRSEQSVGQVQMQRILPGINPVKALEILPGVVFEDADPWGNNEQNSSLFIHGFNQNQLGFTMDGVPLGDQSYGNFNGLSPQRAAISETIGMASVATGAGALGTASTSNLGGTLEFQTQDPLHRAGGQLDQTFGSWSTFRTFARIDTGDFGNGNSAYVAWARQDARAWDFDGHQGGNQVNAKFVHQGDNDRITGFFDWSDKVEPNEDGIVEPQGGDLYKRPFLYPNLQQAINYYNNSAAYKAAGLNYRNYYSDAQREDFLSYIKWSHDFSSHLHWDNQIYYHHDLGEGVVAGPITAAGLPALFGAYFPDNSAPQLSQVFGGSGMATRTTEYWDNRGGLMSTLRYQLGHHHIELGGWYERNNNTQARRWYAFDAADPTSPYDRQQNPLIHQYTNYFYTNTWVTHLQDTWQVSRNFSLNAGFKSELVYTNGTLPVAGLPGSLSPKTAITVPGGTIAAVKPFLPSFGALWNLTGHEQWFANIQENMRSFQDTGYGNASPWGVTSQQAFQDFKDHGHPETDWTYETGLRTNRPLSFGPLTNISGQLEYYHVHFSNRLLAVSSSPNLASIVGSATILTNVGSVTTDGMDFSFTTQFGPHFSFYNALSYNKSVYNDNYANGTTIVPTAGKNVAGVPNWTEKLVASTNWGDFNAQFIGDVIGKRYTTYTNDLSASSYALFSVNAGYTIHGIPHVRGLKVQGNITNLTDTRGWSTLNISNASGQYTAFPIAPRMFFLTLSATF

SEQ ID NO: 17713 - protein, 709 aa, Colwellia psychrerythraea
MTIPSLRAPRASRHCRARCVPRMLKLTIPALAVGAMSAAAAAEAARAAGAPTDDAAVLLPPVEVVASPLTTPLVIVTDPKTPRQPLPASDGADYLKTIPGFTSIRSGGTNGDPVLRGMFGSRLNILANGMPTLGACPNRMDAPTSYIAPESYDKVTVVKGPQTVLYGPGASAGTVLFERVTPRFERPGMRFDGSVVGGSFGRNDQNVDVTAGTPDVYGRVSANHAHAQDYQDGNGNTVPSQWDKWNADAALGWTPDDHTRVELTAGTGDGYARYAGRGMDGAHFRRETFGLSFDKRHLGDVLERIEARVYYNEADHVMDNTTLRQPDPTSSMPMRMASEVRRRTLGARAAATFRFGDDFKLVTGVDAQSNRLDARSAMGRQNYGDQPWDAQATMWNAGAFGELTWYASDAARVIGGARVDYASARDKRATTSGMMASKPNPTFDDDRARVLPSGFVRYERDLASLPVTWYAGVGHAERYPDYWELFSAKRGPAGSVNAFSAVQPEKTTQLDIGAQYKSERVDAWVSAYAGYVQDYILFNYAAGMMGPTTQATNVNAQIFGGEAGVSWRPVAPLRVETSLAYAWGRNATSGDPLPQMPPLEARVGLEYTRGAWSAGGLWRIVAPQHRYALNEGNVVGKDFGPSAGFGVLSLHAQYNVSKKVQISVGVDNVLDKAYAEHLNLAGNAGFGYPANAPVMEPGRTAWVRVSAKL

SEQ ID NO: 17714 - protein, 449 aa, Colwellia psychrerythraea
MKVKKIALILFPSCFVAFGANAGDWENAIKENSFVADSELELSTRNMWKYLKSENRYDANEKRYRKQVAQAWGQNIQLDYQSGYFADFIGFDASYYGAIKLAASKDFASRAILYNDDGEAKGYNKIGQRYAKFKLDLEPVNFNGKAGWFTLKNKGIFTNSQRLSLNTYNGYYTNTAISDWNLDLLYLDGKVMRRDSPNIDRMYFRDGNGVSHDINHVVTGGINYNTKPLKVSYFIGQADDVFRQQGLEIKYKLNSDITLSSQIYGHEYGSDGKRTSTDTKRGKQNFDKRAWHYAGEIEWRVPETPWTLMTGITHTTAHKTNGVGQFARNPIGNTRGRFNSPAYADIDYVRDGETMLALKAEYQVNPTWSVGANSNYSEFSYSGERLKQGQVGVFTYWKPTENLSVSLSGGMGWHHQQESDNSTPKLYDGDSRRAHSLSGSMTTTYRFKM

SEQ ID NO: 17715 - protein, 216 aa, Colwellia psychrerythraea
MVLKKEKQKFHQWVCYAKFLIFCVGFLSLANHLGAKNLGYMSSSYQVGMVFMRPLSANKLLQGASIVQGYEVNPKNDWAYSRYYIFVDYGNVLFNENSTLQANMFTYGVGGDFMVAYAKNPINRWAFFFGLQLAANTWLLNNKVKDLVVNTWNSLKDFNFRNTYFRAIGVFGVQFRTIVLYHNVDVEIGMKIFLTPERHSLFERSFLFFVSHSWHF

SEQ ID NO: 17716 - protein, 902 aa, Colwellia psychrerythraea
MKNQLKHFLLFAVLVIFGTATAVAQATLKGKIVDAESNEPLIGATVSVKGSTEGSVTDIDGVFSLKITTSGTTVEFKYLGYKTKTMKITQKGTVDLGTVSMEADSHVLNDVVVTSSIAVARKTPVAVSSVAMDFIEEKLGTQEFPEILKSTPGVHANKDGGGYGDSEIYMRGFGNENIAVMVNGVPMNDMEWGGVYWSNWSGLTDVTRTMQTQRGLGASKVSAPSVGGTINIITQSLESKKGGTVSYSLGNDGMNKILFSVSTGLTKSGWAMTLLGSKNWGNGYAQGLDFEGYNYFLNVSKRLNDAHQLSFTVFGAPQTHYQRNGALTIADWKMTEEVYGIKNYKYNSTYGFDNEGRRRTSEYNSYHKPQISLNHQWQIDDKSSLSTVAYVSIGRGYGYSGQGNEYYGYSYQDWKGANYGVLQTKFRNPDGTFDYGAIQDINAESEYGSMLAMSLSKNYHNWYGLLSTYTTKFGKYIDFYGGVDFRYYKGTHTNEISDLYGGQYFMDSTRGDVLAENNIAAADPMWKYEKLGVGDVVYRDYDGHVMQEGAFFQSEFNKDKLSAFVAGSLSNTTYWRYDRLFYDKAHAKSDKVSFLGFTAKGGANYNITENHNVFFNLGYISRAPKFSYGAFMQANASHAINKDAKNEKVLSFELGYGFRNSWLTANVNAYWTKWLDKAMTKSGQLDNQERTEYYMNMTGVNALHKGVELDVKVTPVKWLDITGMFSLGDWKWDSNATGYAYDDKGMPLKEDGTQASGIGAPDHVSASINLKGVRVGGSAQTTAALGATFKIGKSIRVGADWTYYGRNYAYYSFSGSDLKLGKEISIAEPWKVPAASQIDMNASYRFKLGKLDATLSGNVNNLLDYQYISKAYNPKSGVVSEETIYCYYAFGRTYSLRLRVNF

SEQ ID NO: 17717 - protein, 1187 aa, Colwellia psychrerythraea
MSNFKHSFFRTLLYAQLLSGFSGVAIAAQISLSVKDRPMREVIKELEETTEYRFFYNDGIKGLNSPISVDVEDADINAVMDAIAKQANVAYVLKSGHQIVLSSVKTVQQQGNKKVTGTITDPKGEPIIGANVVVKGSTNGTITDIDGHFSIEVTPNAILQVSYIGYVAQDVPVGNKDNLVISIHEDTQKLDEVVVVGYGSQKKVNLTGAVEQVTSDVFEGRPTANATQMLEGVVPNLNISLSDGKPGRTADFNVRGAGSINGGSALVLIDGVEGDPSMLNPNDIESISVLKDAAASAIYGARAPFGVVLITTKNATEGKPKVTWSSSYSLQSPQNVPDVVSDGYIWAKHFYDAYFNYNQANPSGINKTQQFSVAWLDEYKRRHETGDFGTVISDGSIGTKGRYVYYPEGTDYYDLMYKKSVFAQNQNLSISGSDGKFDYYLSGRFYSYDGLFDSDEQTDKFKTYNMRFKGGYQLTPWLKINNNFEFSHNKYYNPITYSEGSGVVWRNIADEGHPSSPLFNPDGTMTYSAVYTVGDLLYGRSGITTKNSNLKNTTTFNAKFLGDRLRVNGDFTYQQKTQEKTKKQVRSPYARSVDADGESQIEHITGTYSNLAETTDHTNYLATNLFAEFEETFAEKHYFKAMAGWNYEKSTFKRIYAYNDDLLTDDVDNMNLVMGTDNRSITSQWKAYQFGGAFFRLNYAFDDRYLLEVNGRYDGSSRFPSDERWAFFPSASVGWRISQEPWWNVKSEHISNAKVRFSWGSLGNAAGLSNYQYIQTLGISKSDYILDGLRQNYMSSPAALPGNLTWETATTYDIGADLGFFDNRLTVSGDYYIRKTTDMIVNGPTVPDVFGASSPKGNYADMSTYGYELSLEWRDGFDLAGKRFNYSIKGTLADYYSVIDRFNNANKSLSEYANQSLDKNYYEGMRIGEIWGFVSNGLWQDQASIDAAEAAAKAAGQSYYNPLMQTSKTYKLYPGDIKFEDLNGNGYIDRGQNTVDDPGDRKIIGNEEPRYIYSFTLSADWNNIWVSAFFQGVGKQDWYPSNEASTFWGQYNRPYNQMPSWHVGNYWTPENPDAFLPRYAGYYAPFYGGHKNANTRYLMNAAYLRLKNIQVGYNLPSEWIKKLHLTNVGIYLSGENLFTWSPLYKYSKDVNVSNIGESDKDLTSSNSGDGYNYPMMKSFSIGLNVTF

SEQ ID NO: 17718 - protein, 296 aa, Colwellia psychrerythraea
MKTKCLFVLSLFTFMTTSTAQAADTVISQQSQPSVSAPSSLSSRLSPVTVSAPFSWSGFYFGGQLGHLSSKSTLNYAPESQGGKWALVDRGLSPKPTGFVAGFYAGSNIDLGNSLVVSFDTDMIWSGKKNTQTDNGKKILDKLDSVHAAFHDAGIPIITSEVQDETIPNYSDIIVSSVTLKEKWAGAARARIGFASHRLMPYIAGGVAYTQMQYILSLLTKSQEDSTVFASGDVFDKTKTMIGYTVGGGFDLAMTDDIIMRTEYRYTDFFKQKFANDELKMSVQTHNFRLGIAYKF

SEQ ID NO: 17719 - protein, 249 aa, Colwellia psychrerythraea
MKLSLTFRVLPQLAAVTAVSALAAFSLPAAAQSAGDNIVNVGWFHLKTYDSSETLIRRSPAPGPIAGSSATVGDADTLGLAFTHFVTDNFALTADLGIPPKFKLDGAGSLASLGQIGTARQWSPAVIAKWYFGDRNSQIRPFVGLGVTRVWYSDVKLSSSLQAAVTPPAFGGPGTATANLSSSWSPVANLGLTYNIDKKWSIGFSISYIPLDTDAEIIGRNAAGNVISRHTTNLTLDPLVTFLSVGYKF

SEQ ID NO: 17720 - protein, 1001 aa, Colwellia psychrerythraea
MTISNTDFLLCSSPVSVSRDDMPSWCAAYHRNHQTRHGSAPFPYRRTLILSTALAALVYASAAMQQAHAQSIIGNGDLNYTPPGGAQTWSVGDDLIVGDTLPGPSSLLIDAGAKVDNNAGYVGNQAGAVGTVIVQGSDGSGSASTWTNNGQVLIGVETGGNGTLNILNGGVVTSIGASIGRDSGSTGSVTVSGTGSTLDSASTATTYIGEGGSGTMQVLSGAVVNSGWVSIGDQSTGDGHLTVSGTGSTWNSATNTTFSIGVSGNGTLDINQGGAVHSGQGMLGFGSGHGHVTVSDAGSTWDPLGNIYVGYIGTGELEVLEGASVSTVGFSGPASAATIYLGYFAGAQGTVTVSSSTGNASTLSVSDDLIVGVDGSGTVTVEKGGLVKVGDNVHIANTATSSGTLHINGDATGRGIVETGSVVSGVGTVNLDLNGGILRANRDEANFLNGFTGLTVGSEGAWFDSNTYTIAISTAFTGTSTFNKLGAGTLILTGDSSTFIGNAAVSAGTLQMDGILGGTIDVQSGGRLTGIGQVGVTTNSGVIAPGHSGSLGTLTIAGNYTPAGGSIEIRTQLGDDSSATDRLVITGSTSGATPVTVTNFGGAGAQTTEGIRIIEVQGASNGTFSLVGTTTFEGQQAVVAGAYAYRLYAGGASTPADGNWYLRSALLNAPGTPLYQPGVPSYEAYPQILLGLNGLPTLQQRVGNRFWNDGSSSSAKDNGRGVTGTFTETNGMWVRVEGGHNRMTPKDSTSGSDYQYDTYKMQGGIDALLTENNKGKLVGSALLHYVHGSAKTSWRYGVGNYGSGNISTDGYGIGGTLTWYGENGFYVDGAAQLTWYSSNLSANSVHSLKSDNNAFGQAWSVESGKRVKMNSNWSVTPQVQLSYSKASFKDFNDVFGASVRHGRDDSLQGRLGMSLEYQENRTRLYGIASLYNEFFDGTSVTVGGQTFANSNDRLWAGIGFGGSYNWNNDKYSIYGEASYNASLASADSHGYGGTIGMRIKW

SEQ ID NO: 17721 - protein, 712 aa, Colwellia psychrerythraea
MLLSGTALAASDPARVDETGILPHLKARETIVVKGQRVEQKLSDISGAITVITEEDLDRQVATELTDVFKNEPGVSVTGSAGRPQNISIRGIGGNRVLIIKDGVRVSDGFGADDLNDKVGRFSFDLDDVKQIEVAKGAGSALHGSDAIGGTIVISTKQPEDYLQGQDAYLSSKVLHDGSSNKQKLSATGAARWAETEHLLRVSGWQGHETANYDESRIPADLDGLSASTSSRFTLNEHHLLRLELDYFEDNAKRDQGPREMPQPDGKWQVRQYREDSTQRSQGAKLSWEARSLDHLLADQFTLSLHGNHAKNSANKRSLLQNDLLSGYPRYRSERELATFTEDLLGGELDIRRDLTTGAIEHKLSYGIELERASHERPVDKLTLEAGIPQPGQSAPFSNARTDRAGIWLGDVASLGQWQFTPTLRMDHQWLSPQDGKGASNHSWHLSPSLATSYRFNDQWRSWLSYANGFSAPSYDKVYGNIPHYFALPPFEIIANPDLKEETSHSFEWGVSGEGDEWSIKPALFYNRYYNFVDWRQVGFRMSDGVMLRQYRNVAKSETWGAEIAASYWLTQQWELATKFGWVDGKDSQGESPRNLTPLEGNTRLSYQANDWSLGLQADYAAAMSRVPTCGNSLTQQQSECMKSAGWLSFALTADWQITDALKANLKLDNLLDTRYTRYQDVAGQEAGSDAGLYTQTGRYLSASLRYTFVGI

SEQ ID NO: 17722 - protein, 1061 aa, Colwellia psychrerythraea
MNNEYNIMKQKIRFKLTDRYLVLLICFLGYISTVSAQSHKISGVVVDEGKSPIIGATIQVKGANNGTITDIDGNFSLEVKNPKAQLQISYIGFTTITVPVQLKGKMTITMQEASRNLDEVVVIGYGTVRKSDLSGSVSAVSMKNEAEIMPITSADQFLQGRIAGVSIAANSGAPGAGMNIQIRGVSTLSGNTDPLYVVDGFPIEAATASVNGGTSELSQQPAMNPLASINPNDIESIQVLKDASATAIYGSRATNGVILITTKQGKEGKVNVNYNARVDISNISKRYNLLNAHDYALFENELDRTSNGYDMQGNVIPSTKVPRHTDDALERYKIYSTDWQDLMYQTAVSQDHQLAVNGGNKMTQYNITAGYTDQEGIIMNTGLERYSFRLNLKSELAKRLVLQLNTSYSQTEQKQTSHSQSSSMNQMVRRILTTKPTLMPGDQIYEDENVEYVPADNPYIMATELKDILQQRFFILNASLTYNFGKGLSWKGAGSFNRTDGSRSTYYPIGTNAGNSAHGMAFRGEDNRQNIVLETTVNYDRKFKKHHHINAVLGYTHEDRQRKTLAIQVGDFAGNDLLYYAIGEGTNTMDKSSSVIQTKLSSFLGRMNYTLYDRYIFTATGRYDGSSLLASGNRWSFFPSFAVAWRINQEKFMKDIPAISNIKLRLSYGVTGNQSIAYAAPLAIMNHVRSYSGGAVTHGMVNGKLANPNLGWESTATYNAGLDLGFIDNRFRVTMNVYQRTTKDMLMNFGLPLSSGYGSIPYNMGKMTNKGFELEASADILTGRVKWTLGGNIYLNRNKVDDISGNELLGTSYLAGGGVFSQSIHITKAGYPVGSFYGYVVDGVYQNEAEAKLAPFDTPQATPGSLRFKDISGPDGLPDGKITSDDMTIIGTAEPKFNYGINSELSWKGLTLSMIFTGRVGGDIANLNRYFLDSFTDTNDNIRAEAWEGRWQGEGTSNFYPAVNGSQGSSYFNKRFSTFLLEDGSFFRLKNLTLAYQFSLKKLRWLRSVRVFGTVTNVFTITNYSGYDPEVSITSGAMSPNVDYAAYPSSRTYSMGINLAF

SEQ ID NO: 17723 - protein, 67 aa, Colwellia psychrerythraea
MYNNGNYHYTNKDLVKYVEVGATYYFNKNMSTYVDYKINLLDNDDDFYANNGIATDDIVAVGLVYQF

SEQ ID NO: 17724 - protein, 967 aa, Colwellia psychrerythraea
MYNNSKVAKAIRLAMIVSASAAATISAPVFAAEADELESVERISVTGSRIKRAELSTPSPTLTINAQELVRFGNPDLGSMLAELPALGATSTIIGNNNDGAEAGVSSVDLRRLGTKRTLVLINGKRHVAGSPGSSQVDLSTIPAALIERVEVITGGASAIYGSDAVSGVVNVILKKDFDGLEFNLTGGNSTESVGNENYTFSVLGGTDIADGRGNITFFAGIEDTTEVMSSAVRQWDSWGSVINPDNEGEEDGVFDKFRRPNVGSEMINDFGVMNPFSGDRFTFDKSGNRQDACSRSLDNSFAFGELEASCGDRGFFGEQYENYIPGVQRTTVGSTINYEITENINFFGDFKYTRADIQQQFQPSFRFGSIDINVADNAFLSDEARAELGGTGTASMAKFFGELGNRSSNHNRELFRFVGGLDGFFSLGDTDVDYELFYIYGETSNNRVSENDLIPGNLAAGIDSVIDPATGQAVCRSQLESAQDADYSDPATVDAGSCVAYNPFGFAQSSPEALDWVSADVTRKDVIKQEVIGGSLAGDTGAFFELPGGAVGIAAGFEYRTESSSTITDELTKSGATTNSATPDEFGEYDVTEMFVEVSLPLISGQFLAEELTLDGAYRYSDYSHAGSVDAWKVGMMYAPIADLRFRGTYGAAVRAPNISEAFSPLSPGFARVSDPCDADNILDDPDRVSNCAALGIPVGFEANDNVSIDTFSGGNDELTPEESTSLTIGTVWTPSYLENFSITLDFYDIEIKDAIIEVESQDIADNCVDATGGPDAVYCGAVDRSATTYDIDLVRSGFLNASAYNTSGIDVEMRYNFALDSLGVPGELYLKLFVNKLLELEQFEFQDRPDEINVEVGETGDPELQASFSATYNLDDLSVTWQSRYIDRVVTYDVSPGGGSPEDLEQGYIPSVTTHDLSFNYIVSENVKVNAGLRNIFDKLPKGWTNDPLYDLVGRRAYAGVTVNF

SEQ ID NO: 17725 - protein, 232 aa, Colwellia psychrerythraea
MIQKSKIKDLVVFTDENNSKYLNVLNDFLSYNINIIKVFRSIDDTKVMLIDTDYGKLILKVFSPKVKRNERFFKSLLKGDYYERLFEQTQKVRNEGLNTLNDFYLLAERKTLRFVHTYIMIIEYIDGIELCDMPDIDDALKNKIQQSINALHQHGMVSGDPHRGNFIIKNGEVRIIDLSGKRASAQRKAKDRIDLERHYGIKNEIRDLGYYLLVYRKKMRNFMRRLKGKPAR

SEQ ID NO: 17726 - protein, 1043 aa, Colwellia psychrerythraea
MKDRTYSSLMRCASNLQRLFFLALFSVIAIGAYAQGKTVSGTVLDKSGESVIGASVVVKGTTNGTITDFDGKFTLSNVPNDASLEISFVGYKTQVIPVQGKTTFNVTMAEDTEVLDEVVVVGYGVQKKSDVTGAMARVGEKELKAMPVKNALEGMQGKTAGVDITSSQRPGEVGSINIRGVRSITADQGPLYVVDGMIIQNGGIENINPSDIESIDVLKDASATAIYGSRGANGVILVTTKKGKEGKISLNYSGTVTFETLHDVTEMMSASEWLDYARLAKYNMGSYASATPDYEADKAAFGSVAASWANIEKAWEGGTYDPSKVGSYDWASNGKQTGITHEHTLSASGGTDKFQGYASFGYLNQKGTQPGQSYERYTLKTSFDASPLSFFKMGSSINASYSDQDYGYSFTKSVTGSGDLYGALRSMLPWTVPYDENGEYIRNPNGDVNIINPIRELDYNTNQRRTFRANASMYAQVDFGKIWEPLEGLSYRIQFGPEFQYYTLGIANAAEGINGDGNNGAQYKNEQKRSWTLDNLIYYNKTFAEKHNLGLTLMQSASAYHYEMGDMRATNVASSEELWYNMSTAGTLSSFGTGLTETQMTSYMIRANYGFMDKYLLTASMRWDGASQLAPGHKWASFPSMALAWRLDQENFLKDVNWLSQLKLRLGFGITGNAAIAAYATKGAITGLYYNWGQTDSSLGYVPSDPSAKDPAKMANQDLGWEKTTQYNVGIDYGFFNNRLSGSIDAYKTKTNDLLLGMTIPSLTGYTSTYANVGKTSGWGIDLQVNAIPVQTKDFSWNTTLTWSMDRNKIEQLSNGRTEDVNNRWFVGEEIGVYYDYVYDGIWKTSEAEEAAKYGRKPGQIKVKDLNQDGSIDATNDRQIVGKVRPDWTAGWNNTFSYKNFELSFFILSRWGFTVPQGAATLDGRYMMRKLDYWVAGTNENAQYYSPGSNGEAADTYSSSMNYQDGSYIKVRNISLGYNFTSKQLKNVGLNNLKVYVQAMNPFTIYKACDWLDTDLLNYDNNTKTFGSATTLKSFVIGVNIGF

SEQ ID NO: 17727 - protein, 113 aa, Colwellia psychrerythraea
MSLGKSGNLTTGIAGIKLTAPKRLSNDTQIVPGLHASVENSFSNKQPKMNARFIWADNYFENTTISSTPKVSYNVGASLLTAHKNIELFATYNCNLRSKYNSHQRFIKLKILF

SEQ ID NO: 17728 - protein, 955 aa, Colwellia psychrerythraea
MGISREKKALGYAVQDVKSDQLTRAANTDLAGALQGKVSGVDIAPSSGMPGASSKITIRGSRSFTGDNTPLYVIDGMPISSAADVTTTDNANGAAYGTDYANRSVDIDPNDIESINILKGQAASALYGMRASNGVIVITTKSGKGVAKGKPTITFRSNLSFDVVSTLPELQNEFGQGSGGSYDPYSGHSWGPKIADLANDPTYGGNTDNAFTQKMGKRQGQYYVPQRAEAGLDPWATPKAYNNMKDFFDTGITWSNNVNVSQNLDKGNYSFSLGNSHQEGIIPTTGMDRYNAKMSAEVQLSPNWSTGFNGNFVTSKIKKQSTANSGVTATIYNAPVSYNMKGIPSHVEGDPYEQNTYRQAWIDDAYWAVDNNLFTERSQRFFGNAFVKFTTKFGTDNHKLDVKYQLGDDAYTTNYSEIYGYGSTMADTGDAIEYHYSINELNSLLTASYRWDINKDWVFDALIGNELVEKRTQYAFSEGMNFNFPGWNHINNASIYQSSKSYNKKRTVGNFANLSLAWKNMVYLNGTIRNDVVSNMPRDNRSFTYPSVSLGFVFTELEPLKNNILTFGKLRASYAEVGMAGDYMQSYYYTPSYGGGFFNGTPIAYPINGTMAYIPYYKVYDPNLKPQNTKSYEIGADLTFFNGLFTLNYTYSRQNVKDQIFEVPLSGSTGYDSMIMNGGKIHTNSHELTLGVSPVNNRNFKLDFAFNFSKIDNYVDELAPGVESIYLGGFVTPQVRAGIGEKFPVVYGSTYKRNKAGQIVVDANGLPQVGEDDVIGRVSPDFRLGFNTNIELYKFRIAAVFDWKQGGQMYCGTAGEMNFYGVTKESGEKRKSNFVVPNTVKETGTDAQGNPTYAANDIEVTNAQAYYTRLRSINESYIYDSSFIKLRELSVSYPVYASKWLNVDVNVFARNLIVWSELKGFDPEASQGNDNMGGAFERFSLPGTASYGFGVNVKF

SEQ ID NO: 17729 - protein, 357 aa, Colwellia psychrerythraea
MQINTRKNIFSIAALLALVGAAAPMAASAQSTEFTWYGRIDLGLESTSDGDVSRIMASNFASRLGIKGEHKFNPALSAIFQVETGVAPDDTANSKAFANRNSFVGLKSANAGTVLVGTYDMPLKTLEGTSGGLWGQGDLLEILVHGKGSRVAIGNANFQNVHTRKTNVLHYASPKFANAIVAKVAYSPDEAKTTVLNKAVFGASVEYNDGMFNGGVAIENQKDAIAAGKAMKATKVTLGTALSDFTVGVAFSKLDNSNGKETSNAVITGAYKLDSALTLKASLGKSGESSTGANDGIKGMAFEANYAIDKQVAVYGYFTKLTNDSAARGTLVSSDNFPSVVAGKDPRALGAGVRYSF

SEQ ID NO: 17730 - protein, 344 aa, Haemophilus influenzae
AVVYNNEGTNVELGGRLSIIAEQSNSTIKDQKQQHGALRNQGSRFHIKATHNFGDGFYAQGYLETRLVSAQSGTESDNFGHIITKYAYVTLGNKALGEVKLGRAKTIADGITSAEDKEYGVLNNSKYIPTDGNTVGYTFKGIDGLVLGANYLLAQERHKYTGAGAGAVAGEVYQQKISNGVQVGAKYDANNIIAGIAYGRTNYREDIIAGSDSGKKQQVNGALSTLGYRFSDLGLLVSLDSGYAKTKNYKAKHEKSYFVSPGFQYELMEDTNFYGNFKYERNSVDQGKKEREHAVLFGVDHKLHKQVLTYIEGAYARTRTTQATGTKVKTEKEKSVGVGLRVYF

SEQ ID NO: 17731 - protein, 344 aa, Haemophilus influenzae
AVVYNNEGTKVELGGRLSIIAEQSNSTIKDQKQQHGALRNQGSRFHIKATHNFGDGFYAQGYLETRFVAAQSGTGSDDFGHIITKYAYVTLGNKAFGEVKLGRAKTIADGITSAEDKEYGVLNNSKYIPTNGNTVGYTFKGIDGLVLGTNYLLAQDRYKYAATGSFAGEVTPQSISNGVQVGAKYDANNIIIGIAYGRTNYREDIVTAPGGDLAGTKQQVNGALSTLGYRFSDLGLLVSLDSGYAKTKNYKDKHEKRYFVSPGFQYELMEDTNVYGNFKYERNSVDQGKKAREHAVLFGVDHKLHKQVLTYIEGAYARTRTNDKGKTEKTEKEKSVGVGLRVYF

SEQ ID NO: 17732 - protein, 342 aa, Haemophilus influenzae
AVVYNNEGTKVELGGRLSIIAEQSTNTEKDQKQQHGTLRNQGSRFHIKATHNFGDDFYAQGYLETRFVADQSGTESDHFGHIITKYAYVTLGNKAFGEVKLGRAKTIADGITSAEDKEYGVLNNSKYIPTNGNTVGYTFKGIDGLVLGANYLLAQERHKYTAGSDTVAGEVYPQKISNGVQVGAKYDANNIIAGIAYGRTNYREDLSTTKDLGKKQQVNGALSTLGYRFSDLGLLVSLDSGYAKTKNYKDKHEKRYFVSPGFQYELMEDTNVYGNFKYERNSVDQGKKAREHAVLFGVDHKLHKQVLTYIEGAYARTRTNDKGKTEKTEKEKSVGVGLRVYF

SEQ ID NO: 17733 - protein, 337 aa, Haemophilus influenzae
AVVYNNEGTNVELDGHLSVIAEQSSNTLDDQKQQHGALRNQGSRFHIKATHNFGDGFYAQGYLETRFVSKYKDNADHFDSITTKYAYVTLGNKALGEVKLGRAKTIADGITSAEDKEYGVLNNSKYIPTNGNTVGYTFEGIDGLVLGANYLLAQQRNAHSGAAGEVVAQAISNGVQVGAKYDANNIIAGIAYGRTNYREDLAIQDKSGKKQQVNGALSTLGYRFSDLGLLVSLDSGYAKTKNYKDKHEKRYFVSPGFQYELMEDTNVYGNFKYERNSVDQGKKAREHAVLFGVDHKLHKQVLTYIEGAYARTRTNDKGKTEKTEKEKSVGVGLRVYF

SEQ ID NO: 17734 - protein, 912 aa, Haemophilus influenzae
MTKKPYFRLSIISCLLISCYVKAETQSIKDTKEAISSEVDTQSTEDSELETISVTAEKVRDRKDNEVTGLGKIIKTSESISREQVLNIRDLTRYDPGISVVEQGRGASSGYSIRGMDRNRVALLVDGLPQTQSYVVQSPLVARSGYSGTGAINEIEYENVKAVEISKGGSSSEYGNGALAGSVTFQSKSAADILEGDKSWGIQTKNAYSSKNKGFTHSLAVAGKQGGFEGLAIYTQRNSIETQVHKDALKGVQSYNRLIAKPENQSAYFVMEDECPKGYDECIPSAKPPAILSTKKETVSVSDYTGANRIKPNPMKYESQSWFLRGGYHFSEQHYIGGIFEFTQQKFDIRDMTFPAYLSPTEKGDLANRPFYPKQDYGAYQHIEDGRGVKYASGLYFDEHHRKQRVGIEYIYENKNKAGIIDKAVLSANQQNIILDSYMRHTHCSLYPNPSKNCRPTLDKPYSYYRSDRNVYKEKHNMLQLNLEKKIQQNWLTHQIVFNLGFDDFTSALQHKDYLTRRVIATADSISDKTGKTRRNGLREYPYLYPKPKPYFAGEDHCNYQGSSSNYRDCKVRLIKGKNYYFAARNNMALGKYVDLGLGIRYDVSRTKANESTISVGKFKNFSWNTGIVIKPTEWLDLSYRLSTGFRNPSFAEMYGWRYGGKNDEVYVGKFKPETSRNQEFGLALKGDFGNIEISHFSNAYRNLIAFAEELSKNGTGKGNYGYHNAQNAKLVGVNITAQLDFNGLWKRIPYGWYATFAYNRVKVKDQKINAGLASVSSYLFDAIQPSRYIIGLGYDHISNTWGVNATFTQSKAKSQNELLGKRALGNNSRDVKSTRKLTRAWHILDVSGYYMANKNIMLRLGIYNLFNYRYVTWEAVRQTAQGAVNQHQNVGNYTRYAASGRNYTLTLEMKF

SEQ ID NO: 17735 - protein, 915 aa, Haemophilus influenzae
MTKKPYFRLSIISCLLISCYVKAETQSIKDTKEAISSEVDTQSTEDSELETISVTAEKIRDRKDNEVTGLGKIIKTSESISREQVLNIRDLTRYDPGISVVEQGRGASSGYSIRGMDRNRVALLVDGLPQTQSYVVQSPLVARSGYSGTGAINEIEYENVKAVEISKGGSSSEYGNGALAGSVTFQSKSAADILEGDKSWGIQTKNAYSSKNKGFTHSLAVAGKQGGFEGLAIYTQRNSEETQVHKDALKGVQSYNRFIAKTDTSAGYFVIQDECPNPNDYDSCIPSAKPPAILSTQSETVSVSDYTGANRIKPNPMKYESQSWFLRGGYHFSEQHYIGGIFEFTQQKFDIRDMTFPAYLRSTEDKDLEKPSFYPKQDYGAYQRIGDGRGVKYASGLYFDEHHRKQRVGIEYIYENKNKAGIIDKAVLSANQQNIILDSYMQHTHCSLYPNPSKNCRPTLDKPYSFYRSDRNVYKEKHNMLQLNLEKKIQQNWLTHQIVFNLGFDDFTSALQHKDYLTRRVIATAKSISGTVGKTQQHRNGFKERPYLYPTPKAELVGEDHCNYQGNSSNYRDCKVRLIKGKNYYFAARNNMALGKYVDLGLGIRYDVSRTKANESTISVGKFKNFSWNTGIVIKPTEWLDLSYRLSTGFRNPSFAEMYGWRYGGKNDEVYVGKFQPETSRNQEFGLALKGDFGNIEISHFSNAYRNLIAFAEELKNGRGKGNYGYHNAQNAKLVGVNITAQLDFNGLWKRIPYGWYATFAYNRVKVKDQKINAGLASVSSYLFDAIQPSRYIIGLGYDHPSNTWGINTMFTQSKAKSQNELLGKRALGNNSRDVKSTRKLTRAWHILDVSGYYMANKNIMLRLGIYNLFNYRYVTWEAVRQTAQGAVNQHQNVGSYTRYAASGRNYTLTLEMKF

SEQ ID NO: 17736 - protein, 912 aa, Haemophilus influenzae
MTKKPYFRLSIISCLLISCYVKAETQSIKDTKEAISSEADTQSTEDSELETISVTAEKIRDRKDNEVTGLGKIIKTSESISREQVLNIRDLTRYDPGISVVEQGRGASSGYSIRGMDRNRVALLVDGLPQTQSYVVQSPLVARSGYSGTGAINEIEYENVKAVEISKGGSSSEYGNGALAGSVTFQSKSAADILEGDKSWGIQTKNAYSSKNKGFTHSLAVAGKQGGFEGVAIYTQRNSIETQVHKDALKGVQSYNRLIAKTDDKTSAHFVIQDECSKPDDYNSCKHLAKPPAILSTEKETVSVSDYTGANRIKPNPMKYESQSWFLRGGYHFSEQHYIGGIFEFTQQKFDIRDMTFPAYLSPTEKGDLANRPFYPKQDYGAYQHIEDGRGVKYASGLYFDEHHRKQRVGIEYIYENKNKAGIIDKAVLSANQQNIILDSYMRHTHCSLYPNPSKNCRPTLDKPYSYYRSDRNVYKEKHNMLQLNLEKKIQQNWLTHQIAFNLGFDDFTSALQHKDYLTRRVTATANSIAKVGETRNGLKSSPYFYPKPTVGFAGEDHCNYKGSSSNYRDCKVRLIKGKNYYFAARNNMALGKYIDLGLGIRYDVSRTKANESTISVGKFKNFSWNTGIVIKPTEWLDLSYRLSTGFRNPSFAEMYGWRYGGKNDEVYVGKFKPETSRNQEFGLALKGDFGNIEISHFSNAYRNLIAFAEELKNGRGKGNYGYHNAQNAKLVGVNITAQLDFNGFWKRIPYGWYATFAYNRVKVKDQKINAGLASVSSYLFDAIQPSRYIIGLGYDHPSNTWGINTMFTQSKAKSQNELLGQRSLGSNSRNVKSTRKLTRAWHILDVSGYYMANKNIMLRLGIYNLLNYRYVTWEAVRQTAQGAVNQHQNVGNYTRYAASGRNYTLTLEMKF

SEQ ID NO: 17737 - protein, 913 aa, Haemophilus influenzae
MTKKPYFRLSIISCLLISCYVKAETQSIKDTKEAISSEVDTQSTEDSELETISVTAEKIRDRKDNEVTGLGKIIKTSESISREQVLNIRDLTRYDPGISVVEQGRGASSGYSIRGMDRNRVALLVDGLPQTQSYVVQSPLVARSGYSGTGAINEIEYENVKAVEISKGGSSSEYGNGALAGSVTFQSKSAADILEGDKSWGIQTKNAYSSKNKGFTHSLAVAGKQGGFEGLAIYTQRNSIETQVHKDALKGVQSYERFIATTDTSYGYFVIQDECTNGYENCKNSAKPPAKLSSQKETVSVSDYTGANRIKPNPMKYESQSWFLRGGYHFSEQHYIGGIFELTQQKFDIRDMTFPAYLRSTEDKDLSSRSFYPMQDHGAYQHIYDGRGVKYASGLYFDEHHRKQRVGIEYIYENKNKAGIIDKAVLSANRQNIILDSYMQHTHCSLYPNPSKNCRPTLDKPYSFYRSDRNVYKEKHNMLQLNLEKKIQQNWLTHQIVFNLGFDDFTSALQHKDYLTRRVIATADSIPKKANEPTPRNGLPKQPYLYPTPKPYFAGEDHCNYQGSSSNYRDCKVRLIKGKNYYFAARNNMALGKYIDLGLGIRYDVSRTKANESTISVGKFKNFSWNTGIVIKPTEWLDLSYRLSTGFRNPSFAEMYGWRYGGNNSDVYVGKFKPETSRNQEFGLALKGDFGNIEISHFSNAYRNLIAFAEELQKNGTGKGNYGYHNAQNAKLVGINITAQLDFNGLWKRIPYGWYATFAYNRVKVKDQKINAGLASVSSYLFDAIQPSRYIIGLGYDHPSNTWGINTMFTQSKAKSQNELLGQRALGNNSRNVKSTRKLTRAWHILDVSGYYMVNRSILFRLGVYNLLNYRYVTWEAVRQTAQGAVNQHQNVGNYTRYAASGRNYTLTLEMKF

SEQ ID NO: 17738 - protein, 358 aa, Haemophilus influenzae
AAEIYNKDGHKLDLFGKVDGLHYFSDDKGSDGDQTYMRIGFKGETQVNDQLTGYGQWEYQIQGNQTEGSNDSWTRVAFAGLKFADAGSFDYGRNYGVTYDVTSWTDVLPEFGGDTYGADNFMQQRGNGYATYRNTDFFGLVDGLDFALQYQGKNGSVSGENTNGRSLLNQNGDGYGGSLTYAIGEGFSVGGAITTSKRTADQNNTANARLYGNGDRATVYTGGLKYDANNIYLAAQYSQTYNATRFGTSNGSNPSTSYGFANKAQNFEVVAQYQFDFGLRPSVAYLQSKGKDISNGYGASYGDQDIVKYVDVGATYYFNKNMSTYVDYKINLLDKNDFTRDAGINTDDIVALGLVYQF

SEQ ID NO: 17739 - protein, 875 aa, Colwellia psychrerythraea
MRNKLSDAIKLANKSALMLGSAAAIAMMGVATSVHAQDGAMEEVVVTGIRSALKNAVDIKRNSTAVVDAVSAEDVGKLPDSDVGQALGRIPGVTVGRAFGQGASVSIRGSDPQMTYTTLNGQSVASTGWYDQQAIDRSFNYSLLPAELIGGMEVYKTSQADITEGGIGGTVIVKTRKPLDLDANTVFGSVKGSIGTVSDDFAPELSGLYSWKNDAETFGVLVAAAVSEGDYIRRGIEADTRWSGDVAPTTFVQERERKAFDVNIQARPSDNLEVGLHVLSMELVGDNSNTSHYIFAGNAPASTCSVTNANGICLKSNIGAADATDAFIQTWARVGKMTSDTYELNATYTGENFKLSGVVGKTEAEGGTDMTTNYSYYAGLLPKWTGSIDATGKEIKVRPSSDQSTTVADFGTTAGPAGSWATTRGPNSDEETFYQFDLTVDLELGLINSFKTGIRSTEHEFEKRVDRSVFKATTTAAQTSSLYSGTIDMGTPGWSSPKPDIGAMMANTRANISGWVEERGGYGLLNEQNNSFYGMFTFEGEGVRGNFGLRYIQTDVYGIGYKLDGTPLSVGDVDQNAGWGKQKVKEKADYDDVLPSVNVAFDLTDDLVLRASASQAITRPNYDNMFLEVQTGFQDTVAGNETYTKGDVGLQPMKSSQAEVGLEYYYGDGNLISLTYFTKDITNFITTETEVDQSIGVVSPDSGLDSWTVNRYINAGGGEIDGIELQLNHAFDNGFGVLVNYTYANGNAPAVSYQDNIGVFTLSSNHNANLVGYWENEEFSARAAYNWRSKYMVRETGWYGNRMHDDFGTLDLSFGWNVNDMVTLSLEATNVLEEDDIQYGAADNSTTVKAPLKDGYPAWSFMGEATYKLGVSFKF

SEQ ID NO: 17740 - protein, 362 aa, Colwellia psychrerythraea
MKKALLPVFISAALLSGQAFAQVIYQDDTNKLELGGVAVLDLAEPMWADEADLSLGRSIFNIAAERKMANDWSIDFKLEWDQFVNSPNSGSSNFRNRLSYITINNEDLGNLRFGKQWSAYHDVARYMDNMVIIDPDATPIYSEGADGGFAATGRGDELIAYRYSQNGLNVSAHYGLSTDGYNAELAEHEKVSRDYNYAAAVSYDFDFGLSLGTTYLENKVKVESGSSNIGLNDGDSQKALTFAGNYEVDGLKVAAAYTQGTKIHKAGLFGPDGKWADANAFDIYTSYLMDVGIKPFAYYSSIDFDDNNVGATGKRDIIAGGVSYAFAAGVIASVELHSYELSEFGGAKSTENGGGFNLIYAF

SEQ ID NO: 17741 - protein, 941 aa, Colwellia psychrerythraea
MKNLNFPKYFLLLTFTLFLNASIANAVTVTFSYTGSAQTWTVPSGVTLITVDGYGAMGGHGASDRNGRGGLGGRVQTNISVTPGTTLNIYVGGSGGNTTSNPGANYKPSYNPYEAGNGQGGFNGGTQGGQTSAGAGGGATDIRFGGTALSNRIYVAGGGGGGANQRRESQPGGDGGHGGGTTGGAGSKGGSGGTNQSSSDLTRGPNATGGGAGGGGGTSSAGGAGGSVSGSDGTLGIGGQGGNSGRHGGGGGGGYYGGGGGGHKNGSDAGGGGGGGSSYCDPTYCSSTTHTQGYTTATGNGSLEITYDTTAPTLSSSSPADNATAVAIDANIVLNFSESVDAETGYITIKKTSDDSTVESFSVTGSKVSGSGSSQITVNPSSNFDPNIEYYVLIDATAFDDISSNSYAGISSTTALSFTTANVLPTLSSSTPADNATDVARDANIVFNFSEIVDVKTGNITIKKTSDDSTFETIDVTSSNVTGTGTTQITINPTSNFEAETEYYVLIDATAFDDVSSGSYTGISSTTALSFTTESMVDPTTVKDVVGSIDVQSHLAKNSITQSTITVSSRLSYLRQNKDNQNLSKQNIKLDFGNAILTSLTNELLAKNDKSIIPDNWSSWSEGSLSSSKIGDRTGSSSSETDAQALAFGFDTKLNDSDLLGFAIQYGKSDTDIGSSGSSTDSENINISIYRTRPLDDDNFIEGMFGVGLIESDLKRISGANTLTGSRSGTQIFGSINYGKTLDKGDFNLTPIGRIDLGYTELDAYKETGTDALSYGKQTIESGLASVGLELSDIVKFNDNKLKPFGSIEYGMDFSNSSEAKMNYVSDTSTIYTYTQGANSNHLITSVIGFEYITKDNLEIISSYKRIQGNESEQTDILNVSVNFKSKRETEYAMSIDGSEDLNAGFDITKNVNGFDINFYANRSLSENSDQTANVSLSRSF

SEQ ID NO: 17742 - protein, 755 aa, Colwellia psychrerythraea
MLKSKLANAVSKAVKPKYLIMTLLVTSAPAFSSDENVNKEGLQDQEITRVVGIKQTLTSNIAQSTMRSEADLSSVPRSVQVINSEVMEQQDASDLSDVVQNVSNVTEHNNFGGTRDLFKIRGFEANVYEDGTRVYGVAQDKAVIEDLESVEVVKGPESVLYGNMSPGGLINLISKRPTPIAQNQVKVTMDEHGKQRLSVDFSGPANDDGTVLYRLVGVFDDSESWRDASDSKQVFIAPSLSWLVTDDTTLTFSYKYNKEELPFDRGTLAVSDGNNGWEFLDIDEKRLGTDFSRQEREVHKFGFDIDHDINDYWSMRFKARNYERKASAERVHFYASSAASRKNGFIYGQDGAKAFDGTINRYLYGSELSSNTQLYSWENNIEFNTGSLEHRTILGADYTHYKEKEDQLASASWSQNEYAMYSKGVLHTPNTSKGSFDYYTGDPALEPHPDDLYNTRQVRQELTEYSIFAQDLIELNDWNFVLGARYDIFKAKKETIWDPTAAAAANLSNESSESPTEANISFQAGALYKLNSQVSFFGNVTDSYLPNQKFDSVKKEWVEAQNGRQFEVGSKLSLLGHKLNLTTSVFRTDLKNVAYDGDIAGSVDVYKQKVQGLEIDGDYAITDDLTALFSYGYTDVEFVDAPDSVSKPVNVPKNNASLWLTYQASHEWGVGSGIRYIDDRAGNRRKDYDYTLDAYTLVDAAIWYAPDFADNDLKLQLNVKNLFDKDYYTAGSDSTQNAVYLGSPRTVSLSAAYNF

SEQ ID NO: 17743 - protein, 703 aa, Colwellia psychrerythraea
MNKNENTGAARPLAWTLLSLSSGVFSQAAFAEGQHTVLPEVSVVATQDTSLQGKRKLVTTDSTGLPTAVSVVTADELGTINIGRDISNMFRRVPGVVANNIDQGDTGNGFRMRGFATQGTHGADTAVYVDGVPQNMPSSQAGAGHGPAFLEWLTPDMIGQIDVIKGPVSALYGDQNRAGAVPISTQSGDVPSSIGIGFDRYNGKRATLVLSGSHAFRPGPEPIKSLFVADIYRTHSYRYDGSTDRDNFFWKLSTRIGDGVYSLRLNHYRSESTAAGYLLLSDLQSGKVDPRSTQYGLPGFGSGKRSMFALNRAPAHGEDGWYATLYGEAFERERGIATSSVQHTVGSDDRNIFGGRLANNFTFGDRAALMVGAEVRRDRGDAQRQIWVRGVPTANYINAQQLDLLTYGLFVQGQFRPVEAVKLTAGLRRDWFDYDIVNRKLPAASTDYFSGVTTPKLGAVWSVLPRLDLFANVAQGFRSPAAEQISSSGATGPLGAPGGTVYDVSPSKVKSYDVGFTATPANNLTVTAAAYYTLNEDEIVGQPDGSFKSVGDTTRKGYELEARWRPIRPVSVYASYGQIIQAEANNPLPNTGARLSVPRHQLKLGAEYRQRLQGAQLTVNADAYLTTGIPYYMGAPQTQLRFMPAYTRFDLRAVLDWKQYQLSLFAVLQPHRFSTEAAYGSAAGLLVAPQPKWQAGMAARYFF

SEQ ID NO: 17744 - protein, 435 aa, Colwellia psychrerythraea
MIRVRPVGRLALFLALGGTSPCHAATEEAKAPDYLEWRLLNRNYFLYNDYRRADARRGYRKEWAHGLIADLESAYTPGRVGFGLDLHGFAGFKLDGGRGHAGTGLLPLDSSGDNASEYSDAGAALKLRLGESLLKVGEMTVETPVFDTSDKRLQPQYARGFFLQSDDLDRVRIQAGRFTAFKEQASSSGHGDFDGYGASTAGSAIGFAGASLAASDNLSGSLFAAQLDNVWRQVYLNMNLQRAAFSLDGNLYRTRDQGRSRAGAIDTLAYSLQLKYRVGAQGFSLAYQRVHGDTPFDFVGGDSIYLANSIKYADFNGPGERSWQARYDLDLAPFGLPGLSFMARYVSGRAIDGSHAPAGGAYNPLGADGRYRPLQGSGGKHWERDLDLRYVFASGPLKDLSLNVSHLSHRANAAQAGDDIDRLYLIVEYPLKGSL

SEQ ID NO: 17745 - protein, 168 aa, Colwellia psychrerythraea
MKNIVLVSALAVCVSVTSAAAEGLYAGAALTALQADNDGFEIETTNLTAIVGYEVSQTFAVEGEFSFPIEEDEISGVDVKLNTAALFAKASFPISPDFSAYGRIGFMNLEVEASSGGESADEDETGLALGAGAEYAMSSTVAIRADATFADIDDVDVTAVSIGAVFSF

SEQ ID NO: 17746 - protein, 934 aa, Colwellia psychrerythraea
MKHTNRMTSLESVQKRRQPVRIPFMKTALAVALACAGLPVLADARLQGYVSAGEPAIALQGARVRILELNREAVSQRDGRFIFLDVKPGTYTLVSSYLGADDVQERITLVDHQTHQVNFSLKGVSGVVENIIVIGQAAGINKALNKQRSADNLITVVSADAIGQFPDTNVSEALQRLPGLSVERDQGEGRYVRVRGMSPDFNAVTINGVGVPGPDADRRAVALDVIPSDLLENLVVTKSVTPDMDANSLGGSIDVQSLSAFDRDGFFYQFTAEGSYDDNTAQTSPKLALTTSKRFSVGSGNDNLGIAAGISHFKREFGSDNVETGGAWDFGDGQDLLEEMEQRDYRITRERSGVVFNLDYKPGNSTHLYWRNLYSEYTDKEIRLGTVIEFDEPLASGEQGIAEVARELKDRAETQKIFSSALGGKTDFERWSINYGLGYSKSGENEPEHVAGAVFTLDEGVIADEVFELGYQGKRNIRVNAPAEFYQAQSYRLDEVELASSDTNDESLSLHLDFTRELTLADHPAQLKLGVKRVEREKDNDASVWVSEEFIGDTSLTQFAAGPVDYRLGEFGPQIRARAIKAVLDNVEEDELESRIGDFDITEDTSAAYVMGRIDLGNLRLLSGVRYEQTDFSARGYAYDGVADEMNTQTFSNDHDYWLPALHVRYSFSDNTQVRAAWTNTVVRPGFGQLSPGRVLEEDDGEIEASFGNPDLKPLESSNLDLGIEHYPGAASVISAYVFYKSIDHFAYQTDLAGSAGYEGFAEAMTFVNGKRAELTGIELAASRQFSNLPAPWNGLLVGGNATWVDSTARIGSNDDGEWSERDIPLPSQSDVSANLMLGYESDRWSARLSANYKSEYLLEVLDPLDVDYDTYVDEQLQLDFSLRYFVSDNIKLHVEALNLTDEVYYTWVKSPRYNAQYEAYGPTYKLGITFMSF

SEQ ID NO: 17747 - protein, 353 aa, Haemophilus influenzae
MKKTLAALIVGAFAASAANAAVVYNNEGTKVELGGRVSIIAEQSTSNRKDQKHQHGSLRNQGSRFNIKVTHNLGDGYYALGYYETRFINKDIDGNEKNIGSGFGSITTKLAYAGLGNKELGEATFGLQKTIADKISTAEDKEYGVIEKNSYIPTEGNAIAYTYKGIEGLTLGASYVFGGRNFSDYEITDGKVSNAVQVGAKYDANNIVAGFAYGRTNYKAQQAKTQQVNGALATLGYHFDDLGLLISLDSGYAKTKNKADKHEKRYFVSPGFQYELMEDTNLYGNLKYERINSVDQGEKVREHAVLFGIDHKLHKQVLTYIEGAYARTRTNDKGKTEKTEKEKSVGVGLRVYF

SEQ ID NO: 17748 - protein, 314 aa, Helicobacter mustelae
MTKINKALSLTLAAVVSMPTLAENINTDDFSFGGRIEARGVLADSDFSDASRVRLNGQGKHEINDDITAIGKFEYELTQQDDSAATTNQTKTRYLYVGVETAYGTVTYGTQDNAVTYLTDFTDMAEYFSGYTNEEITASGDRAEDTILYSVTKGDLTFNASANLKETENGGGLMVAYKLLPSVEVSAGYATTEAAENESDSSDVYMIGARYTNGGVLVSGLVQKGTLADSDFEAVDAFASYGFGENTVSVSYNYLSADDQSANDVNFVAFEYGRYIGDVAAYAGYKVALNDDTSAGHGNNGNADEFIIGARYSF

SEQ ID NO: 17749 - protein, 215 aa, Colwellia psychrerythraea
MKRTALTILAASSFSVAAAPYVGLEYGFGTTDHDFETSFEADGVNLNPELEDGIFGGFVGYSINDSWAVELGYSQFELDDSRSKNLGIENIDGKDYHREMEWDSSIKAKQITLAPVFSYALNDKWTTKVKAGLSYTQYESKAGKYEEHELVSNDDVEMSKTLFHNTEKNNELGAVFSVGAEYKVFPQLTIGANAKYQLDSYANTASINVGSTYYF

SEQ ID NO: 17750 - protein, 996 aa, Colwellia psychrerythraea
MKNNTIKIKAFLCLLLLMCGWVSVQAQQVLTVKGVVVDALKEPLPGASVQVVGMSTGTVTDLDGNFSLQVPKGKTIAVSFIGYVTQELTVNQNQSNLTIQLKDDSKQLNEVVVIGYGTVEKKDLTGSIQSVTSKELSKLVTTDVTETLNGRVGGVLVNKTSNRPGSDTKIEIRGINSFNFSNEPLYVIDGVPSQTGMRHLNSADIESIDILKDASSSAIYGSRGANGVVIITTKGANKRQGFNIDYSGYVGFKTPTRIPEMIGNMGNGLEYVDYRTALWKKKYGDASLSRPDFLTDDEKRRIKHGEYYDWLRELSQNALTTSHSVSATGGTDKLSFSFGLGYLKDDGMVGDESFERITANVGLEYRFSDKFKTGINSYVSLNNTNEGANDALINAYFLPPTVSPYDKDGSYLFNCQPTSSKINPFVQIENNKREKEANYTNFSGYLEYQPIKGLSFKSQIAVQYDSDVYGEWVGTMTQAKGGLNAPEAYRKEGRNMNWVWDNIITYDKTWKNIHRLNAIGLYSVQKETHKGSEMRGDGLPYNSDWHAIETAEEIRDVKSYYWESSMLSFMGRVNYTLMDRYLFTVTGRYDGTSRLATGNQWGFMPSAAVGWQMKNENFLKNVDWLNSLKLRVSWGKSGNNSIDHDITWTKLDLTHYIYGGKGENAFGLGDRKGNKDLRWEMTSEWNYGIDFGFLNNRINGTIDVYNRTTKDLIFARSVGNLNGYGSILENIGTSSNKGVEIGLNTVNVSKKDFTWKTNLTFSLNRNKIVDLYGDKKDDLANRWFIGQPMKVIYDLEKVGIWQTEDKELAAKYGQVPGHIRVADLDENYVIDERDYKVLGSPSPDWTAGMTNTFTYKNWDLSFYMYARIGGTYNDDFTYMFTAWDNEHWNKLNVKYWTPENHSNEYQQIGAQSYHTQVLGKISGSFLKIQNITLGYTLPENWMKKMKMKNARAYINVQNPFTFTDYLGPDPETIGEDVYKSLSLYPMTFTFGVNLTF

SEQ ID NO: 17751 - protein, 379 aa, Colwellia psychrerythraea
MKRVQVGLTALTAATAVFGQDCMAAEPARPSSVQIYGVADVALAHYQTSGSSGTKMQTGGSGSRIGFFTSEGLSDGWRVNTRLEAGFNMNSGTKSSTGGVPDRLWSRQAYVELENKALGGVRLGRLQGPTYNFFPKFDPMLVPAMDAWGVLTTLGAALPGYGSGTGVSSGFLINPTMRTQNTIAYMSPSWRGLQAEVAYSFSNGSSVEPALLEVGLDYRSGPLAVGLLFVHADSTSGAGTVRATKPVSEMAIGAKYDFGPFNPYVTYIHRNLTDQMVGSDGAALNTNSESVKLVGAVVPVSSRGNIRITYGRYSSGSPGRDAKSYGLAYTYDVNPRLMLMVAATRLTQQDKAKWPVFQSPRPDAGASVNGVITGMTWRF

SEQ ID NO: 17752 - protein, 360 aa, Colwellia psychrerythraea
MKIETGYKAIIRDMNLDFDQEIYDETIQTYVFSDELSNEFKYDEQVHAAYVLFKGKLKKKIGFNFGLRAEQVYLTAKSDNTQNIENNYFNLFPSARITYRVRKGEFFKVSYSKRIRRPRFRLLNPFRDISNPTRIRVGNPELGPELTHSAEIGYNKVWSKISLIPSLFYRHTTNVIQRFASFDANSALVFRPVNLGTATDYGIELIVIGNLVKWWDFNASYAFFNREIDARNSETDLITSNTSWNAKLQSNWKLSKNTTLQLTGNYRAPIIRAQGTRQAFHSIDLGFRHRFLKGRATFGLVLTDIFDTRQFGFATTTTEFTSSGIYKRESQILRASLTYQIGKRFKTSIKKGRGNRRRRR

SEQ ID NO: 17753 - protein, 681 aa, Colwellia psychrerythraea
MKTHPLVATVAALLFAADARAQSSDSALTLGKVDVHQHHEGQLSAHQVLTSVDVLGADQIEDKNVSYSWELLGQMPGMQLTETRQGAESGKVSFRAFNGEGYLNAIKTLIDGIPSNVNSGNQRFVDMLFPLEISYIEVVRGTNDPRYGLHNIGGNINFGTRQGGSYTDARVAYGSYASRDAQIAIGRERDGFAQNYFIGAQASNGYRAHDRSSKHVLGGKWFYGSLDDGMRIGLTARAYRTQADEPGFMTAAELQADRRNSDRRNRNDGDDRDMQQLGVHLDLKLTDTLFLGSKLYYNRYEDDRRVTFSDLPTGNAPRQRRRWNETQVGMLNTLTWRANDLLTLEGGINYEHQDNAYRRERFNYAEPTDFAAVPARIQNDDRYTFDNWGAYVQAIYQPVEALKLVPAYRVDRFDGDTQLPGAVRAPLQRYGSIGQPKLSVIYALTPSTNVYANWGRTFQVLTGSTAPAYLTPGQAGIRPSTNTGVELGMKFSPFAGSQARIAVWQQDAENEVSNMPATGTTVTLGKTRRRGVDAQISAQLGDRWTLWASHAYQEARITRDDRAAALSLQGNEVIATPRYISNIGVDYRATEALQLGLQGRAQGNYYLEERNVAGKYGGFATLDLTARYTINPNWSVDVQVRNATGREYAYVWYDSFFWAQAQPMFSPAAGRQLYLGLRMKL

SEQ ID NO: 17754 - protein, 502 aa, Colwellia psychrerythraea
MTKLDEKQIELLRNGSSGNIATVLAKAVPGLSDSSRTITDYGQTLRGRNALILVDGVPMNLTRDTSRGLSAIDPESIANIEVIRGSNAIYGGGASGGIISITTKAAGGEPTAKTVVGLQTPLTNFRSNALSGNIHQYFTGSFNAFDYALDFGYQRIGSPYDASGDRVAPEPSQGDLYDSDGYSIGGKLGYHIDDNQYVQFAANYYNAEQDSDYASDPSVKNAPAGTVPAKAIKGLKLKDQNKNENQIYNLTYNHKDFFGNKVDAQIYYRDFFTRFSPFDARKNPNRGGNVDQIYQENNILGSRLTVTTPLEFLGDTSLVWGGDFSREKSEMPLDTFNPDIYDQSGGLEFVKTGKLIYLPELTTQSVGGFVQLKHRFNDQWSAEAGTRYEDSYAQIDSFIPLSQFDPKTQSYKPNPYVYQGGKVKADAWLYNANVTFSPNDQHSIYASFNQGFQLPDVGVIIRNADNTDKKKNYELSSSFLEPVKVITMSWAGKGTSITFHQA

SEQ ID NO: 17755 - protein, 735 aa, Colwellia psychrerythraea
MYFHPTKQAKPRFARPALVTPRGLSLTTLVLSLQAGGVFAQSGEVPAPATASAAAELPAVTIRAGSDDETATGPVHGFVAKRSATATKTDTPVMETPQSITVITRDRMEAQGAQSVQQAIGYSAGVYAGPFGNDARGDWGRFRGTEFTQYRDGLLNQVGFYNNVRPDVYALERIDVLRGPSSMLFGQGAVGGILNLVSKRPQAEAAREIGVQFGNYNRKQVQADLTGPLDADGKWLYRLVALARDSDTQVDYVKDNRYLIAPSLTWRPSQDTSLTLLANFQRDESGTSVGFFPWRGTLQANPAGQIPDHLFISEPGFDRYNAEQASVGYEFQHKFNDTVTVRQNLRYSHSTVDYRSIYAAGFNGAGHGWVPGSDTLMRRTVYLNQPTLNSFAVDTQAQTNFRTGPVQHTLLTGVDYQHSEITGRAGVGGTAAPLNVFNPVYGNFTLPGTRDLNPATQAQTGLYVQDQLSWNKWLLMLGLRYDWSRAAQDNTPSASRDDSELTKRAGLMYRSDIGLNPYVSYSESFQGLAGFNKANQAFKPLRGSQWEAGIKYQPPGKNATLTIAAFDMREKNRKTAGVVNGIPDSVQVGEARTRGIEVEALASLSSRLDLIATYTYLDARVIDGTPAEVGKKLASTPSNMASLWANYRFKLFGVPGFVAGGGVRYVGPSYDGADQNRVGGVTLYDAMIAYDHGPLRVSLNASNLFDKQFLTTCLARGDCYFGARRTVVGSVTYRF

SEQ ID NO: 17756 - protein, 625 aa, Colwellia psychrerythraea
MKSVPLISGGLSLFLSACSGGGGSFDVDDVSNPSSSKPRYQDDTSNQRKKSNLEKLSIPSLGGGMKLVAQNLRGREPSLLNEDGYIIFSSLSKIEDDFKKENQSQEPTIGSIDEPSETNSPQNHHGQQYVYSGLYYIQSWRNFSNGKFYSGYYGYAYYFGKQTATTLPVNGEATYKGTWSFITATERGKNYSLFSNSSGQGYSRRSAISEDIDLENDQNNGETGLISQFSADFGTKKLKGELFYTKRKTNNQNYEKKKLYDIDANIYSNRFRGKVKPTEKDSEEHPFTREGTLEGGFYGPNGEELGGKFLAGDKKVFGVFSAKETEETKQKTLPKETLIDGKLTTFSTKKPDATTSTTANAKTDATTNAENFTTKDISSFGEADYLLIDNYPVPLLPETENSGDFATSKHYEVRDKTYKVEACCKNLSYVKFGMYYEDNKKNNKNETEQYHQFLLGLRTASSKIPTTGNVKYRGSWFGYISDGETSYSTTGDKRQDKNAVAEFDVNFAEKTLKGSLKRADSQNPVFSIEANFKNGGNAFTGTATAKDLVIDGKNSQTKNTPINITTKVNGAFYGPNASELGGYFTYNGKNPTDKNSPTASSPSNSEKARAAVVFGAKKQVETNNK

SEQ ID NO: 17757 - protein, 476 aa, Colwellia psychrerythraea
MGTMMIGVVRIVFQILMDMTLYTSSGSEYSEDSGDEDGIPISPPAIEEDRAELDSIRELQVSRQSSAVASNDSINEVSFAADSSGFKEEQQEESTTESDFEILDEVDEEDSLSKDISTNLGGTVSTEPQEQSTAKDKEELLKKATIAVASHNQAREANKISSKQIRHRMFVRDILISPVSAGEDGTDILARIIGYHIWSSGTLGSNKQKSKADLNGYSSKIAGGTIGLELNLENDLLLGANFSKFSSRVKYQDQGGSSDLRSSTASNRAKYDTHIFSLYGLSPVSRNMSVSVIGSAGLSKGRKARSKLLSFEPHLNYRVELPKAVTLIPHIGLRYEYEKANAYQEQIASNLSIESAKKSYQALSGEIGSRVIFAPIKLNGSTPRAISITPTVHFSVERKIGSRGTSHPFTLTYYESKQTIGTGTISANAQNERTSLNAGVGLIAASQNIKLELLYDQQRQRRFKSHQGVLKLKVSL

SEQ ID NO: 17758 - protein, 715 aa, Colwellia psychrerythraea
MNTSIHFKKAILSISITLLLTQNIFAGENTQSAQQLPTIIVKAEATDNTTLSNGQVTKKSQVGMLGDKDTMDIPFNVTSYTAQYIQDQQVTSIAKALKNEPSVRSVFSGNGLGEYFNIRGFYTQSHEMAWNGLFGLVPHNRIPTEFLERVEVFRGTSALLNGMSLGGAVGGVINVVPKRAGEQDLTRVTATYTSDSNLGLHLDVGRRFGDEKQFGIRVNALKSGGDTVLDGQEEDRALGSIALDYKGDRLRASLDLYDINEKVDGGMPLMVSFASADIPKAPDSKINTQPGSYAHTKAKGLIANVQYDFLNDWTAYATVGTKKQKSHGVIANNALGMAAQPNGDYTAISRMNANDTDVNAVETGVRGTFTTGQIKHQLVLSGNTIDQNTYMGLSVGSPWQSNIYNPKPGTNAVRPANVPKISETKLSSVALADTLSVLQDKYQLILGLREQRVESQSFSINPATNALNPAYKESALTPAVGVVLKPWGNHLSLYANYIEGLSQGDTVSDTTAANVNTVFKPYKSKQFEIGTKWDLGNFRNTLSFYQITKPSLIKNTTTNIYSDDGEQRNRGVEWTTVGDLVDHLRLLGGVSYLDAKYTKTAGGVYQGNDVMGIPHWQSNLGVEWDLPVQPNLTLTANSVYTGSMYADNANTQKLPDWIIFDLGARYATVIAQRNVVFRGGIDNVFDKKHWAGVWNGYVGVGGDPRTYKLSMQIDF

SEQ ID NO: 17759 - protein, 653 aa, Colwellia psychrerythraea
MKKRFLLSLSLVASLLCAEDNGFFVSAGYQIGEAVQTVKNTGELKNLNDKYEQLNQYLNQVASLKQSIQNANNIELVNSSLNDLKSFTENNYNSTTQSPIFNAVQAVITSVLGFWSLYAGNYLTFFVVNKATKGPADVQGNPPFKTVTTNCSGLENCAMDQTIYDKMKKLAEELQAAQQNSTTKANNLCALSGCAATQGQTPNSTVSNALNLAQQLMDLIANTKTAMMWKNIVISGVSNASGAIISTGYPTQYAVFNNIKAMIPILQQAVTLSQSNNTLSSKLQAQATGSQTNPEFAKDIYNLALNQKQVISYAKDIFNLFNSIPKEQYQYLEKAYLKIPNAGQTPTNPYRQVVNLNQEVQTIQNNVSYYGNRLDSALSVAKDVYNLKSNQKEIVAAYNGAKNLSQEISQLPYNQVNTKDIVTLPYDKNAPAAGQYNYQINQVQASNLSQALAAMSNNPFKKIGMISSQSNNGALNGLGVQVGYKQFFGESKRWGLRYYGFFDYNHGYIKSSFSNSSFNSSSDIWTYGAGSDLLVNFINDSVTRKNNKLSVGLFGGIQLAGTTWLNSQYVNLTALNNPYSAKVNTSNFQFLFNLGLRTNLATAKKEDSEHSAHHGIELGIKIPTINTNYYSFLGTKLEYRRLYSVYLNYVFAY

SEQ ID NO: 17760 - protein, 446 aa, Colwellia psychrerythraea
MRTFILLVAAVFLSVLAGNAFGVEHAEGSGFESPPGKVGASDADGKRTEKTQPGPGEGASEAQESKTEERRPHLPEIKEEVEEKKTFEIHGGLVGFYQGAAAGRIGGREIDPDSSSGFGVAADLQVTYRPPVPVFENGRFFMRVHAGTQKGADKNLEDNLFANLNTIADNSNELQRPFDKVFWLPEAYYAHEFAGGKLTVVAGKTEPVVFVDNNAFANNPNSQFVGKPFVNNPVFNSEDEFAPLAAVTYTPVESISVTALGVASSHPNAPWERDQKSIYSRIFDQPLVAAQLAYSPKFGELQGNYRVYYWNAGYHHENSAGDTSPDGWGVGVSCDQQLTEWLGLFARLAYSSRDAYDTDWFWSAGANLKGIVPSRDKDELGIGIAGLKGVVAPHNDGTELHAELYYRIYFNEYFALTPDVQYVANPLGDSRNDGVFAGMLRLEYSF

SEQ ID NO: 17761 - protein, 820 aa, Colwellia psychrerythraea
MQQFRFSLLAVACASAFLPGLLSANEQAQAPEKVQAAELKNKDIERITVYGRQNQVVMNSGLATKSNMSLMETPAAVVIVDEELINAQGVNNLQDLVRNISGVTQAGNNYGIGDNLVIRGLGANYTYDGMYGGAGLGNTFNPTRSLTNVESVEVLKGPATGLYGMGSAGGVINLIEKKPEFDSRHDIGVELGQWDSYALSIDSTGGLTDKLAYRVVAKTARSDGYRDIGTDRDEVYTSIKYVFDDSQDLMLSAAYIKDAIAVDSIGHPIRIYNAESVGGKTAGEASWQDLINDPEGKGIQLTDEQRQQLADSLSASDGLTPYAFGHAGIISPIAKDNAGEELRFKLTHNIFFNENLFLNQQLQYRDYSSGFTRQTGAYNYVYWDRRGTINADPRAPLLEDGVLYPFAARRQEYRKASADETSWQYFADLRYDFELAGIDNELLVNANFEDRDIRSKQYSIYDADKVIKNKAGDVIYQGQHPYIYDIRDPNWGEGSFEDYDPLLTSNYNKKVSAWGVGLQHVGYFGYGFTTRVGVAFNEIKQSYEHFGVDARYRASAADPTPRADSSDNGITYNLGVTYMPTDDLSFFVNHSKGRTAYSMLGGVKGDGSDRLDSESESDDLGMRFKAFDDQMLTSLVFFKSSRTNLQYSNPAYEEDVSGPNVPKNFYDGKEVTTGVELDMNAHLNEQWMINVNGVYQDARDKKDPNRSSYDTRQKGVPYVTASAWVTYGAEWFSLSSPVDISLGAKYVDDRSTNSSSFGILNGHVPSYTVFDSAISYQADNWKLQLNVNNLFNETYYNKAMFLGGMPGEERNAKLTFNYQL

SEQ ID NO: 17762 - protein, 424 aa, Colwellia psychrerythraea
MKLVKLSLVAALAAGAFSAANATPLEEAIKDVDVSGVLRYRYDTGNFDKNFVNNSNLNNSKQDHKYRAQVNFSAAIADNFKAFVQFDYNAADGGYGANGIKNDQKGLFVRQLYLTYTNEDVATSVIAGKQQLNLIWTDNAIDGLVGTGVKVVNNSIDGLTLAAFAVDSFMAAEQGADLLEHSNISTTSNQAPFKVDSVGNLYGAAAVGSYDLAGGQFNPQLWLAYWDQVAFFYAVDAAYSTTIFDGINWTLEGAYLGNSLDSELDDKTHANGNLFALKGSIEVNGWDASLGGLYYGDKEKASTVVIEDQGNLGSLLAGEEIFYTTGSRLNGDTGRNIFGYVTGGYTFNETVRVGADFVYGGTKTEAANHLGGGKKLEAVARVDYKYSPKLNFSAFYSYVNLDQGVNTNESADHSTVRLQALYKF

SEQ ID NO: 17763 - protein, 751 aa, Colwellia psychrerythraea
MNKTHPKPPASASAAQLLPTLGLLPVLAISAGVAGPAQAQDTVTLDTVVIRRQQGNEAETSYKVTESTSDKATAPLLDTPRTVTVVTGRQIEERGQTSVADVLRTTPGVTLGAGEGGVPQGVRPYIRGFEASQDMLVDGMRNASRTQYEAFNLESIEISKGPGGVYSGAGSTGGTISLNSKIPQPGAFDEVALSYGTGNYVRGTLDSNREFGAIGLRLNLMAQRADDLGGRDGVESRRVGVAPSFSYRLTDDSKITAGLYYYKDEDTPDYGVPMSNATTPAAWRRGSGTRIDPFLPVDVDPDTFYGLHARDFRDIESASGYVRFAHAFSDSLRLTTALRKARDTNTYVVTSPTSGSDGLVSRSSKASDRVNETVSFNAQLSGEARAWGVEHSFAVGVDIANSRATNRRLTVTNPDPMPTSPYENPNPGAPWGGSIERGGESGYSTTRSRGVYALDTITFTPQWEATVGLRWDDYSVDSITHATDTTPRESHGNDSDFLNGILGVVYKPVQNGSIYASASTSSNPAGEGAGTGGSNASDDLDSLDPERSVNYEIGTKWLVLNDQLELSAALFRTEKDNARVTNALGETENIGNTTAKGIELGFAGQVAERWGIWGGYVHQDVKLKDGGWSTPRGGGEPYPNPATGKQVAKVPRNSFSLWTTYDYSPQLTLGGGVTYTGKRTASYSQNGDADAALPSSWRTDLMAAYRLTEATALQLNVNNVFDRQIYTDSHVSQFANIEPGRNFVLTLKHAF

SEQ ID NO: 17764 - protein, 729 aa, Colwellia psychrerythraea
MSTKRLSSSGAKQGRTHVSGLAITIAAALGTLAMPAFSADTKEETLTVVGSSQPQQESAWGPVGTYVAKHSATGTKTDTPIEKTPQSISVVTREEMDMRQPETVKGALAYSPGVMVGNRGASTAYDAVNIRGFSSVGTNMYLDGLKLQDDNYSIYQIDPYFLERAEVLRGPSSVLYGKSNPGGVVALVSKRPTTESLREVQFKMGTDNLFQTGFDFGGAVDDDGVYSYRLTGLARDEDQQQVGEKSKRYAIAPSFSWRPDDRTSLTFLSSFQDDPDLGFYGWLPKEGTVQNGINGKLPTSFNDGEPGYNNISRKQQMVGYAFEHGFDDVWTVRQNLRYSKMDLDYRSIYGQGISPTNPAELTRGVMNSKEHLSSFAVDTQAQAKFATGVVDHTLLMGVDYMRMRNDVVYQYGTASPLNVVAPQYGNQNYTITGGASQVNRQEQTGLYVQDQAEWNQWVLTMGGRYDWSDTNSTNRLNQNSVSKQKDNEFTGRAGLNYVFENGIAPYVSYSESFEPTSGTDFSGNTFAASKGKQYEAGVKFAPKDRPITASMAIYQLTKTNNKVADPNPDHPFASVQGGEIRSRGVELEAKAALSANLNLLGSYTYTDAEYSKDTTLQGNTPAAIPKHMASLWADYTFHETAISGLTLGSGVRYVGSSYGDEANTFKVKDYTVVDAAIKYDLARFNLPGSSIGINVNNLFDKEYVSSCFATYGCYWGAERQVVATATFRF

SEQ ID NO: 17765 - protein, 408 aa, Colwellia psychrerythraea
MARFVVLVIDSFGVGAMKDVTLVRPQDAGANTCGHILSQLPHLQLPTLETLGLINALGYAPGDMQPSDSATWGVAELQHEGGDTFMGHQEILGTRPLPPLRMPFRDVIDRVEQALVSAGWQVERRGDDLQFLWVNQAVAIGDNLEADLGQVYNITANLSVISFDDAIKIGRIVREQVQVGRVITFGGLLTDSQRILDAAESKEGRFIGINAPRSGAYDNGFQVVHMGYGVDEKVQVPQKLYEAGVPTVLVGKVADIVNNPYGVSWQNLVDSQRIMDITLNEFNTHPTAFICTNIQETDLAGHAEDVARYAERLQVVDRNLARLVEAMQPDDCLVVMADHGNDPTIGHSHHTREVVPVLVYQQGMIATQLGVRTTLSDVGATVCEFFRAPPPQNGRSFLSSLRFAGDTL

SEQ ID NO: 17766 - protein, 672 aa, Colwellia psychrerythraea
MPNHRLALAIAAALSIPCAHAGIILAPITVTATKEAAMPATDQLTEHTPFQSPKADAGEALRLIPGISGSRMGQHGIDPIIRGQTADQLNVLIDGGYVFAACPNRMDPPTSFGSLVLYDRVVVEKGVQSLLHGPGGSGGTILFERDTAEMAAEPGVRGRLSFGANDNGLHGEAGLDMLISNGQGYVRVLGEALNAGNYEDGDDNEVPSSMKKRAITLIGGYRFDSHSGVEASVDRSRVTDARYAGAGMDSPEDELTAYRFKGWAEALNGPVNGVKAELWRSDVDHVMDNFSLREPADPMMLRRSPTTSRTTGGRLILSSRLDRAEVDYGVDVRRVDRDAVLLNALSGDLLFRTWPDARQDNVGVFTQADVQTGVFGLLRGGLRVDRHESSIDSDLEGQSIATATAPWVPEGTAEAADRTRRDTQMSALLRYEHALNGSLTAFTGLSRTIRQPDATELYFYRPHMTERLIGNPSLDAEKHHQLDLGVVSQGPRLSYEAALFYDRVDDFILRDNLGTTLSFRNVRATLWGAELGAGYRLHDDLILSGALSYVRGRNDSDGRDLPQIPPLNGHLGVEYQPAQWLVGARTRFADKQTHIDTQGGVDTIETPAWAVLDLYGAYRMNRQVEVRAGVDNLFDRHYAEHVNRNYSALFGDPSERIYEPGRTLWARVNVTF

SEQ ID NO: 17767 - protein, 1023 aa, Colwellia psychrerythraea
MKRYNKFIFILFVTAILSGIATSLEAQDKPKKKKTALIEVKGLVTDNTGKPLSGVTVLSGEGSIINYTDANGKFALKTKANGTLLIEAFGYKDVVINLAKEQPTVIKLQNEDLYASERDIHERADGGKTYQRDLVGTVSKLSMENVLKYPDLQLSNALQGQAAGLIAISGDGGLGYNTSTLYVRGQHNNGTNTALVIIDGIERPIDDILPEEIESIEVLKDATAKILYGAAATNGVVLVRTKREEAHKRIVRVGVEYGVQPSTRVPKYLDSYNYSKLFNEARINDGMNPYYTDTQLEGYRNSSGVNDVLYPNVDYYNEFLLNQNIYRKGTIEFNGGNEGVKYALVGGYTGGSGLEKVGERSALHRMNARGNLDIKITDFLTVTADVAARVELKNWGAKDGAGIFSTLSSNRPNEYPFIIPNETLSGQFTPNEDGTPFFGASTRIVDNLYADMVYGGDTSERYVNSQTNLGANFDFNKYVKGLTFNAYVTFDNYSYLRQELRNTYPTYAIDTYSDLDGETITRYTQMKKLDLPKTQKIASNNTYRYFGMRADIGYERTLGVHDFSAIGAFRYTKNEMTGMTQDFKDANISLRLNYSYDKRYLAELTLAGMGSNKFDKNDRFFFSPAVGASWIISNESFMKEVKAVNFLKLKASFGVLGYTGNTGFFLYQTGWNNNGNYNFFQDQTDHKVSLARWGNPDLTWEYSQEFNIGIEGLFFNNRLSTELNYFHECRKDIIGVNNAQYAATAGNYTMYENIGQVTNQGIDIAINWKGNIGRDFLYTVGANMTYSKNKLDKWNEIEGVESYRKAIGRPTSTIFGLQALGLFGKDIPLEDHSLQSYGIYQNGDIAYADLNNNGIVDDNDRMSLGQSFPVTTWGINVDLKYKGFGLYMLGTLHTGITQLCTNAYYWNNGLNGYSELALNRYHEVNNPSGTMPRLTTTTESNNFRDSSFWTENGSFFRLKNVELSYTFENKAGRFFANKCKLFVRGTNLLTFSKIKDLDPERLNAGITNYPAYMTVTGGLSVSF

SEQ ID NO: 17768 - protein, 786 aa, Colwellia psychrerythraea
MTFNKILMTSASAALILIAPSHAQEETQTETSATRESAIERVLGTVTVTATKKADVEDVQTVAVAMSAYNSDTLDALNVTTLESLSYSAPNVSLDDVGTARGTANFAIRGLGVNSSIPSIDPAVGVFVDGVYLGVNSGVVVDMFDLDSIEVLRGPQGLLFGRNTTGGAIVVNTANPTDEFSFKARTSIDGPVDSDRGGANTNVQAIVSGPLIENLLNGKFGVSYNTDDGYFKNSFNGDNHGELQSITYRGGLEFMPTDALTFLGKLEYTDSRSDGPSGKNHSWFDRDNFDMSINNPGFGESETILGSLRTDLDVGFGNGVITNIFGYRNYESTSSGDIDATPLTLFHSNAEFNQEQFSNELRYAGTFDKIDLTTGLYYFEQTLDYTEIRNLPSTRPAALPASIPWGFYGGGTLDHTVWGAFANVDYSLTEKLIATVGVRYSVEEKAGDVIYIRPRFPCSVVEGTCSADGFNSLIGLISPPGAPGEPNGFSDSDEWKNWTPKVGLQYFWNDNVQSYAHYTKGFRSGGYNFRITDLPIFNQFVAQTGSLGFDEEEVDSYEVGFKAQSVDGRIQVNGAAFMTEVGNMQREVNTAGASGVVQNIVNTADATIYGLEFDGRVALTDTLLGSFNVGFMDAGYDEVFFDLNADGIVDREDVNLDLPRVPPMTYGFGLIKDFDLGTSGAIVAQASYQHRDRIAYTDSNFGWIQDADMIDVNITWETPMEGLSASVYGKNLLDEVQIGNDTQLPFPGPNSVAGSPNTAYQTQIAGGTFSPLKKGRLLGLELTYVY

SEQ ID NO: 17769 - protein, 304 aa, Colwellia psychrerythraea
MKATSEELAIFVSVVESGSFSRAAEQLGQANSAVSRAVKKLEMKLGVSLLNRTTRQLSLTEEGERYFRRVQSILQEMAAAESEIMETRNTPRGLLRIDAATPVVLHFLMPLIKPFRERYPEVTLSLVSSETIINLIERKVDVAIRAGTLTDSSLRARPLFNSYRKIIASPDYISRYGKPETIDDLKQHICLGFTEPASLNTWPIARSDGQLHEVKYGLSSNSGETLKQLCLSGNGIACLSDYMIDKEIARGELVELMADKVLPVEMPFSAVYYSDRAVSTRIRAFIDFLSEHVKTAPGGAVREA

SEQ ID NO: 17770 - protein, 1911 aa, Colwellia psychrerythraea
MNILLKNLYRSCFERFCKRSNVLIEKRPFTLFFRWLLILPLLLCSNQLMAAKFTMSIYTGGGTPTVMTTADDGTTTLTATRSDGGNLAGVSSGFLDPSVMNGADTYTVTFNVPITISSIQIAEFTNNSTGNHYVLTPNVGTPFSIADNDGALAGSVTTHAPSNWIGVTSLTYSYSASGWRNGLDNLVFTVTAPPSITSANYDASTGVLAVTAPSMTTGDTIDVSKLTLTGRNDATHTLTSSNVTASSSSAFSVTLNAADKLAINGLLNQNGFDAINGTAYNLAAAANWNITKSAPADLTGNSITVSNVSAPTITSATYDSSTHVLTATGTNLVGLPGANNDISVSLLTLTAEGGATYTLTSPDVEATSSSSFFVTLNATDYGVVETIFNKNGTSSTSGTTYNLAAADDWNSEITGGNIADASNAITVSNVSLPSISSATYDASTGVLVVTGSGLVSKTGGTNDIDISKFTLSGDASSYSLTSSSVEITNGSSFSVPLNSTDKNELISRLNKNGTSSNGAVTYNIAAADDWNTGADPALNIADLTGNGITVSNAATIPGAPIIGSATSGDGQASVSFSAPVSNGGAAITAYTVTSSPGGFTATGTASPLTVTGLTNGTAYSFNVTATNLVGESSASSASNSVTPMGSQTITFANPGAQNFGTTPTLTATSSSGLVPVFTSSTAGVCSITSGGALTLVTAGTCTINANQGGNSAYLPAAQVSQSFTVNAVVASSPTIGTATAGDASASVSFSAPASNGGVAITAYTVTSSPGGLTATGAASPLTVTGLSNGTAYSFSVTATNSAGVSAASAASNSVTPQSANSAPVATNASVSLDEDTSLSISFTATDAEDDVLSFEVVTPPTSGKLVKHGSVWLYTPDADFNGDDSVRFIAKDAELSSTPGVVSIKVNPVNDEPKAVDDSISQSLSTDNSYTLAVLDNDTDVDGDTLTIDGAAADVGSVQIVSSQLKYQAPTGFVGPVALRYSISDGHKGRSNAKVQLLITGENSAGAPVITVPADITANATGLFTKLKLGVATAVDASGKKLAVSLVNTKQLFAPGEHVAYWQATDSQGRSAIKSQKVTVKPLISISRNQVVSEGSEAKVSVFLNGPSPQYPVSVPYTVSGSSDGNDHDLVDGVVEITSGLSASFSVNVFDDGVTEADEELVISLDSGLNLSGQRETRLLITEANIAPQASIVVTQSNEQRTQVSKAEGKVYIKAKSRDVNPQDSLTEVWSTGALVLDTDADGSYFDPSTLDAGSYPISLVVTDDGTPQLSTKVQLTLLVKDSLPVLTGADSDGDLIPDNQEGFADTDGDGIADYLDAINECNVLQEQASSQQTFLAESQSGVCLRLGNTAQLNGSQGIQVPDSALIKDTLADNLGGLFDFELTAIPRLGASVAVVIPQARPVPTNAVYRKFVRGNWQDFVLNTNNSVMSSAGNSGYCPPPGAAQWQPGLTEGHWCVQLSIEDGGPNDDDGIANGTIVDPGGVAVMLNNNSLPVAVADAVIVPVNQSTEVDVLANDTDADGDTLTVRQVSSQFGTAVVLDNQQISYTPAADFIGTDVLVYSISDGKGGTASSELTVTVVANRAPVAVDDMASTDDKTVLILNVLANDSDPDNQALSIIAASAEQGSVMIENNQLRYTPKTGFEGIDTVSYRISDGLDGEATANVMVSVKAYKAQVVDNQSGGSLGWAWVAALLMALMLRVSNRLNLRLKGKLLLAGLLSMAGVMQVQAAPSPWYLDASLSVSETDKTQMELQQEVTAGTISGFDNSDTGVGLSLGYQVTPLLAFELGYLDLGEGSAQISGESLDAGQYHELMKLVSPVLPQGVTVGARFTLMEHQGWRFSVPVGVFIWESELHSDSQGQRLTTKLDDTDWYAGMRFDYALAQHWSMGLGINYYALAPNDVLSYQLSVRYQF

SEQ ID NO: 17771 - protein, 711 aa, Colwellia psychrerythraea
MQPVPYPNAGQLPPDADPYANPNAPYQATRVQSNKFSEPLINTPKTITVLTKDVLEDKNATTLREIGRSTAGVTLGSGEGGNAFGDRFFIRGFDARSDVFIDGIRDPSVSIRENFFTEQVEILRGPASSYAGRGTAGGAINIVTKQAGDRNFYNAETTFGTDRTKRVTLDVNQVINPTLSMRAGGLFQDAGVAGRNYVEDNRWGGFAALKWTPTENVKVTANYVHTDLSGLPDFGIPYYRQGNVPVTEVGVPRGTWYGFVNRDYTKSTQDFGTVAAEVQVNDSLTLSSRVRAARSVLDYIGTLPQGPNTTDPDPLKWTVTASAQSRYQVTDVLANQNDATFKFNTGAWKHTAIFGAEFSQEKMSVDRYSGLTSEVGGSDPFTSSGALQNQSIFYPAYNQWPFTGSPTLVGNPLKPTINTKGVYLLDTANYNDVLILNGGIRYDDYDIHTQNNTASNSAHDGLFNYNVGAVLKPVPFASVYAAYATSSNPIGQEMDAGGADYGGLSPTLPTGQILGPERNKSAEVGTKWELFDKKLLVTAALFQTTKDNARETVSNVLQGGGAYRIQGIDLGVGGKITDRWSIFGGVVLMDSKVTKSAIANNIGLKLANVAHESFSLLSKYRFDNGWELGGQAIYRSKVYGGTLAASVGTELPSYWRFDTFLEKKIDKNVTVKLYAQNIFNKLYYDTLYRSAAPFVAVAPGRAVYVMTSVKF

SEQ ID NO: 17772 - protein, 572 aa, Colwellia psychrerythraea
MNFTKQFTCLSSLGITVLITAIVGGGNTEPIFAQSLNNLDNLSTQNNFPQRRRLGSTFTVNDNAKTSVSSLQATMGQATSVDQLRDVQPTAWAYEALQSLVERYGCIVGYPDRTFRGDAEGTLRARPLSRWEFAAGLNACMNVMERLIQENAMVLREDIDKLKLLAQQFEQELQAYNTRIGNLETRIAYLEDRQFSVTTKLTGDSIWVLSGVGGSEQADGPPDQPVQNGEVTVNFRQRINFNTSFSGEDNLLIRLQSANFFLARGGSNLTDFNFAATEEQGNVNINKMQYSFPVGDRARIWLAGNRITMDDIMDPLAPYTNSFTDGAVSFFGAIAPIYLPNDNSGPGAGFSYNFTDDLSLGGFYSAGKGFSPNQSEGLFNGQFGVGAQLNYVPAANTGVAFSYLHNYIPQGQYDSFSALGYTGLANTDNPFDDAASSTNHYAVIWTWQLADWFSLEGWGMYSDATAKSGDRQGDTADIWNWKVSLAFPDLGKEGNVGVVSVGQPPYASFISNNNNVPDITPATTDAPWFVETFYLYQFNDNISLTPAFWIGINPANGRDPLWVAALRTSFKF

SEQ ID NO: 17773 - protein, 616 aa, Colwellia psychrerythraea
MLTMRHAYVSLGLAGVLGLLAVVAQPASAEMPTTSVNDLSSPSLFGQRGRSTAQVNSVSELTDVDPNSWAFQALKSVVERYGCLEGYPDKTYRGNRPLTRYEFAAGLNACLEKVNELITASTANLATKEDLATLQRLQEEFRNELAALRGRVDALEAKTKEIESKLFSTTAKLDAEVIMAANIQGGDVNYNYVDGAGNSQGFGGQANANFITRTRLNIRANSLITRGDQLRVRLNGRAGESTPFTSRQGRVARVDYAESTGGPLDGRSAVDFDKVYYDFPLSLFGGTNNLRIRFGPRIENIDLLGRNKFTQNEGQQFSFRNFRKDPLLIQIQESSHPGAHIDLRFSRQFALRIFYAARDGGSAGGIADEPGNVPFGGSGLFGGSTQIAAEIGFQPTPSIDIGIGYSYVNVSSAGGSTGFIFGDASGSGGGDGRLRYDAGNVSNVGHNIFNAHVDWDILPQVAIFGRYTFANSNFYGYANGGANGVNVGGSLDSNTWMAGLAFPDLFGRGNALQVAYLQPIQISNNGVIAFPTEGSNPSDDPRGAQNVFEGSVNPITGVVSGLPFNRTGTEGNVAVAYRFRVSDRLSLTPEVLFVINPNNVNQNGLTVGNVRATFEF

SEQ ID NO: 17774 - protein, 1548 aa, Colwellia psychrerythraea
MKIKKLIMISLIVAATASYANERTDTIKKIDKIIDNAITKAIEADKTNPYLKQNRIKEIKGQILAAIKKDLDEPRLSRLDIPEILPKINKEIKKIGDGIGPKNNYKIIQVSKEVIQPIEKTAYEAFLRVVDEQNRLNGVKSNYWEKGNVKAQRLNDGVDLVPIAHVVDSQSESKRVEPYTGSKVHRSSTAIADLVEKGTGAFSKEYYSELPYQNSDQFYGKRFYFGAGNTVKDIVFLDKDKFSSKVNNSKNNQRYYIEGEYKLVTTNATDDERAKSFGAEKDVNPLDITMKEYRTRIEGKSKAEISSFLKEKMEQKNIKNVIQEGENLYTVDDKGRKWKVDWKLEPVSVESGSKEEYKDSIFTTIHYYSPFDDKSTSDNRGKLLYTNDGSIYAQDKNKYTDDVSLKLTETETKIITKIQKMVKLTKDKYGDTEELTEAQFNAKRSEYTDPNKYYYSYDEDEEIYYVNKITKIVKEFEATDTEKIKEFKEHAQNLIEENLDKEIKETVKTNKDVTKNLNEFIRVAKERAEKGEIPRNQFDQYFYDKKNLTKKDFENKWVKPFQDEKYKAAKENYERELAEATIKRDEAGKVRDKYGDIEKTLFDKINPNPFNLGVVVDRYDFHVGKDVTKPLITEAELEQFINSKPELNTEEKKKLVKDFYKTHKIWQENSDIYKKLNEEVANGIAKKYGFWDNDAATPEQRKYVGLNGLIKDLELTRSIAGKNIEFRGIGRIEGTVDLGEGKNKLTITEQITGKYGTNITLGAYAKLKNIDTVVVGKALTNDLSRVSLSGKTSLRMDIDTTKKNVEGHYYQHALKDSDPNIIFRSIYSETGNLDKRNDFMIELLTSKITENEAIIDMGRKIDYTWHNMETGTDYDMTIPFVSDSIAHQLINNKKLSKNGTSLLELKTREEIKRLNSDENAVYRSIRNANKLGLLAPTLTTSNKKTTFNTVDEEREAKKKKDLITYLKTKTDEELIKDLSQFNLSETEKKEALTLIKNLKESEDFKAILTKEKELQNRLGEIDKIEKDSNYQKLHFQEIFGKIETDFDNLSKKVYSLYPNEKDLEKQFQLELKRENSYTLVEKAVLLSDKIPELKTELNSIKNELKTKLNETRELLRKDLATIKELKAKYPNSKFGEIEKTIETILLGDNLERIVMSSRDYNKDSDLAALVSDFKKLASDISLQLKEKENIIKALEENDASVEQARYANYHRLKAKLFYTMREEEVLSELKNMLNQLSDRNIYSKLNKISKNEISTYTTIPFEISHALTDKKSIARGGFISNRTVQDNFKGNIYTAYGLYETTAESDTKYGILFGGANTKHNEVYQRSLTTVATESKIKGTSAYIGGYFNKPVVHNLNWITGMGTQYGRYKVEREMRNNYQDLHSEGKVNTTSLNTYSGLIINYPIQEDVFVQLKALMAYTMVKQSKINEKGDLPLDINKKTYHYLDGEAGISFNKIFYGEDLRSSISAGAYGILGITGYKNSDMEAKINGSSSSFGIKGDKVKKDAVKIHLDYNVQTDVGYTYGLEGTYITNSKENNVKIGIKGGYVF

SEQ ID NO: 17775 - protein, 1072 aa, Colwellia psychrerythraea
MFKKLLFLVTLLMAVAVGAQTTTSAISGVVNAGEQTLPGANVVAVHTPTGTTYGAITNFDGRFNLFNLRVGGPYTITVSYVGFQAQEYTGVTLNLGETYNVEVTLSEDSNALEEVVITGSRNNTFSDGRTGSATNVGERQLKALPTISRSAADFYRLEPSASSNGSFGGRNDQFNNFSLDGAVFNNPFGLDAATPGGQTGSQPISLDAIEQIQVTTAPYDVTLSGFTGASVNAVTKSGTNEFKGTVYGFYRNEDLTGGKVAGDDVFKADLSQNTYGISIGGPIIKNKLFFFANFEDESRSDLGAPWAPNRNTGAINESRVLPSDLDAVSAALSSITYADGSSYDPGRYEGFNFDAGSTKALFKLDWNVNDKNRVALVYNLLRSSKDNPANPNAIALRGPSQSTIQFENAGYAINNNIDSFQLEWNSEFAPNVSNKFQAGYTFFDDFREPFSTPAPSINITKGGQNYIIAGHEPFSIGNKLEQEVFQITNNLNIVSGDHTITLGTSFEKFSFYNSFNLTGYGFDLFGSVAIDQETDLDGDGIADTDYINDVTGETDLDAFQQFLIDRYQDTFTAAEAEFNENNGLPIGDPNGWSLAETNVGQFSLYAQDQWKMSEDFTLTLGMRFDKPLYFDTQDKIQENIDRKGTYQPDNVYVDPATGEDILLDSTVLPDNAFLWSPRLGFNWDVKGDKTFQVRGGTGVFTGRFPFVWLGNQVQGVDFFFYQTVDQDFKWPQVWRSNIGADYRFDNGIVLTADLSYTEDLNAAHVQNWALNDPSSTLEGVDNRPIYQTSDFATNQFGGPTNAYVFTNSNSGRTYNATFKAEKSFSNGLFASLAYNYLDSKDVNSIDAEITGDAFNANAIRGNANDDILANSRYGDQHRIIAVASKKFEYGDGKFATTVSAFGEWARGGRFNYTYAGDINGDGSNFNDLIYIPTADELAQQNFATPEQAQAFEQYIQQDDYLSENRGGYAERYGALAPWRSRVDFRLLQDYNFNVKGKKNTLQFSLDILNVGNLISSDWGLVEQPNSIQPVSVSVTDGVPTYTYNEELTQTFGTDASLLNRWQAQVGLRYIFN

SEQ ID NO: 17776 - protein, 789 aa, Colwellia psychrerythraea
MSLRSNIKHALCFPLLIDACYSADHTLGKVTTEAKRIFTYNNEFEVTSKELEQRQSNEVKDLFRTNPDVNVGGGSVMGQKIYVRGVEDRLLRVTVDGAAQNGNIFHHQGNTVIDPGMLKSIEVTKGSANASAGPGAIAGVIKMETKGAADFIPRGKSYAASGAVSFYTNFGDRETFRAAYQNTHFDIIAYYTHQNIFYYRSGATATKNLFKPTQADKEPGTPSEQNNALIKMNGYLSDRDILTFSWNMTRDNATRPLRSNAIGLAYPCEAPFSPDSSQGCPNVLDSFTRYLYHSTNTANNLSLQYKREAGHSFGDPRLDFTLYTSIRNAQFDPLFDPNGVYAKFPTSQATKWERENYPCIEGGYCTPSFSDIDKPSSQPRNLFLNNTGLNLKVAHVIDEATDSLFEYGFNYQNLSVFDARIPKSELYRPNQVYIDDEGQKQVACSLVDNNPNDPTLCQRGKANGNIYGGYVQANYSPHKIITFGAGVRWDAYTLYDKDWNHRYTQGFSPSTALVISPIEPLSLKITYSQVTRGVMPGDGVYMRQNDLRYAKNIKPEVGSNAEFNIDYSSQYFSGRAAAFYQALDNFISQYAQNLVVTNLSQAIRIYGYEVGGTFKYKGVSLNIGISRTWPTTRGYLMADSYELAASTGNVFIVKLDYTIPKTGINLAWLSRFVTGLDYCGFDIYLPDYGTAEKPKTPTDLAKCGSQLGLVHMHKPGYGVSNFYVNWSPRAKSRWNGLLLSAVFNNVFNKFYVDQTSPYVMSPDMPGTDAVKRAIAEPGFNARFEVAYKW

SEQ ID NO: 17777 - protein, 352 aa, Colwellia psychrerythraea
MKKTLLSVLLPAAFISNTVLAAEIYQAEDGSTVDLYSRLGFNITNKNNTHGDGKGEFDGRIGLSGSQTINEHASVIGMAQYQVGAAEYANQVNDKPALTARYVWAGIDAKEYGRITGGRVSSGLIMFTDIGDVFASSDVSMARQANKVDKTATQVFRQDGTLQYQNQFGNLDVSAAYILGNNTSELDYGYNAALRYTIDMGDFGRLAPVVAMQKNKGDAREGNDTDYTFWGVGTRYYLGDVMLGALYSEDELQGFYTQTSTDKVTELTAVYNLSDKWALRAGYRSLQNSGGDELELSDTTLEVQYKLTARSSIYTSYVDRNGERGYNSGQETSFGGAHADESYYHFGLRYEL

SEQ ID NO: 17778 - protein, 712 aa, Colwellia psychrerythraea
MTFSKRLQPFLGCTAIAIVATAVSIGPGTRIAMAQDATPSDEDAATTLAPIIITGEKFGRDQFTTFTSVEVFTGGELHDLVRPTLNDALNSSPNIRAFMSGRGNSDIVIRGLSSEGVTAPSRSNPVISVVVDGAEQGVEATRRGTRGLWDVEQVEVLRGPQSTLQGRNALAGSVIIKTKDPTYTPEASIEGLIGTDEYKSGAFAVSAPIVEDELAFRISGQIFRRDNDIDYVDPSISDVGEEEFEEIRGKLLWEPAEIPGLRGLFTVSRTHDKPAWALVSGPDFFARRFDDTTAERRDTYVNRYIADLTYEINEDWKIQSITSFVDTDVEITSPQTPTLQQFQLIRDDTREGGDFSQDIRLTYGSAESQFSGVFGLFAGRSTFDLDSNIRVVADPVTPFILPFQQLQAKNKSETTALYADTRYEFVDRWTLLAGGRLVHDKVSANYTGSLLDASTFGYVPLTENNSVSNTEFLPKIGLAFELDENQNLAATISKGYRPGYSELIIGTTDINTVRPESLWAYELAYRSKWLEDRLQVNGNVFYYDYTNQQVPIEFDPRFPAQTISLNAAESHSYGAEIEVRYGFDSGLELFSGLGLMKSKFDKGDFKGKEFPEAPSLTASFGGVYKHESGFFAGGDVSFTDGYYSKGDVKNVRALDSFTVVNANIGYEKDNLKITAFARNLFDEEYLTSISSNGNLATIGDGRSFGVRVNATF

SEQ ID NO: 17779 - protein, 179 aa, Pseudomonas syringae
MISLYSQQQFINCLILQEIFSASNSHINKKDLRPVGPNSYKTAIGKYTSKAYGFDGNVGYQFSIMDGINLMPNICIRYNTDKDNAYTETGTGVNNMYVAGKSGNLTTGIADIKLTDPTRLSNDTQIVPGLHASIVNSFSNKQPKVKARFIWADSYCEHTTSSSTQKVGYKCRCKFTDGS

SEQ ID NO: 17780 - protein, 679 aa, Pseudomonas syringae
MELPHSGHLNNQLYRKNVLAISVASIIGLPGLAIANTEITAMETYVVTGEKFDKDIKEVTTGVTVVTEDRLESGENNQAKDTATLAPNVVASSFSNISIRGISGGGAATGGLAYLTGARARVATVVDGVTQGFSGYNFNPITLWDVEQLEVLRGPQSTAQGSSAIGGALVVNTKDPTYLSEAAVRGGFENYENGNMKYNLGVMSSGALIEDELAYRIVIDGSTGEGWLNYDTNGFDTPNLSESDSVNVRGKLLWEPANIPDLTAKMTVNYQSNSGEHANFVSNTDEGIASKKMTLGGRSEVRIQDSKAGSIAVDLDYRINNGLTNSLLVSYVGSDIHEDAYSTGNTYDIDNKNYVVENRVLFDEVGADLTGVIGLYFSNKDATLLTSNFDLATEYETQTNAIYGEGTYSLSDKLRLVTGLRIENEDSDKTSSTAFSGGESSQDNSDTYYLPKLSVLYDIVSSTTIAATASKGYSPAGVGIDFFGNEYSYDSETVSSFELSSKSVFADSTILNANVFYNDYKDYQAAGAAFDVVNIDQSHTYGLELEGVTWIGEHLELRGTLGLLETNIDEDTTYKGKDLSDAPSSNIGFGFTQYLGESWAIGADAVYVGEYYSDLANTKDSTAGDYTLVDARASYTVGEFSVNAYIKNLTDESAVYYRAGSLAAVSPSRTIGLNVLYRM

SEQ ID NO: 17781 - protein, 454 aa, Pseudomonas syringae
MKKSTLALAVALGAIAQQAGAAGFVEDSKATLGLRNFYINTDNRNGTGANKNEEWGQGFDLRFISGYTQGTVGFGVDAIGLLGVRLDSGGGTNGATKPSGANPGSYGGTIFPSEHNGKAVNDYSSLGLTAKAKISQTELKLGTLQPKLPVIITNDGRLLPQTFQGGQITTNDIKDLTLVGGQIEKAKGRNSSNNENLSLSGANSRGATWRDSNKFIYAGGDYKITKDLTAQYYYGNLEDFYKQHFLGLTHNWAIGPGVLKSDLRYFNSSDDGANGNESAYFTTGNYQGFRAGKGKVDNNLYSGLFLYTVAGHTFGGGYQVSNGSRDFPWLNQGDGSSAYLTTDMQIQKFARAGERTWQARYAYDFAKVGVPGLTAGVVYLKGSDIDTVANTASRTQFNGQSEWERDITVAYVIPEGPLKNLGVAWKNAMWRTDIAGARDQDENRLIVSYSIPLL

SEQ ID NO: 17782 - protein, 832 aa, Pseudomonas syringae
MRIAGTKRILFLCRQNNKRQRMNKSKLLAFALALLSIGNVCAEEVDTLKIVDVEEVLIIAAPKENRKLRELPNAVTLLSQQDMQAAQVNSIKNLTALVPNIFIPDYGSRLTSAVYIRGIGSRINTPSVGLYVDNIPYIDKSAFDFNYSDIERIDVLRGPQGTLYGRNAMGGLIKVHTKSPFSYQGTDFRIGAGTHNQYNTSVTHYHRMNERFAFSAGGFYEYEGGFFRNAALNNKKVDKGQSAGGRIRAIYLPSDNWKLDFNVSYEYGDQGGYPYGLYNKETGDVAKTAYNDESSYYRNLLNAGLNVEYQAQNFTLSAVTGYQHLKDRMFLDQDFTASDTYTLEQKQRINTISEEIVMKSKENRRWQWATGIFGFYQWLNTTAPVTFKEDGMAMMDQMLGSVIPSKIEVPMGPTSSMNIMPSLKIASTRLPINGDFETPLLNGALFHQSTFRDVFGLGGLSFTAGLRLDYEKMKMDYNSGTAMDYTVGITGQMVQNGQVIRDIPMMPETALTVESRYEGSISKDYLQLLPKFALQYDFKKNTGNVYVTVSKGYRSGGYNIQMFSDLLQSSLRNDMMKQSKEEIMPHVPDAYKALVEGHFPDAGVNPDAKAATVYKPEQTWNYEAGTHLNLFQNRLRADAALFWLETRDQQISRFAQSGLGRETVNAGKSRSLGAEISLAGAVTTNFTLTANYGYTYATFKEYVTNAKSADNKVIEISYNGNYVPFVPKHTLSLGGQYIFRINPGHWLDRIQLNANYTGAGRIYWTEQNDVSQAFYGTLNGRLSLQKGNGQIDFWVRNALDKDYAAFYFESMGNGFMQKGRPIQAGIELRCRF

SEQ ID NO: 17783 - protein, 768 aa, Pseudomonas syringae
MNNRSILRAPRFPVTRLALLVSLNSLCLISPFIQADDEVPTSATVPASDDSAAMTLGTVSVIGQGETRQVQRVTQKDVKAYSAGTSPMKVLQRLPGVNFQSGDPLGREEGSQRISLRGFDMHHLGYTLDGVTLGNMSFGNFNGLSITRAIIAENIASSEVAPGIGSLGTASNSDLGGTIQFTSSNPDKEFGARLSQTLGSYDTSRTFMRVDTGEYNGLSAYVSGEKYDADAWKGHNNPQKSDAVNAKVNYNFGDNRVSFFHSTSSHDEANLPNLSKSIIQRLGYNWSYYTPDWTRAVNAANGIYSGGVTSANDATYNASSLRDDELDILNGNFSLTDDLVLDATVYHHHDSGRGNSYYPFVYTSGSTTVPSNSIRSTKYGIDRTGFQSSLTYYLGQHEIQGGFWIQSNKNDISRYLFDTTNATPQNHIVKTDGLPLAATVLDQSYNDLTRQFYLRDTYTLLDDRLKLEFGAKNTVTTSTAEGKGGGYASGSLQARDRFLPQAGATYKLDEDDEVFTSYSENMAAFPSGGYSPFFTTQSAVDAQNGFKDLKPETSKTVELGVRRSTRLYSASAAIYNTKFDNRLVAITNCTGIVICQNGVANVGSVTSRGLELSFGLTPNENWRWSNSMSYNHSTYDDDYASGGNTVHVKGKTVVDTPKLMYSSNLDWNWEHWNAGLQGSYISKRYYTYTNDSSVSGYWLANANLGYDFGKLGALKDTTLSLNMVNLFDKRYISTLNTDASAATDPAGNLQILQVGTPRSAFVTLGVKL

SEQ ID NO: 17784 - protein, 228 aa, Pseudomonas syringae
MNKHLLRASLAALALTAPLAANAYEKGDFIVRAGAAHVQPNEDSGEVRLDGAKVSGTKSTLDGDTQLGLTFAYMLTNHIGIELLAATPFNHTVSVKGLGPGLDGKLADVKHLPPTLSLQYYPMEPSSRFQPYAGVGINYTTFFDNDLTSDRKSQGFSNLKLKDSVGLAAQLGMDYMITDNVLVNASVWYVDINTEATVDGPSALAVGQTKVDVDIDPWVYMVGVGYKF

SEQ ID NO: 17785 - protein, 353 aa, Pseudomonas syringae
MKTTSMALAAAALATAGTAAAQSNVTLYGIMDAGIEYVNHAGPNGGGATRLVSGGKNTSRWGLRGSEDLGGGLKGIFNLESGIAIDTGRLDTDNTLFDRRAVVGLAGSFGQVVFGRTFTTTYDFMLPYDPMGYAPNYSWATSSTATGDRKDGLFSRASNAVRYDGTFGGLKLGATVGFGEVAGNFKASSKYDVGIGYSAGGFSAAATWDRQNGAGTSTTPADTTDYIQGIHAGASYDFGALKLFAGYRNYKRAFTTAAAAQRSDMYWAGASYDFTPAFTLFGAVYKQNIKGGTDADPILFSLRAQYALSKRTTAYLAGGYAKARNGQNVSLSRDVVGFGNSQVGVTAGLQHRF

SEQ ID NO: 17786 - protein, 703 aa, Pseudomonas syringae
MPLSSYRPTPSLLFLAVSLGLSSTAAAAPQATTLDAVQVTAAADASAQAREALKRVPGASNLIDVAKADSRLSTSADVLAYQPGISAQSPGNEGTKISIRGSGINRGPGAHASGIAVSIDGLPLTGPGGTPYELLEPLWLSRVEVLRGANGFERGALALGGAIDYVSRSGRDSAGVQLHYEAGSRGYQKRGISWGGVSGDVDYFLAYTDTEFDGYQRHARGDGKGAMANVGWQIAPDLQTRFFVRYRETNHETPGRLTRDQIRNDPRAANAANLAIDARRPQPGSTWVGNVTTLQIDEDSSLQAGLVYHKYPMDLNESLYRQQLDYANLNATLDYRRRHRLFGLDSETTVGLRVTHDLDADVRESLRFASNGYAAGTRTRDFRHHGTDSTLHVGNTLTFNDRLRMQTGLALINTRRDVQVTWPSSGGRLRDHDWDYAPRLGFTWQHSAQTQWFGNLSRSVEAPHPWSMIWGSNQYFGPGNGPSSDRQRAPVPMQNQTATTLELGARGDAALGRWELTGYYAHVNHELLSVELQPVPNLFIAENNASPTVHRGMEAGLDSTLWQAAPGRLSLRQAYTFSDFRYRHDARFGSNRLPGLPRHAYQAELRFDHASGLYAALNTEYASRIAVDYANSYWADSHVIFGSRIGYDAPGGRWQAWAEMRNLGNRHYAATVTPGYDDAGRDVARSTPGEGRGIYAGVRLRFD

SEQ ID NO: 17787 - protein, 447 aa, Pseudomonas syringae
MRVMKWSAIALAVTAASAQMATAAPFVSDQADAKGFVEGSTLDLKLRNYYFNRDNKNGNSDLRDWTQGIWANFSSGYTQGTIGVGVEAFGYGGLRLWGLDKYSGSGNLVTDSNGDNEATQGKLGGAVKFRISKTELKVGDMQPTSPVFGVGGSRLLPQTASGLSLQSSEIAGLDLEAGHFYSGTSQDDTSHNGSIWATYAGVPANSADFAGGKYAITDGLGVAFYAAKLEDIWDQYYGNVNYALPLGNDQSLAFDANIYRTVDEGSAKAGSISNTTFSGSAAYSFLAAHTVTLAFQKVNGDTPFDYIGIGDNNRGGDSIFLNNSVQYSDFNGPGEKSWQVRYDLNMEPYGVPGLSFMTRYIKGTDIDGTNVAADSPYRKNDLARSPLYGADGEHHETNLEAKYVVQSGPAKNLSFRARQAWHRANADQGEGDVNEFRLIVDYPISIL

SEQ ID NO: 17788 - protein, 758 aa, Pseudomonas syringae
MKIMTKIAGAGVVLIGLQGLAYGEEKQERKSDKVMKFGSLKVSGSQDDAEVRAMERPGSYSSKGEDTKLQSTDSILRSMPGTYTQIDPGQGTVSVNIRGLSGFGRVNMMVDGVSQSFYGTSPTSPAHGTTYNQFGTIIDPNFIVGVDVNRGQSDGSSSVNALVGSANFRTIGVDDVIFAGNSLGVRTKTAYGNNGIGYNGMIAVAGKTPAFSSEGSIGAMLAVSGHSIDAHYKNGDGVLSDEFVTDKSFKQKPNSQLMKIKIEPNEFHDMELSGRNYHNKFTRRHIDSRDIYLKYNYTPFSEWVDIKLLVSTSESRQRYEGDSLFKLLNSNAKNKSDAIDISNISRFDYGDTNFELTFGSKLMETEYSRTTNSVYSGRGKDEKEKQEYNKKDSEVKENNVFAPSGKQDIASIYGGLKINRGIYQADITFNYMDYRVKGYKPACDLRIPCFPQGATELDLKEHGFNPGILLSAEIIPEFQPFVSYARSMRAPNIQETFYSNEGGGSMNPFLKGESSDTYQIGFNSFRPDLIVKGDTFRLKAAWYHTKVKNYILSDIWLICGNRKKCKADSSTDYNEVDPNIKMYIYHNSLTPVKIHGYEIAADYDAGMFYSKLAYSWQKTRQPTSAATAHFGAEPLSQLPDSFMTLDTGVCLFNEKFRVGAIVKYTGDSHRLDPDQYNFDEDGRVVQQKEPKIPTIVDLYSDYQINHNVLLKFSVQNLANKNYSEALNRANSSPLMTEQTSAMQTARGRTYIVGAEIRF

SEQ ID NO: 17789 - protein, 701 aa, Pseudomonas syringae
MSSRKKASLLGLTLGLLGDPAFADEPQTLELDAISVISDYESPAGPVKGYRATRSSSATKTDTAIRDIPQAISVVPASVLKDLGSTSVERALDFAGGVSKQNNFGGLTLYEYSVRGFTTSEFYQDGFSANRGYPSTPDAANIERIEVLKGPAASLYGRGDPGGTVNIVTKKPQPAAFTTLQTSAGSWDRYRTALDVNTPLDDQGDVLSRINLAVEDNNSFRDHVDSKRVFVAPSFSWQLNPDTSLLVESEFVRHSSTFDRGIVAPNNKWSGVSRSTFLGEPNDGNIDNHNNRLQATLEHHLNDAWKLRLVSHYKEGKLWGFASENRPLNADGHTVNRRYRERDTNWHDSITQLELRGLFDLGTWQHELLIGSEYENFRKNERVTTIAGGPYAIDIYNPVYGQPKPNGARSGTDFFEHVESHALNLQDQIVFSEKLRGMIGARFEHFEQTIDDHSRNTTSRQTHDALTQRAGLLYQLTPDTGLFANASTSFKPNNGLDVAGKSFDPEEGVGYEIGIKNELFDERLSSTLAFFHIDKENVLALDPGTDTSRAMGKARSRGFDLQVTGQVTDAVRVIGAFAWIDAEVTKGDAAIPAGSRILGVAKRSGSLLGVYEFQDGRLRGSDIGAAFTYVGDRSGESGSDFELPAYHTVDLLAHYKASDTVTLGLNLNNLFDEKYYERSYSNYWVNPGEPRNFTVSLTFNL

SEQ ID NO: 17790 - protein, 843 aa, Pseudomonas syringae
MCARTRNTILLFLLSISFTYAQNPNNNKTLSSILTALEKKYDIKFSFSDVDIENIFIAEPPKKITKEELLVLLNKKTQLQFTALGDRYVTISFLNKMVAICGTILDADLSQPLLLASIKVNGFQIGTTSDAMGTFYLKEVPIKSTVSISFVGYKTKQITAKELFSNTTCAPLFLIEKVEELSEITMPRLLTSGLQKKADGSIVLNTEKFGILPGLIAPDILKTIKILPGIESVNENISNINVRGGTSDQNLMLWDGIKMYHSGHFFGLISAYNPYLTKKVSVTKNGTSSAFSDGVSATVNMETNDKITNILSGGAGFNLLSSDAFVEVPIKKDLAIHVSARRSFTDLVNTPTYANYFSRSFQDNSISSNTVNNTESNFYFYDYSFKLLYDIGDNHKIRANFIHIKNSLEYVEQYNENALTIEENSTLKQENLGGKIGWNANWNSKFSTNFSAFFSNYKINSSDYNKDTDQFQTQFNNVLETAIRMHAKYELSEAFFFSNGFVFNEIGIKNTTTVNAPTFSKKIKNILLKSALYSEIEYNKKNTYIRFGIRANYFDKFKKLIIEPRIAFRQEINAALSLSLEGEFKNQTTAQKIDFEDNFLGIEKRRWILSDNKNTPIIKSKQASVGIEYNQNSFFIDLTGFYKKVSGITAANQGFYNNTQNLNSIGNYEVKGIEFLINKQTEKFSTWFTYTYSKNQYAFDVFNPRVFTNSLDLSHSLSTAFNYDLHKNLKISFGGILRSGKPYTKPIVGNETIQNGNRTIVNYDSPNKERLANFIRLDLSASYHLPFFKNLEATLRIGFTNITNQKNILDSYYIVDTTNENNVSRINNFSLPFTPDLSFRVQF

SEQ ID NO: 17791 - protein, 200 aa, Pseudomonas syringae
MHTPNRSLRLLSCALALACGTMAAHAQAGRATGNSFIPATQQGYIGLNAGQSKYDLRNGTSPFDFDDSDTGWKLYTGGFFHPNVGVEFGYLNFGKATRLGGDTKAQGLNFSLVGRAPISEQFDIFGKLGTTYGRTKTSGNPGFGVATGDDSGFGLSYGAGVRWAFNPQWAAVLEWERHRLHFADGKSDVDMTTIGVQYRY

SEQ ID NO: 17792 - protein, 711 aa, Pseudomonas syringae
MRRTLVSLCVIQAISQAAWADQVTAGQPSSDSIELQNIDIQGAASAENAQGPVDGYRATRSASATRTDTSLHETPQSVSVVTREAVEDIGATRLQDALDYAGGVGRANNFGGQGLTTFTVRGFTTGEFYRNGFPINRGYPNMPDANTIERLEVLRGPATTLYGRGDPGGTFNVVSKQPLAERKVTLGSQLNDQGMKRGTLDASGPLDDEGRFAYRLNVVGEGGDTFRDHVETERYGVAPVLSWQVNDATRITFEGDFMRNNAPLDRGLTRYPAQTRTASRDTFFGEKSVGKLHNDNNMAQLRFDHDLNADWKLGGGVQMLDGSLQGDAIEANGLAADGSTLGRNFNYRKLEWTDRDVQLNLTGHFSAGGFEHTLLTGVEYEDYDYKSIIQRSSGAVSAYPIDIFNPVYGQARPALTRTTTHDKENLKTWAAFVQDQVTLTERLKLVGGVRLERFEHDYDSFLPGTSSWTASDNAVTPRVGLSCDLTDTVAVYANTARSFKPNSGASRLGGGFKPEEGKSYEIGTKWETLEGQLSVDAAIYQIEKRNVLTTDPVDSTFSVAAGEVRSRGLDLNVVGNLTPEWRMMGSYAYVDAEVTKDNTLRSGTRLMNIPEQTFSLLNVYEFQDGALRGLGLGAGGRYVDQRAGRTANVAFSMDSYTVFDLLAFYKVNPNVKLNLDLKNVFNTEYEEGAFGNVYAYPGAPRTVQVGIAYTL

SEQ ID NO: 17793 - protein, 299 aa, Pseudomonas syringae
MKKPIVTALAAVALSAGAHAETKFYGKFNVSTAYNDSTEEFNMDSHASRLGIKGSDDLGFATLVYKAEYQHNVDEGGLKARGTYVGLKYEGLGTVKLGKMDTPLKKSQGKFDLFNDIYDIKRNLLGENRDNNSINYTSEKLGNLTVSASAILEEGSDGYSVSGVFEKGNIYASVAYDKDVPDSEDVAKLDSVLRATAIVTQGDIRLGAIVNYAEEGNFDDTGFAFNAALTKGLHTFKAQFGTAEQAIDDQGGINEVQTLSIGVDRKLAKTTTAYFYADSEEQNDADAVNELRIGLVHKF

SEQ ID NO: 17794 - protein, 1096 aa, Pseudomonas syringae
MHRRGSQDLLQAVRQASAGMPAKTVAVSHVARTAVGSCTPPEDTSMRRTLKSFKSKAMFTFVGGLLVINPAFAQHTTPQAPPPQSSSDAATTLDTVNVTGIRSSLDQSMGIKRDAAGVVDAISAEDIGKFPDTNLAESLQRITGISIERRDGEGAQVTARGFGPQFNTVTLNGRLIPGADAFGAPGQTPIGGVDVGTRAFNFAQLASEAITGIEVYKTSRATAPSGGIGATINIQTDKPFNHSGVVANAGAKMVSDRSQPFGDSLTPEVSGIFSYTNPDKTFGIGLSASYQKRHGGSVQATENTWNIQRWTGTDPALRPDAVVTNAPAIGQLYGMPNDLRYAFADFQRERMNGQAVMQFAPTDSLTLTLDYTYSSNEIREERGEQGIWLQRANSFTDLTFDTGQAVATPVYLRDVPSGAKDFGMEQQRNEQKYTLGSLGFNADWQVSDRFQLSFDAHNSKTKSLPNDPVTGGSATYFSLAGTNNCASGPLCGGQWGQELWFNNSLPIGARTWYPTAADSLAGTNGVVNPDFTAGNLGSQVLRIYYQSQVTEIKEGRVDGTFDFDDGRFQFGVSSANTKMNRLTSDTNSTLGDWSVANAGNEPGMVALLQPVSITGMFKDFNANGAAPSAWRGDADQLALWGGSQYGATTRYNPQYSADNQVEEKTRAAYVQLELQGDIAGMTTNTRLGLRYERTDVESVSQVATPTGLLWQSNNDFQLVRSAELQPFSEKTSYNYILPNLDFSIDITDQLKGRASFGQTIARAPYNNLIAGPTPNTPNGSILINPSNRAGGDSQNPQLDPLESDNLDLALEWYFADASYVSATFWNKRVSNFIGNTVSRESLYGLTDPTSGPDAQAALAFLQSGACAAQVGASGNDVAAACSANDTSLFAAMALLRNAAATGGLGAYNGSSAQSLALENAYDITGNSSDPLYQFDVSRPINQNKANIHGWELGGQYFFGSSGFGIYANYTIVEGDVGFDNTVIDRDQFALLGLSDTANAMLMYEKYGFSARLAWNWRDEYLIAANQDNSNRNPYYVEAYQQWDLSVSYAFSKQLSIGFEAINLTGEDVRWHGRSDKQIIRLIDQQPRYTLGVRYAF

SEQ ID NO: 17795 - protein, 742 aa, Pseudomonas syringae
MSSRQFPAARPVHRQPVPSRLRATVFIARVAVIAGLPLGAFAQTAQTAQTAQTAQTTQTAQTAQSAPEQALPTVTVSAAQEIDVGPHLDKPMTSGALGSRKQLDTPFSTTVITGDDLAERQVTKLGDVFFTDASVSDNSNANNAWASYLTVRGLQLDWQNGFKINGMPFVSYGITLPYEQLEQVELLKGASGFMYGFGNPGGTVNYITKKPTDVFTASAELGYRSSHLWSEHVDVGGRAGPDNMFGYRLNLTHEEGKPSNAVGLNRNSISLGLDARITRDLTWTFDGIYQDRSTFGQTPTFTTYSLAPGSQLPGVVSGRGGLFAGPDQHFYSNLQFYSTGLRYNLNTDWTVSTIYSFSKQSRSRNESSLSLIDSNGDYTDLRYDGAEGHQFNQWTTMVEGRFRTGPFSHQFVGGVTWQNQVNRYSSNPVSLSLDPGNLSQPYTGVYYSQVAFNKYRASDITQKALFMSDTIQLTERWSVLGGLRFTNYEQNSYGTDGTRTTHYDKTGLLTPTVALMFKPMPSTTLYASYVEAFDGGTTVGTTFANAGAQLNPVKSKQYEIGAKTDQGLWTGTAALFRIERGAEYTNSQNVLVQDGLSIYQGAELAGAARIGSQWEVGGSAMYLDSYYDKGQTYNGNRVAGAPSFILTGRLAYRIPYVPGLKVGIDGKYTGTTKLRPAGDLTLGGYTIFNLGATYSTRVAGKELTLRAALTNLTNKRYWGFQYAEYIQPGDPRAISVSAKISY

SEQ ID NO: 17796 - protein, 680 aa, Pseudomonas syringae
MRRLRNTTADMLACLPLWLAVTGAALPVLAVPALVQAQDTQDAAEGAVVQLDTIVVTASGHAQTLPDAPATVTVIDGEEITSKPYATVADVLRNVPGVIVSAPSGRSGAETISIRGLGESYVLTLVDGKPIGNSQEATYNGFGSELAMSYLPPPSAIERIEVIRGPMSSLYGSAASGGVINIITKPVSDVWSGSLTLGTSHYKHGGAGDANEGRFYLSGPLLQDRLGLALFGSRHDRSKDEMAVSGRGGSVSYQSQDIERKSLGARLTWRIDERQDLDFETVYSAQDTTSAPLDGGTPGGISLKRMNYALSHDIRWGDDYRTETFLTFEDVDFENGSNVSGYEMLNLNTRTSMSLGRHDLTFGADWRDETTRHDPSRVNVDPKMTRWQWALFAEDNFHLRDDLTLTLGMRYDHNERYGSQITPRLYAVWHANPSLTLKGGVSGGYKTPTLKQADSNIFEPSGGDGRARDQGNTDLKPEESTNYELGAIWETAGGVQLGLTAYHTRFKNKITTEQICAHDTPVPGLPTDCGMNTPTDPIKWINQYVNRDAAELNGVEATVDFTLRNVDVSFNYTYADSKITKGADVGAAFNNSPLHVANLGLDWQATDALSLWSNIQYRSATTDSGSGYIREHAIVDLGADYRFNDNVMGSLAIYNVDDKTFDNTGYNDGRRFYMGLTSTF

SEQ ID NO: 17797 - protein, 1167 aa, Pseudomonas syringae
MALNSIHISLRRLLAAWIAVTGLMAAEHHGTVKFGGLPVPGASVTVTKDDKKHVTTTDENGQYAFNDLADGVWHIDIEMMGFAKLTNEIGIAFDAPPAEWTLKFLPMSEIKAPAAAAPVTSTATPAPAAPAPTPAATPAATPNKPAATTTAVAPAAPKPAANANGARGQQGGRGQGANNGRPSLLAGNNGFQRVDVNSSGDAAAAPDAGIPAGDMADMSSSADPSLMVNGSVSRGLDQPQQNDWFGGPGGRDGMGMGMGGPGGMLGMNGPGGGDAAGGGVAQMGGRGGPGGGPGGGRGGPGGGGFGGGPGGGFAGGFGGRGGRGGPGGPGGRGPANRPGVASFGNGRRDRRMQYNGNAAFTLDNSVWDARSYSINGQDTAKPAYAKARANMTFGGPLKIPKLLSGQKGQFNINYSLGRTRNGTTSTNTVPTLLERSGDFSQSIGAQGPVTIFDPLTGNPFPGNVIPQNRMNSASLGLLKYYPLPNSPGYKYNYQAPITTIQNSDNLNARLNQTLNTKNRINGGIGYMGSNNTTPNIYNFVDTGTARNINTNVAWGHNFSTRLINNLRYTFSRSRNSGIPFFAYQQNVAAELGILGTSQAPQNWGPPNLSFTNYTALTDGTSSLTRNQTSAVGDSLIWVHGVHNMTFGADYRRQQINRASDPNARGQYTFTGLSTASLANGVPVSGTGFDFASFLLGAPDTSALRYGNSNLYFRTHAYDVYATDDWRLSQKLSINFGLRWDYASPITELYNKLVDLDVAPGYAAIAQVLPGQVAPYSGALPASLVRPDRNNISPRIGFAWRPIPKHSMVIRGGYGTYYNTSVYNTMANNMAQQPPYAQSFSVSNSPLNPLTMQTGFLAPVTNSLTNTYAVDPNYLIGYAQMWQIAIQNDLGHSLVGTITYNGTKGTHLDQTILPNSAPSGAKANGLPSGYLFEQSNGNSIYQGVSAQLQRRFRNGISANAVYTYSKALDNAVQAQNYLDTAAERARSNTNRTHVLNFNWQYSTGVGRTGATMVNGWKGALVKDWTFTNSISLSSGLPLTPTVGGIRSTTTGTGITGSLRASATGLPVNDAPAGEPFNFAAFTLPAAGEWGNAGRNTITGPVQFGLNASLGRVFRIGERKSIDLRFDATNALNHVTFRSFNTTIGSNNLGLLAGASNMRSMLATLRFRF

SEQ ID NO: 17798 - protein, 922 aa, Pseudomonas syringae
MIMKYHHFRYSTIASAVLFALSHSYSAAAENEKMTENSDVAVLDEVIVTESRYAHERQNEVTGLGKVVKNYSEMSKNQILGIRDLTRYDPGISVVEQGRGASSGYAIRGVDKNRVAMLVDGLPQAQHYNTLGSSANGGAINEIEYENIRSIELSKGASSAEYGSGALGGAISFRSKDAQDVIKDGQQWGLDTKTAYTSKNSHFLQSIAAAGEANGFEALVIATHRNGKETKTHSEANKLHHNIQRITGFENRYDLYPGSAQNAPGGSFFIVEDACPTLDCTPRATVKLNRDNFPLRKAPEYTSEERKQIEQIPYRTEQLSAKEYTGKERIAPNPLDYKSNSVFVKLGYHFNSSHYLGAVLEDTKQRYDIRDMQTPAYYTKDDVNIKLDNLWSKNPVYEGNNILDGLVFDRSIPYGLRYSRVKFFDEHHHKRRLGFNYQYKPENNRWLDSFKLIADKQNIELYSRMHRLHCSDYPNVDKNCRPSLDKAWSMYQTERNNYQEKHRLIRLEFDKAFTAGQGIFKQTHKMNFSLGFDRFNSLMNHGDMYAQYTKGGYINIRGRGRLDDPYIYRRLPRSIETVSLCDNKHGGILNCEPRKIKGDSRFVSFRDLITSEYVDLGLGVRFDQHRFKSDDLWTLSRTYRNWSWNGGITLKPSDFIALSYRISNGFRVPAFYELYGKRTHIGLIDNEYVQNEQRNHRLEPEKSMNHEIGVSFKGQFGYIDVSHFRNNYRNMIATACKKLTHKKSECFYNYHNIQDVVLNGVNLIAKFDLHGILSLIPDGFYSSVAYNRVKVKDRKLTDQRLTSVNDPILDAIQPARYVFGFGYDHPEEKWGIGITTTYSRAKKAEEVSGTRHHGIHRVDLGGKLTNSWYTHDITGYLNYKNYTLRGGIYNVTNRKYSTWESVRQSSVNAVNQDQGSNYTRFA

SEQ ID NO: 17799 - protein, 802 aa, Pseudomonas syringae
MSAVSSYRLRPLLHFSLLLTLSSSPLFISTSWADTAGRRAYEVPAGSLSAALTRFAGQAGVNLSVDPALVNGRNSSGLSGEFAVEEGFARLLQGSGLQLIPVGEQAYTLIPAPQSASAGLQLAPTSIVGDSGVTDGQDYAGGQVARKGSQGMLGSRDFMETPFSMTTYTKDAVKNQQARTLGDLIASDPSVRATNPAGGRYEQFTIRGFSLFNSDVSYNGLYGILPTYTIDMEMAERVDILKGPSQLINGISPRGSVGGGINVVPKRATDKPITELTTSYASKGQVGAAVDVARRFGEDDKFGIRFNGVKQSGDTEWDHQSVDRDMAVLGLDFRGDRLRLSTDIGHTERDTDAPQERVQVGANAKVPNANDVRDNYAQSWSKARTKDTFGAVNAEYDLSDSVMLYGGVGVRKSNHDFLRHAVSVTNDAGDFSVQPRDFTRDENVRTATAGARSWFNTGPVSHEVNLAASYFYMDFENGGARYAAAPSNLYNPVDTPTPSNPTRADSKVYTENRFSGVALTDTLGFFEDRLLLTLGARWQRVKVDDWTDDVKGDTAYDEEKVSPSGGILYKVTDDFSVYANYMEGLSQGKVAPSTSVNEDQIFPPFVSRQVEVGAKYDLGSFAFTASVFRIKQPAYETNTASRVFGPNGKRRNDGVELTMFGEPMKGFRLLGGVMYIDSELTNTVNGTFDGNRAPATPKYNVNLGAEWDVPGVNGLTLTGRGIYTGSQYLDQANSKSIDSSERFDVGARYAFKVDQKDITLRANVENVMNKYYWSSAGASDDSEPGLTLSTPRTYLLSATIGF

SEQ ID NO: 17800 - protein, 675 aa, Pseudomonas syringae
MERGRAGALPAHRTHRSHGGVRRHVRGGGAQHAVHERRRPHRHRPLPEVAAGERSRRTGVRLRRQGEQGAVPRRRQQDRRGALHRQLRRLPPYRRPGLRAGVPGAGRQPGGQRRRRHLADPHRAQGRHPAGDPSGALGFHHAAVQLAPDRPAGRRRGELHPHQLGQPGAGGERRTGRAPARGAGCAAPGADPRSSRASAAALKRLPGVRPDARSASLPDGFGSDRRTFFPPHDYPPPRRGRLELFSSRGTSQLNNRNDSSLSGSRACALTLAFAGLFPGTPVLAGFLEDSQGTLTLRNFYIHRNFVEDGATRSKAEEWTQSFILDLRSGYTEGPIGFGIDILGLRSVKLDGGKGTGGTQLLPVGKDGKPADDFGRLAVAGKLRFSKTEAKLGEWSPALPILRSDDGRSLPQTFQGGMFTAKEVRNLTLYGGRFRGNSPRDDSSLEDMSWVGNASVTSDRFSFAGAEYAFNDNRTQIGAWFGQLEDIYKQRYFQVLHSQPLGKDWTLGANLGYFDGEEDGSAQAGDLDNSLLTGMFSLKHGAHVFYLGLQRVGGDDRWLRVNGTSGGTAANDSYNGSFDNARERSWQVRYDCNFTALGIPGLTLMTRYIKGHNVHAGGIDDGEEWNRETELAYAVQSGPLKNLTLRWRNSTVRRDWGADNKFDDNRLIVGYPMSLF

SEQ ID NO: 17801 - protein, 1072 aa, Pseudomonas syringae
MRANSKTSTKAEVPIQNTVSGTIVDSFGVPLPGANVVVQGTTRGTQTDFDGNFSIEADGDDVLVVSYLGYVTQNVPVNGRSTVNVTMAEDSQALDEVIVTGYTTETKRETTAAVSIVKAEELAAIPSGNVEQQLAGRVAGVTVVTNGQPGTASQIRVRGFGAFGGNEPLYVVDGVPINDISFLNPDDIETTTVLKDAAAASIYGARAANGVIVYTTKPGRRNQKTEININIQSGVTDPNVAGSPEMLNPQQMAEYTHIAYRNNAAATGTTPQYTHPQYGSNATPTFPDYLHADGQNGVSESDIDLAQIRANYEADPENVFLIRPNLRGTNWYKEITRLAPATRISVGFRGGNENGRFYAGLGMQSLDGVLLENEQDRFTARFNSEFDLTPWLVIGENFQATYNSVRGQTGGNGGLGIANDESEILSAYRMPTIIPVFDEFGSYASTRAAGFNNPRNPVRRLAQDRGNDDAFSVNLFGNLYAALTPIEGLTLRTSIGGQYNSFTNRDYNYRYLGDSEPQASFSFNEGMEYGFQWIWTNTINYDQLFGKHRVKVLAGIEAIEGASTPVTPARGRRIQGSGINPFSTDLDYVNLQTVTSPVVQSFIRKGVNFSSIFGKLDYNFDEKYYVTGVIRRDGSSVFGENNRYGTFPAVSGAWRVIAEPFMENQSIFQDLKIRGGWGQMGNSNNVNPANQYSLAALDIGNTIYPIDGQNSGANEGFATSRIGNPDAKWETSTTINVGFDATILNNHVDIILDWWKKDTEDLLFQVPLPAVTGAYAAAPSRNVGAMLNQGVDFQIIGRGNLTEDLYFTVTLNNSFLKNEVVRFAEGIEFLDGPGYRGIFPTRNQVGRPLSSYFGYQVTGYFNSQAEVDAAPTQDGAGVGRFRYADINGDGVITPDDRTYLGDPVPEYSGGAVINLRYKQLSLDTFWNWVSGVEIFNMSKWFRDFFGTFEGSAKGVAALNSWTPELGNNAAAPIWESASNLSTSGAANSWYVEDGDYIRLQRIALMYSFDDEVLNSLGLKRLEFGVSANNVWTITKYSGLDPVVGGDADTTFGIDVGNYPVTPSYLFNLNIGL

SEQ ID NO: 17802 - protein, 344 aa, Pseudomonas syringae
MKLKNTLGLAIGTIVAATSFGALAQGQGAVEIEGFAKKEYYDSDRNFKNDGNLFGGSVGYFLTDDVELRLGYDEVHNVRSDSGKNIKGANTALDALYHFNNPGDMLRPYLSAGFSDQSIGQDARGGRDGSTFANIGGGAKLYFTDNFYARAGVEAQYNIDQGNTEWAPSVGIGVNFGGGSKKVEAAPAPVAEVCSDSDNDGVCDNVDKCPDTPANVTVDADGCPAVAEVVRVELDVKFDFDKSVVKPSSYGDIKNLADFMQQYPQTSTTVEGHTDSVGPDAYNQKLSERRANAVKQVLVNQYGVGASRVNSVGYGESRPVADNATESGRAVNRRVEAEVEAQAQ

SEQ ID NO: 17803 - protein, 746 aa, Pseudomonas syringae
MHNPSRLTPLSKALMLSQMFRSRPSMAAMGLALCMPVAGQAQETVADDSNTTGTVNLAPTAIDSHYLGTTTDGTGSYTTGAVSIGKGAPQSLRETPQSVSVVTRQVMDDNNLTSLSDVLEDTPGITFQYRNFGGHVYTSRGFSLLAESFLVDGIGGQGYQITGWMQPDVAIYDRVEVLRGASGLLVGAGQPGGAVNLVRKRPTADNKFSITTRAGSWDQYRVDLDGSGKLNDSGTLRGRMVAAYDDSGSYLDGRDSRTPLLYGIVEADLSDDTTLTMSLRRQEQVINGYSIYGLPRYSNGQSLGLSRSTNLAQKWNRHESDMTEVFTEVAHRFNEDWTSRTSLTYSQGGFDQNIAFARGAVNPVTLAGSNFQGTLFRKDEVDSVGLNSQLEGNFNAFGLEHQVTLGADWSKQEANTHQVTLTRRTAINIFDVDQNAFAKPARPAWQTDIDTTEERAGLYANTRIHLSEPLSVVLGTRLSWYDYKYDVKTGLAKDYESKQTQEFTPFAGVIYDINNSWSWYASYADIFTPQANYVTAGGSPLDPAIGSNYETGFKGELFDKRMNLSMALFYIKQKDVAAVDIAAQDNLTTCPTSSDGSCYLQDGISRSKGVDVEASGEVLPGLQVFGGYTYNMLRNNGDSDVAYETPKHMLRLNTSYNLPGAWNRLTLGAGVSADSGYEVPYDKALGVAGRAIWDARASWKLDENWKVSLNAENLFDRKYYTTSIATDRSNVYGEPRSYVLTLRGDF

SEQ ID NO: 17804 - protein, 691 aa, Pseudomonas syringae
MPTPCLTPIALGLSMLLSAGFACATTVLPETSINAEADEDDPRVKETNTATRTATSVRYVPQAIDSVKTDNLRSYGTNDLGQALSGIPNVSSGADTRFDSLRIRGFDASNDFYLDGIRDDSQYVRDLHNIERIEVLKGPAAVLYGRGGQGGIVNRVSKLPTPGHKSSIEAQGGSNGFAQLVCRLERRPSDTISLRLNMGNQDNNSFRDGVSGNRQLFAPSMSWQLTPDLNWLVQYEYSRYNRTPDRGIPGVNGRPADVSRSTTYFDHGDYIDDKSQSLRSKLAYELNANWQLRHTLGVFKLDSDFDNTYQTGYDAKTNSVSRQHWQQDLTTRNVFNNLELEGGFDTFGLEHRLLTGIELGSQRRDPKLYSARDARTVPSLDLNQPNRRLSHTGSMRLSSYNHTEVESSALYVQDQLRLNDQWQLLGGLRYDRFEVDTTSKVLNTQENVKSHSTSPRVGLVWTPLEHHSFYASWSKTFSPAGGGLIGITPNAAGNVNDLSPELTRQKEIGVKSDWFDDRLSTTLAVYELELYNRRTSDPLDRTITLLTGEQRSRGVELTATGKIIDNWYVRGGIGLQDAKVEKDNNGFEGKRISDVAKRNASVFITWKPEMGWYAETGLTLVGDRYADNLNTVVLPGYGRWDALAGFRQKEWDVRAALNNIADKNYYASATSAAQIQPGEPRSLVVTGTYSL

SEQ ID NO: 17805 - protein, 739 aa, Pseudomonas syringae
MLRPFTPRVSRAGIALLLAGTVAPPAFAQQAAPSPTQSAVELPTVSVQAVSPAEELVLPDIARLNLKNETGTLVGLTPFETPAAIDIVTQQQMQDRGLRTLTEVYNSVPGVMSGNLPGEPGVTSIRGFSRGAVGYMLDGMQVPDPLMVSRNYDSFSFDRVEVLKGPASVISGNGALAGTINLVTKQPILGQNTGQALLSYGSFDTLRVGGDYNVALGQNAAVRASALYSQSNGYITDTGSETAAITLGATVALSDRLTTTTSVDYFHDDYQTPYQGTPLIARSAALSPSSVVSAPGGMVIDRALWNRNYNVLNGEMKSDAVWARNRTEYELTDTWTLRNDLNYYTADRRWANSEDFTYNPATRLLDRTTTLITHDQQVWSDQLSARYDGMIANMRHRFAIGADYIHTNFDSERRFGTTTPVNPYFPNRGYFPVDTSANFSTRQNYDSQVDQAAVFAEDAINITSNWLVVGGIRYEAIQLDRQIYNLNTLSTSSFGNNYESVTWRLGTVYNITPGTALFAQYNQATVPVTTLLLSNLANASFELSTGNSIEAGIKSTFWDNRAVATASVYQIEQYNILTRDPANPSLTVQGGSMRSRGAEAELAVAITDQLKLTANASYINAEFTQLWSAGSNLAGNRPPNVPEWTYFLMADYKLPTLPMTLSASVQYVSSFYTDNANTIEVAGHTVLDAWASYEIGRGTLRLRGRNLTNAFYADWSGYSSSQVFLGAPRSVELSYAAKF

SEQ ID NO: 17806 - protein, 722 aa, Pseudomonas syringae
MPGQQSQSRFLFTPALLTMGIWIATSHAAYGAETQATEASSATTMELGATQISSDQLGSTTEDSQSYTTGPMQTATKLPLTIRETPQAVTVVTRQRMDDQAMTSINDVVKYTPGLFLDQSSGPGRQTYTSRGFDIDNIMYDGLPASYSGYTAGVHPNLAMFDHVEVIRGATGLATGSGNPSAAVNMMRKRPTAVPQVTLTGTVGSWDDYRGVFDASGPLNDSRTVRGRIVGSYQDANSFRDKEKSDHGVFYGVVEADLNDATTATLGLSRQEDQTNYFWGGLPLDTDGHHLNLPRSTYSGSDWENKKIRIDTVFGELEHRFDNDWKLRVAGSSSSLDGLFSGTYLSRYNGPLETTAYQSKPEEQQTAFDVYASGPVEAFGRTHEVVVGTSRRVYDKTSKEYSPYDTGLPIGAPKPDFVRDGKTHSIATQDAIYLTTRLSLADPLTLILGGRLDWYDYDDRSGDEDYKVTRSLTRYAGLIYKLDEHHSLYTSYTDVFQPQSAQSLSGKVLDPVVGENYEVGIKGEYFNGTLNASLAVFRIDQKNLKTESPTQAGCAVLTCYDAAGLVRSQGIEMELQGALTENWQVGAGYTYARTHYLKDTDPANKNQQFNTDTPEHLFKVSTVYRLQGALEKMRVGGNVYWQSRMYNDIALTDGSYRLEQGSYAVADLMAGYQVSKNLDLQLNANNIFDRTYYTAIGASSVWGSTDVYGNPRSYALTAKYSF

SEQ ID NO: 17807 - protein, 724 aa, Pseudomonas syringae
MSTPYRPAMHHAWRLLPLGMAVASPLLAAEPLNLDAVNVTGFSEQESASDYRAGRASIYGLDQALLLDTPASVSVFSEALIKDRQAKLLSDVLRNDASVGEGYAPVGYYENFVVRGFSLNAANSYRINGRSIAGEQNVALENKQQVELLKGLSGLQSGVSEPGGVINYQTKRAQDVRSVTVSSNEHGERYIATDVGGWFGSEQQFGLRANLAHEDIRSYVEHADGQRDFASLAFDWNISERALLQLDVEYQNKEQRSVPGYQLLGGTTLPHDASPRKLLGYQNWSNPVGIESLNMSGRFEYRFTDSWKGSLSASRSRVVIDDYSAFAWGCYGSASCATEAVPNHFSAEGGYDIYDFRSPDDTRRNDEVEAAMSGTFATGALEHQLTFGTSAYRRTVDTRGTFNEFVGSGNINESPEPVAPSSLPLTHTERRLDSRQYGLFVSDRISFNDRWQAVLGGREVRLDERAFNEDGSDARHTERYVFLPQAALIYKPLDNISLYTSYSKGLSLGGTAAWFTTNASEILAPTVSRQLEAGIKYDWQRMSLTAALFQARQAYQYSRPNDDGTFTYVQQGEQKNTGLELGARGWLTDRLQISASAAAIRARVEGSGTEAYEDHQALNVPKYRATLQADYSLPIRGLALLGGMQYSASKYADRTGSVQVNDYALFNLGSRYSTKVGGYDTVLRLTVDNLFDKRYWRDAGEYLGDDYLFMGAPRTASLSASVNF

SEQ ID NO: 17808 - protein, 319 aa, Pseudomonas syringae
MPQPPFTRPAMPSRFLMPLLFAAAAALPCTSVLAAPATAEDSAQGEALSPPASPKEGKGAYFSDWFNQDLTLIGSKDISFGPKPNDDIYLEYEYFGRKGPFELYGYVDVPKILGIGNDNDKGVWDHGSPLFMEHEPRISIDYLAGRSLAVGPFKEWYVAFDWIYDHGSNTANRANTLYSGLGTDIDTHSRVNLSANFYGRYQWENYGASNEYSWDGYRAQLKYIVPISTFDNGASLTYIGFTNFDFGSDLKNDPARTGNSTVATNVLLYAFTHLRFTLVGRYFHNGGNWQDGSELNFGDGNFRARSDGWGYYAGVGYQF

SEQ ID NO: 17809 - protein, 453 aa, Pseudomonas syringae
MKKINKGKSLSRFQLVSTLSVLGAMGLAGNVHAAEAFAADSPWMTGDWNGKRTELLDKGYDFSLEYVSEMASNLKGGSNDDTTGRYSDQFALGMKVDLQKVLGWQDAEFKLAITERSGRNISNDRIGDPRAGTLSSSQEVWGRGQTWRLTQMWVKQKYFDGALDVKAGRFGPGEDFNSFPCDFQNLSFCGSQVGNYVNTWYNWPISQWALRVKYNITPEVYAQVGVYEQNPSNLETGNGFKLSGSGTKGMILPVELVWTPTVNSLPGEYRVGYYKSTPNADDVYEDVNGQPQAATGAAFKSHDSKHGWWVVAQQQLTSHNGDASRGLSIFANATVHDKETNFVDNYQQIGLTYKGPFNSRPKDDIGVGIARIHVNDDVQDRVRLANQISGINDFDNPGYLPVQSTEYNSEIYYGFHVTNWLTVRPNLQFIKHPGGVDQVDDAIVAGIKIQSKF

SEQ ID NO: 17810 - protein, 787 aa, Pseudomonas syringae
MSSTFAARPSRGRLALACATAFAWPAAHAASTDDARAEAARGGGADRSAIATPASAGVAASATPAGDTLSAVSVTAQRQPVDPDTPAVVTSITREQIDAHTNVTTEDALKYAPNLMVRKRYIGDRNSIFAGRDFNELQSARGLVYADGVLLSNLLGSSYAYPPRWSLIPPDDIARVDVLYGPFSALYPGNSIGSTVLLTTRRPEQLEASLSTQFFTQRYHDGYGFADSLGGNHQTARIANRVGRFWFALSLDRLENNGQPMQYASPASAYNPRLGAAVPVTGAATDIGPNGKPRTIVGAQTIERTEQLNETVRMGYAFTDHVDATLTLGHWENHYRQHGETFLRDATGNPVYGGNVSIGGQNMTVAPNAFAPQRGDQENWLYALGLNGRLDSGWRLSGVVSAYDVSRDVLRAASTVQGGAGTLFQGDGTGWRTLDLKAEAPEVKGHTFTFGYHYDNYFLRNVTYNTADWLAGPTTSLASVYRGDTRTQALFGQDAWRFAPGWLATLGLRYERWDAYGGALGNAKGTLGYADRSANALSPKVALQWDATEVWRFRLSFATGTRFPTVGELFQGTISNNAIVNNNPNLRPEKAIDWDFTAERDVGVGVVRASVFQSDLRDSIYSQTTASGATTVTNISNVDRVRVRGVELAFSGENVGLRGLNLDANVSASNAQILADAANPAYVGSRFPRIPRMRANLLASYRFDEHWLASVGVRYSGRQYNTLDNSDVNPDVYGGTSSFTVVDLKARYRFDRHWTASAGIDNLTDRRYYTFHPYPGRTFYGELKWSL

SEQ ID NO: 17811 - protein, 1064 aa, Pseudomonas syringae
MAPTGETPPRAPGAERKRRRPSPFLVIQPALRNRGRMLLCATAIAATPALASAQTAAPATTATPTHHHKTTTRHTTAKAKTVTPTRAAPAAVAPAAAIPPAGVPATTSSARNASIIAGAANATSAPDNAPAAENVIVTGTLFRDPNLASASPITEVTRKDMAARGLKTVTDALQVLSANGAGNLTNSFSAYGAFAGGASAPSLRGMSTDSTLVLMDGQRLSYYPLADDGERNFVDTNWMPSSIMDRVDVMQDGGSATYGADAVAGVVNYITRKQIKGFEGNAEGGLSQRGDAGHQKLYATYGWGDLDRDGWNFYLNSEYQQDDALYNRQLGYPYNTGDLSGLAGGYNGNTNAPGSTINNFGATPTAVVSPIGFTPTSTGGSIPSNTGPWQLLNPSAGCTGAGVIGKVSGSVSGAPGVSTTCTQNAVGAYKQIQPELRRINATAHFIANVTPRSQFVTMFNYSQVQSSYNANPPYSTLASTPYLTATAQNTYLPSTSPYNPYGQAAQVLATYGGLQPFTTEFSQNFRGSMRYSGWAPSKWGSNWNYDINFVGMNTVLQQVDTGFPTISGIENSITSGSYNFANPSANSKSELNSIAPRNVLNARTQEYSEDMHVSKGLFKLPGGMVNVAIGGNIRWESVNDPNANPQTANPANEWAGINPFSAKGSRWVESGYFEVGLPIIKMLNADISGRYDNYSTGMHHFSPKVGVNFKPVKQFALRGTFSRGFRVPSFAETSGSVLGFTGYTPNSSIPGIAAWQATHGNDGYATNPYSIGVNTVGNPNLKPEISTNFTGGAVISPLDWLHLSADYYYIKKTNYIMANPYVNPVAAANDYILGEALPSGILSATPSIADIQAPGAKASPGIFTDQYMNARSYMTNGVDLSIDATRHLPGPLHDVLWFSKGTATYVHASNLTLPDGSVYHYAGTIGPYEQVSASGTPRWKASWSNTFSWKGLGVTPTVYYTSGYKTTAEDQNGANTNTCAYTLSGYGATGAPSTQCHVKNWWDVDLTVNYQINPRWSVYANVYNLLGFRSPYDYATYGSYLYNSSWTQKGIIMRSFQFGVNVRL

SEQ ID NO: 17812 - protein, 140 aa, Pseudomonas syringae
TGESTMTYRLGVQFDWDKTWLQSDIGRLTGYWDGAYTYWDGKDYKDNHSLSFSPVLVYEFGNGNVKPYLEAGIGVSVFSNTQVEDRKFGSAFNFEDRIGFGLRFAGGHEVGIRATHYSNAGIKEPNDGIESYALHYKMPF

SEQ ID NO: 17813 - protein, 749 aa, Pseudomonas syringae
MTSHQFFAQDQLFTRKRISPALLAALVSVAFMPSAQAQQADPSLPAIQVSPAAKKPNHRLPKRNKRVDAKPRVQQAAPPIAWSPAAMNAASPNPEASRTAEVGGIAGASSTVITAQDIARAPGQTVQDILATQPGIQLRSLFGGVNGAGTSVDMRGFGAFSTANTLILVNGRRLNDVDLAGVDLSTIPLQSIERIEITRGNSGAVLYGDNAVGGVINIVTKAGAGGPPLSGRVEAGIGSLGQRFGSVSSTTNTGPWSTSVFATAIHSDGYRANNKLDAQAGSGELRYNTPDLKAFFSVSGDNQHLGLPGALSTRYYLDNANQLAANRRASFMPFDHGDTQGINVTAGFTKALSNDIDLIVDAGVRDKRQQASYFDDPRAPYPRAVDTVLQTWSVTPRLNIRTPVFGMPSSILTGIDYYNASYDSDRSQLLGLPAIHAYDLNQQTLAGYWQQTIDLFPGTVFSYGGRLQNTRLNAKDTLNPSAPGASIYDMQHLPLKNDETQHALHIGIEQRLSPNFSVFARAARAFRTPNVDERIGVALDSNFNANFNLKTQTSYDVEGGIKVHGNGFDLQSSYFDMHLKNEIHFDPVFFVNYNLDPTHRYGSETSMTLHVNDSLRLKGGFTYMRAVFEQGQYAGNDVPLVSRFTGSAGISWNVWQKYVVFDATLRAWSKRRMDNDQANFQPEIPANATLDLKLSGEYQRYFWSFSVLNAFNAQYYDYAVASASLANVGVFSAYPLPGRTYMLKVGATF

SEQ ID NO: 17814 - protein, 736 aa, Pseudomonas syringae
MVQDSPRIPELIARKHSRTEQMIKMNKAQPLLLGVSLLAIAATGAFAQERNDPRQTFMGAVVLDTVTIEGFENPSAPLDGTVAHSSATTKTRRPILETQSSVSVVPRKQMDEQGATNLSDALGYSAGIITENYGNDPRFDSLYLRGFNLENDKFLDGLRLMRSTQFPTSAPAFELYGLERVEVLRGPASVLYGAGTPAGLVNMIQKRAQADGDFTELGFSLDSKGSASVYGDANRVVDDRFAYRVTSKGGNARTDVEEIDNLRGYLGLSASYALSEATELEFMASYHGDAPISPTGVPSGLVGLVDAKDLREFYFGDESINDSDRKMGTLSFGLTHDFGNGWRLNNTLRYTDFDWDYDSVYISGLTGTSVGRGVITQRENFRAIATDLRLAGSAETGAVSHELTFGLDAQKLRERAYTGFSTIAPIDYTAPSYGGITVPAPWYTANKSVDATQVGLYALDEIEYGNWRATAGLRYEWTRQKGQSVTNFGTTDYARDDQQLTGHLGLGYLWDNGVSVYAAYSTSYLPQPNFDIDGNPLKPTHGKQFELGAKYEPAAFDGLFTAALYELRETDRNTTVTEEIGGRPITGTRQIGEARIRGLELEGVAEFGQGWSVKGAYTYASTEISGDNGGNELANTPRHAASLWLSHEFQSGPMQGLQLGGGVRYIGSRWASDANTQRLEAVTLLDLGASYEWGNGLVGRLNINNVTDETYISAVGLNSSYYGDGRTVQASLSRKW

SEQ ID NO: 17815 - protein, 747 aa, Pseudomonas syringae
MNPLAAALTGTVAAFAMQSAGAQENQPAAELAAASKPVTLQSVTVTSTKDDGYKVDEAQSSKFTAPLLDTPKSVTVVPAEVLQQTGSNSLQDALRTTPGITFGAGEGGNPIGDRPFIRGFDSMSSIYVDGVRDTASQTRDMFNIDRVEVIKGPSSAFGGKGSAGGMINLVSKLPTAENFVQGSVGVGTDSYFRATADGNYLLNDNTAVRLNAMGQSFDVPGRNEVDQHSWGFAPSVTFGLSSPTQVTLSYYHLQGDGMPDYSIPYARPSSQATKANPSAPASVDRNNFYGLTDRDFQRTQSDIATASVQHDFRNGLVFRNTTRWGRATNDYVVTNPDDSRGNVPRGFVWRNTKNRDSATETLTNQTDLTSEFHTGSLKHNLLFGFEFSRDNTDNNPYNVVSANAAASGGTCNASLLASFDCAPLGNPNPNDPWRGSITKMPYTQTTTTNTQSVYLFDTIEITKQWLVNGGIRYDNYDTHSFTNAYTNPNTGAAVAQVDIRNQSHFFNYQAGVVYKPVEYGSIYVSYGTSSTPPGSTNGDGADNITAAQRNLEPETARSFEIGTKWDLLSRRLSLTGAIFQIEKNNARVAIDANTTVNAGKQRVKGFELGFAGNLTDKWGVFGGYTHLDSELIDNGPQAANAANNGNQFPNTPKSSFSLWTTYQVLAPLTIGAGAYYVDKVYANPANSLYVPSYWRFDLMGAYRVNKNLTLQLNIQNLFDKTYYTKAHTHYGALAPGRFGMLTANFRF

SEQ ID NO: 17816 - protein, 640 aa, Pseudomonas syringae
MTKTSRRWPFAACLLSLACGTAAAAPYSTMVVFGDSLADAGQFPDTAGPRGSTLRFTNRVGPTYQDGSGEVFNLNSSTLIGRMLGVPAGDLAASTSPVNAALGAPDGNNWAVGGYRTDQILDSINSQSTVVDPNTGTLLRSRTGYLPANGFRADPNALYYLTGGGNDFLQGRVLSASSAAQAANQLADSAQALQQAGARYIMVWLLPDIGKTPALSGSPLASATSALSAGFNQQLVSRLAQINAQIIPLNVPLLINEVLAEPARFGFDPNENLVSTCFSGNSCRESTTNGRSSATPNPNRLFFNDRVHPTEAGQRLLADYAYSLLSAPWEISLLPEMANGTLRMHQDEIRAQWLSDWGNWQGIGQWQSMLSAGGQKMDFDAQDSSADADGRGYNLTIGGSYRFAENWRTGVVAGAYRQSLEAGPRDSDYKLNSYIATAFLQYQANHWWGDLAVSGGKLDYENAERKFALGVSEGQEKGDTDGEMWAVSGRVGFDIAGPTSRWHLSPFVSADYAHINVDGYSEKGDRSTALTFSDQTRKSRRAGVGVQGKFQVTPSTQVWGEVAHEREFETDQQDVTMALNSVQSVGFTLQGYTPQRDLNRATLGVSQKLTQDLTLRGNYNWRKNDDVTQQGVNVALSLSF

SEQ ID NO: 17817 - protein, 1079 aa, Pseudomonas syringae
MRCNAFVEAWKNHHRRASMILGLSLLAAPLSYAVYAEDGVSNTMVQVVTQTKTVKGTIIDESGEPLIGVSIVVKGTSTGTITDFNGNFSIDLPAGRKELVISYIGYKEQTVTVTGNGPVNVKMVSDTQALDEVVVVGYGTMKKRDLTGAITSVKSEDVVMNPSSNPMQALQGKVAGLDITRESGQAGSGVKMQLRGNRSFQKDSGNPLFIIDGMPGDYSTLNPNDIESIEVLKDASSTAIYGSSGANGVILITTKGGKEGKAIVNFNAYVGVNGWSRTPEMRSGESYIQTLRDASVGAGDGRWSSVADDKNLFTTDAEWNAHQNGQYIDWVDALLKTSVTQNYSVSVAGGTEKTKAYFSLNFSNEDGQFAQDSYKLYSSKIRVDHKIKKWMKVGIDAQLSYVHQNKADSDLQTLMASNPLGSLYNEDGSINPQPVADPSSTVYNYLLNEDKSLYRNQAQNLKVYFNPYLEITPLKGLTFITRAGANLGYSRSNTFTGEGSVQWYKANQTADGIKAQVKDNRSYNYKWENILTYNFQIKKVHDITLTAVTSWNHNRSDVTTLYQKGVSDNKFLWHNILDGNSSTSGSTSYSMSKGMGYVGRLNYSYMGRYLFAASVRHDGSSRLAEGNKWDTFPAFSLGWRISDEKFMESTTNWLSNLKIRFGYGVTGSTAGIDPYSSAASLDATAVNMILGGVLTPIYKFSQNIPNYLLTWEKSYNTNIGIDAAFLNNRIDVSMEYYNTKTKDVIWNKALPVINGAFSPDGGPKANYTTNLNMCETSNKGFELALNTRNIITKNFTWSSSVTFNHNKEKITKLSGGDSDVLNNGDTGYALALGEAINSYYHYKLDGVWQKGEETDAAVFGAAPGDLKINIPNLVKESDGRFYKIDEETGSAAVDENGNVIYYTSDNKYTPSDADYQILGHNSPDWSLGFQNNFTWKDFDLSVFVYARYGQMFAYDMLTSYDPKGIRNFPTYFNYWTENNPSNDFPAANANKGLEQYTGYYALRYVDGSFIKIKNITLGYSLPKSILKSAGIEKCRFYATITNPFVFAKSHLLKDYDPEMNGSLKYPLTKQFVFGVNVTF

SEQ ID NO: 17818 - protein, 428 aa, Pseudomonas syringae
MLNKRISLIALGMLSATSAMANDQAESKGFVEDSSLKVLLRNAYINRDYKDGNQDKAEWGQAAIGTFSSGFTQGTVGVGVDAFGLYALRLDGGKGRSGAGGIDFFKRGDSGNAADDLSKGGAAVKFRISNTVLTYGDQMPALPVLSYDNVRLLPESYTGTLITSKEIKGLQLDAGRFTAESRKSAEGRDSGGLKSINVLGGSYQFTEQFKAALYASDVEDVLKKQYVNANYVFPIDKDQSLTLDFNGYRTKLDNSYVRENGVTGDDNKIWSLAATFATGPHSFTVAHQRSTGDSNLGYAYGGYQKGQGRVGDGGNTIYLANSYWSDFNAEDERSWQLGYGLDFSAFGVPGLSYNFAYVRGDNITTSTSEGGTEREIFNQFKYVVQSGPAKDLSIKLRSSILRVSQKSSEYNVSGNELRVFVDYPINIF

SEQ ID NO: 17819 - protein, 374 aa, Moraxella catarrhalis
MNKFNKLLVCLALLAPFAASAAVYEFTPYDLSLVYSNKDKVSLAYSSYRYNFNGDYSASLGGGQTGESFADTNVYTLGLHKQLTDKLDISAQVYDPYNLNVSHQEGFYDGTKALIETQSLALTFKYQLNESYSLIAGPTINKTSGNMTINSNIASVSANQTPGSVPSIEADFGSDTALGYLAGAALEIPDIALRASLVYQSKVDHSFDVTETSDIILSNTGGATDTAKSGSDFSLPQAIIFDFQTGIAEGTLLTFSAQWREWSDQVISTSVAGELASYDKDAMTYKLGIARQFNDEVAAYIQYVHEERLEDDVNPLAPNDGYRGIFLASSFLVNDINLIAAYEYAMAKDVVDEMGTEFEDNVIQGVTLMAEYYF

SEQ ID NO: 17820 - protein, 743 aa, Moraxella catarrhalis
MSLIRTRKKIVSSAIASSLSMIATTAMAQEAVSQLPTIHTKATQEESLKVDQSANSKFVAPLLDTPKSVSVISKQLIEDTKVTTLADALRTVPGITLGAGEGGNPNGDRPFIRGYSSESSMYIDGIRNSTSQNREMFAVEQVEVTKGSASAMGGAGSVGGSINMISKVAKKGDFLEGSVAAGTDNYQRITLDGNKDFGNGIAARVAVLGHQNEKAVQSNGAEYKRVGIAPSITFGLDTPTRATLSYYYLQTDDKPDSGIPYWDSSLGKAQGKPAEVKQGTYYGWKDRDFQKQENHIGTIKLEHDLTDNITITNTAMYAKSKNDYVWTNPDDSKGNVGKGLVWHRLNSAITDSETFTDQLALTGKFDTGFLKHRFNVGAEYSKQKTDKGGYNIIDAKGNVSSTGFYSDCSDLSTNWCTSLNGPTQKPFVDRLQARPDFDATVESTSVYLLDNIEITPKWLLDLGLRWDKFEAEQNFLATSSAAAYTAKNDSDFVTYQAGITFKPTENGSIYTSYATSASPVGLNAGWGDNSETINANNQMIDPEEAQTFEIGTKWDFLDNHLNLTAAIFRTEKQNTRVQIDPTTYANVGESKVDGFELGLNGEITDKWNISAGYTYLDSELTKNGKSCRSGKCTDQSIYNGNQMPNVPKQAATLWTTYRVLPQLTVGAGAVYSDKVYGDVANTKWVPSYVRYDAMARYNVNKNVDLQLNINNLSDKRYFTKAYASHYATEAEGRSAVLAVNFKY

SEQ ID NO: 17821 - protein, 368 aa, Blochmannia pennsylvanicus
MKLRALSLMVPALLTAGSAGAAEIYNKDGNRLDLFGKVDGLHYFSNNSDSDGDQSYMRLGFKGETQISDRLTGYGQWEYQAALNTTEAEGTANSFTRVGYAGLKFGDAGSFDYGRNYGVLYDIGAWTDVLPEFGGDTYGADNYMFQRGSGMATYRNNNFFGLIDGLNFAIQYQGKNDSNAEVAGNRSVVAQNGDGYGLSASYDFGAGFSAGAAMFSSDRTDSQNRGALSGRGDKAEAYSGGLKYDANNIYLAAMYTQSYNATRFGSSDNLSAYGFADKAQNWELVAQYQFDFGLRPSLAYVTSRGTDIQNWGTQNLKQYVDVGATYYFNKNMSAYVDYQINLLDKNDFTKAAGINTDNVVATGLVYQF

SEQ ID NO: 17822 - protein, 735 aa, Blochmannia pennsylvanicus
MSIHLARGGASALGGVLAATFAVLWPFDVFAQSVPGTALPAVTITAAQPNKPQPKRAMRSAVPSVPAARRESVPSQAAAPAAVPGSLTVLTAQQALREIQQTPGGVALVTADAYKNSTVSNTIKDILDYVPGVFVQPKWGDDTRLSIRGSGLSRNFHLRGVQLYMDGIPINTADGYGDFQEIDPTAYKYVEVFKGGNALRLGANSLGGAINFVTPSGRDLFINGVSVDAGAFGFRRLQAKTGGSNGPWDGFITAATQRSDGFRDHSFGQANRLSGNVGYQFSPDVETRFYLNANNVRQRIPGSVSKFSALTSPQTAAVNNLTGDWQRNIDTVRIGNKTTMRFDSTTVEFGAFGVDRHLMHPIYQWLDYHYQDYGAFARAVDDRVIGGFRNRLVAGVNVLNGRIDNQQLVNLAGGQKGALVSSSIDRSKNTSVYVEDSFYFLPNVAAIAGTQFLYATRNRQDRFLSDGDQSGRTEFNLWSPKGGLLWQIDPTWQAYANVSRSAEVPSYGESANGPGIPTIPFTSIRPQRATTYEIGTRVRRPDATWEVTYYRAQIDNELLCLFSAFGNCNVTNADRTMHQGIEAGAGAAIFRNLFVRGDRPDRLWLNIAYTFNDFRFDNDPVFGNNLLPGAPRHFVRGELLYKHPNGFYVGPNIEWVPQGYYADSANTLSTDAYAIYGLKAGFDDGGRYSGYIEARNIGNKAYIASSSIIDRANANSPLFEPGFGRAVYAGFKVRW

SEQ ID NO: 17823 - protein, 699 aa, Pseudomonas putida
MSRSRPSPLPFNVLSSPARRMAMATLLLGCPLAAQAQDDVAQSDTVVVTATALKVATPPMETPRAVSQVGREELDKRAVNSYDETFRYRSGVQSAPYGSDNGVDWFNIRGFSGEDSTYQDGLRLFREGGYFWWVTEPFGLERVDLLKGPASILYGEAPPGGVVNAISKRPTEEAQGLFEIQGGNKDHRQVGIDTSGPVAGTDDMRYRMVGLFREGDGELDHTDNQRVYLAPSLAVDLSDATTVTFLASYMKDHGTPSKGFRPVAGSLEGTEFGHIGRETNLGEPDYERQEREQISLGYELEHDIDETWQFQQNLRYNSMDLLLRSLSPFTALNPDGRTVGRYLTYRDGSYDSFTVDNRLVGKWFTANTENTLLLGVDYQHFDVDYQNGDGTGDFSGFDVFDPEYGNYSPGTLQYQAEEKKEQIGVYIQDQLRLGDRWILLGGVRHDSASVESYSDAPNASDYDETENQLSFSGGVMYLGDYGVSPYLSYSESFSPQVGRGPDGQAYEPSEGEQWEAGVKYTPDWLDGYMTAAVFDLKETNTLYTDAQFIQSQGGERHSQGFELEGVGYLTEQLQLTASYTYLDTTIEDPERGEFRAGLTPRHQASLWLDYGFESGALQGLDVGAGARYVGESVNAAPDRDDEVSSYTVYDAMASYEINSAWTAQVNVTNLTDKEYIRGCDSWCYYGESRSVIGSLKYRW

SEQ ID NO: 17824 - protein, 346 aa, Escherichia coli
MKKTAIAIAVALAGFATVAQAAPKDNTWYTGAKLGWSQYHDTGFINNNGPTHENQLGAGAFGGYQVNPYVGFEMGYDWLGRMPYKGSVENGAYKAQGVQLTAKLGYPITDDLDVYTRLGGMVWRADTKSNVYGKNHDTGVSPVFAGGVEYAITPEIATRLEYQWTNNIGDAHTIGTRPDNGMLSLGVSYRFGQGEAAPVVAPAPAPAPEVQTKHFTLKSDVLFTFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 17825 - protein, 346 aa, Escherichia coli
MKKTAIAIAVALAGFATVAQAAPKDNTWYTGAKLGWSQYHDTGFINNNGPTHENQLGAGAFGGYQVNPYVGFEMGYDWLGRMPYKGSVENGAYKAQGVQLTAKLGYPITDDLDVYTRLGGMVWRADTKSNVYGKNHDTGVSPVFAGGVEYAITPEIATRLEYQWTNNIGDAHTIGTRPDNGMLSLGVSYRFGQGEAAPVVAPAPAPAPEVQTKHFTLKSDVLFTFNKATLKPEGQAALDQLYSQLSNLDPKDGSVVVLGYTDRIGSDAYNQALSERRAQSVVDYLISKGIPADKISARGMGESNPVTGNTCDNVKQRAALIDCLAPDRRVEIEVKGIKDVVTQPQA

SEQ ID NO: 17826 - protein, 782 aa, Bradyrhizobium japonicum
MADGAKYSRALILGASVVSIAALATESGLAQTASPQAEHGSPERPKQAKRKPAKPLAAQQATPDALNARAQAGSAAPVQTLDTITVAATKTRERAIDALAPVSSISLDQIQGLQPNRLSDVFHSVPGVSFQERGDDPATVINIRGLQDFGRVAVVVDGARQNYQRTGHNANGSFFLDPELIGGVDVVRGPTANIYGSGAIGGLVSFRTKDINDVLRPGERWGVDLSGSYGSNNNRGLGSVFGGVRATPDVDIFGGAVYRTQGNYKDGNGTEIGNTGNQVEAGLMKLTVRPALGHEVKFGAVFQDYQYDIGQFNRGPTTTQALIALNRGSSVYASDAKNYSGTVTWNYSLPSDNLFDWHMSVYGNRTDNDQTKTYHYGTTPSAYCNGGFGNNVSGCVGDKRGYVLNTYGVDANNTTRFNVGDWRNALTWGVDAFQDDVITTDSRGNSNITTPSGIRTVSGGFLQLKQNYSTWLEAVSAIRYDRYDLDSGKTSTGGDRFSPKITLGVTPVPGFQPYVSYAEGYRAPSITETVISGAHATGGGPAFFVCPDGTAGLFCFLPNPNLRPEVGKNKEVGINLKYDNIFSANDSFRGKINLFRNDVSDYIDLVASAPVAVPPFGSFSQFYQYQNIANARIRGFEAETMYDAGDWFIGVAGHYIQGKNVATNIGLATITPRKVVTTGGVRLLDRTLILTAQWASYGPNNDVPAGYLPATGYELVNLYLTYNATRDIVLSASIDNLLNQYYRPYAIPGSSTDGTTQNDVLWSSPGPGRVYKAGMKIHFGGA

SEQ ID NO: 17827 - protein, 1006 aa, Edwardsiella tarda
MKYKNHLCCLAALLTLFQLQAQDQKTISGTITDQDNIPLPGVNILVDGTDRGTQSDFDGNYQIAAAEGDVLVFSYLGQQTVRRTVGASGVMNVTMQEDAQALEEVVVIGYGNQEERKIIQNVGIVKEEAIENLQVTSADQLLQGQSAGTQIVNSSGVLGSASVIRVRGVNSINSGSQPLIVIDGVPITDTETNTLQRGGNTGVNPLSYVNPNDIASLTVLKDAGATSIYGSRGANGVILITTKKGRKNQQATVTLDISTQYTRATDVPEILSADEFRRFKSEVASIQQGTEVTPEDLGLGAIGSGGTDWLAGVQRTGISQRYNLGIRGGTENTTYFIGLDFQDAEGFIIGNDQQRAGARINLETEVSEWLTAGMNLGITNNRLNRVGVENNTFAPFTTAFLQSPVVEAYDSEGNFAQSGSFIPNIFAIVALDTDELKTFRTIGNFYAEITPFRNLTYRAEFGVDKLELEEFLRSAEFNTPGGVAQQINVAEDRWLTNQTLTYANTFGESHNLTALVGLNYEETLNTRTNVSATGFLSDDLRNLGSGSTPTVLNGDRNPNRLYGLFSRVSYDYAGKYLVEGSIRRDGSSRFGANNRYGYFWSAAAGWVLSSENFMEDATWLDYLSLRASIGTVGNDRLGSFPSLGLFNAGAIADYNGESGVIPNQPENPDLKWEESETIDVGFKSALFGGRLNLNVSYFKKTTSDLLLNQVLPPQTGFATISRNIGEMENSGWEFELSTVNVRTEDFEWRTNLNLATIDNQVLRLNEDAATDPQGRRIIDGPIQRAIEGESLNNFYLIRYVGVNPQTGDAEWLDADGNITTTPGTDDRVVTGSPLPDFSGGITNTFRFFDFDLSVLMNYSYGNDIVIDGLRFADGNDAIGGIVNIRRQNLNFWREPGDNAYLPSPTSPTFNLFNQRSSQQQLDGSYLRLKNITLGYNLPQRALDQIGNIFSGVRFYFTGTNLFTIKGDELEGIDPEVTDDIDPLFQGESFFTAPQSKSYLFGARLQF

SEQ ID NO: 17828 - protein, 449 aa, Edwardsiella tarda
MKKQHSNTRLLCQLSAVAALVLSGNAMADEAFSADSKWMTGDWGGERTKLIEQGIDIKADYVGEMGANLHGGYNDDKTGRYSDQFGLGVAFDLQKLLGWDNTQAKIQLTNRNGQNISNDRIGDPRAGTLSSSQEVYGRGHMVRLTQLWVQHQFLDGKLDVKAGYFGEGEDFNTFPCDFQNLAFCGSQVGNWATGIWYNWPVSQAALRIKYNITPELYAQIGAYNQNPSQLEHGNGFKLSGSGTKGTVLPVELVWSPKLNSLPGEYRVGYYKSTADANDVRKDVNGQDAANTGDAYRVHNSKHGYWFVGQQQLTTHNGDASRGLNIAANATFHDKDTNVVDNYQSLMFVYKGPFDARPKDDVGIGFARIHVNDDVRKNAQLINEDNGISNYDNPLYMPLRDTEYNYEINYGFHVTNWLTVRPNLQYITHPGGVDEVDNALVAGLKIQSVF

SEQ ID NO: 17829 - protein, 877 aa, Crocosphaera watsonii WH 8501
MMNRAVTSILAYLWLCVAGLLPVVAQEATGQMLAGRVIDAESQEPLAGAVCQLMDASGKPLAFVLSKADGSFSLEKKAGGKLLSVRYMGYRKMSKAIDAAAPPLLFALVPSDVKLKEVVVRAEPVRKLGDTIAYSAAAFVGPDDRYLADLLRKLPGIEVSANGLVKYQGEPITHMYIEGVDMLQNRYNLASRNMPQEAVKTVEVLEGHQHIKTLRETVPEKRAALNIKLKERFKVRPFGEVTAGGGFPELFTGRLFGMQISPKVQALLTAKGNNTGNSVNEEAVRLLDEDGIMYNASDREEVLTHAGFRSLPMSQSRYLMNRSGTGSFSMAIPLGADRTLTANASLLTDRREQTILQEQTYNLSTQQEVSVREDRYTRNRSRSAQADFSFENNASRFYLKDDLKLSLGSDRERVRLSTNTADCLQTGESLPRVVQNNLTAVLKDDRRSYRFFSFGKYMARDENMLLSDPATGALQMDPDVRMHDLATRNGLESDFRFGRVALHSTTTMGYRGEQIDYRSSLPQPDVEDFGGTYGYHAGHWELSEKPSFSYRFGRTYHRLDLPVAWHLFTLNDKSAAERRQESRAAFSPALSLHWEPGAAWKLNVSVRHGHSFGGLEGFRSGYTRRDYRTYLLPSGFMSERRYSGANFSVDYGDVLHLFYFHLKAGYSRSRSNELPHFDYTAEHNIIRYERYWHDLNAFFADMRLSKFFFPVKANAVLNVRYSRSESLLKQSGHLIGGHANSLSSELTLSKRWGGWLSVSYNLAADYSWMETGANAHRRLPQYRHTARLTLLPIPRLSLRMAGEYNATTLEPGHVHEDVFFDCEARYSFDKVWEVSVSMRNLFDRRMYLIRQLTEYNAFSTAIPIRGRELLATVFFRY

SEQ ID NO: 17830 - protein, 943 aa, Crocosphaera watsonii WH 8501
MLKSKTLVKSLLAISIASVTTYSLAADADNVKAEAKVEKIIVTGSYISKGDFESASPVKILDADDIEGVGAVNVGDLLARMPSVVGDTTSASSNISEQDSGLNTVALRNLGSSRTLVLVDGKRYVSGMSVGSGYGVDLNTIPTTMIQSIEVLTGGQSAAYGSDAVAGVVNIILKKNFDGVAFKAQAGRSGEGDKDTRDIEFSIGKNFDDGNAWLSVGYSEDDGLMAGDRDYSRVHKDAVDTNGDGILDTSQFVGSSHVFGGRIDKYNGDGSLFTRTDDPATSDAFNFHDYRSMVAPLTRHFVATGLSLDLNEKSRMNFTANYARVDSRARYEPIPLDTRNDIFKLSKGGTTGIDIATHPWFAGTALGNNLLADGINSLDDASLTFRRLYEFGDRGAENTRSTFRVAGEYEYDISNDIYLKVSGTYGVTDQKQTNHGDINLDRARFALNVEDNGAGGFQCADDIARINGCVVFNPFSLNGISPEAVDYLSADTNLEGSIEQVVVTAVVAGRLDYAVSNDVDTIGFAGGVEYREEKGHETPDPLRQAGIVRGAAIAKTKGSFDVVDVFGELHIPLHEKLSLSAAVRFGDYSSVGSTTNWTIGLDAPITDSIRLRGAMATAVRAPNVSDLFAGGTATAALITDPCNGLTNADSGNIAVNCRSIDAISDRIDNDGAFNLTQVERQNTAGLLSGSTDVKEEKADTFTAGIVFTPESISGLQMSLDYYDIKIDDAIAKTDRTVILNRCYSADPSNFDAQCGGLVRRDGRSGAALEVNAASGNENLIETRGLDIDVSYMTDLGDGDLYVGFAANILDTYSITGLETGDKQELAGEVMFPELRFNVNASYTINEFNVYWQVRYWDETKDRNDNTVLTEELNSIDSRLYNDVRFSYNFTNQINAYFGITNLFDEQPPHLTAGHKYQQQGTLTNGSAYDLTGRSYYAGVKLNF

SEQ ID NO: 17831 - protein, 798 aa, Crocosphaera watsonii WH 8501
MRKLFLSLVFLSALLSIHANPGIKGIVIDQTTRKALDYAHVVLYDGDHIVEEAMTEANGSFLIQPVKPGTYSIRIHFLGYDVYMGEEFILTEQIKDLGIIPMQMLEVGLQEVEVVANKKQVIYKLDKKIIEASSNLLSSGGTAVDILENTPSIRVNAEGEVTFRGSSGFTVYVDGKPSIFTGTQALEQIPSGQIQNIEIITTPSAQHDTGGDVGIINVITKKNFGEGLSGVINLSGNTVWSRTLDFLLTGQNKASQWRIGGYVGNRLRKSHFTQEKTTLVNDTTTTSYSNGPRESNGYAYILNGGWSYTQKQTTFSINTEGGYAGLKRKGDLEYTEERSANGEQFENGEFKSLDDFDIHETFGLGNLAVDHKFNDKGHNLSGSFFLKYGGDALEYFQSDLFDKNNVRQQGHRAWEAEHRWTVRAKADYVFPYSKTGQIKAGYQYFSYSEDGDYSMQFWNPDTKEFFWRDDIYNTFYFQQGINSLYAIVGDSYRSFDFQVGLRGEHTHQVLRSSKDWANRLQKRFELFPSAHIGYNLTQNQKLLFAYSRRTTRPELYFMEPYITYKDYYTAEIGNPDIRPEYIHSFELNYSLTSGDNALSASLFHRTRKDKIERLRVPYQAGVTLDSMANVGHDYSTGIELSGSLQATSWWNTQINGSLYHYRVENEYKTDGKNETSTNYEIAWNNAFTAGKYTRIQLDGNFVGPSVTTQGRTQSFWFVNLAIRQQFFKRKLTATLSFRDVFNTARYVNTITSSNLISKTRIRPDYPLIGLTLSYTFNQFKLKNGLSNNSKDLFEGTNH

SEQ ID NO: 17832 - protein, 890 aa, Crocosphaera watsonii WH 8501
MKQSLFFPSLFVSSAIAVCVSQPAWSQPLPPIVQITDLRLEATAEGLALVITTADGSPPQFFETRSGNTLVIDLLDARLSLPGGGKEFVQQNPVEGIASITIKQQYQTGVFVTIVGETEVPVAQLTTTPSGLAVRLPETGTGAIARTEIPSQAPEVSTTPPDLQPPGSTTAPPIPGEEPQTPVQPPTGPEELPEVMVTAEPDPPPPPEPTPDPPPQPPRSPLADRSYTPPKTSSVSRDDSQILDTAQDIDVVTEEIIEDRADRTVGEALENISGVTSGRAPTSSVALTPIIRGFESQNILRNGMRDDTQRFFGGITTNVERIEVLKGPASILFGQGNLGGTVNLVTKVPQPESFFSFEFRAGEYDFYRPEIDLTGPLNEDGTVSYRLAASFETARTFKDFEDIEERILIAPSVRWDISDRTQMIIEAEYIKEKTNALAPELPAEGTVLRNPNTDFEGELPIDRNLGEPSLVESFGYVSRVGYRFKHEFSDNWTFKNEFLAAFGRVPEGDGSVFILPVSLGRDLRTLTRLLAENPSKADNFTINTTLVGNFKTWDIDHKLLLGFEYAEEQTEDVLVFRQIDPIDIFNPIYRPESVDQPLTFQDFQSHLNASGFYFQDQITLFDRFIVALGGRFDYTDLTYTDFLREETLEINDEVFSPRVGLVYKVTDNISLYGSFARSFEPVVGQSFEGEVFDAERGKQYEVGAKALLLDEKLSLSVSFYDLTRTNQLEQDPENAGFQIQIGEQRSSGFEFDMIGEISPGWNIIGTYSYTDAFVSEDLRPEFEGRKLPNVPLHAASLWTTYTFQEGTFEGLGFGFGLFYQDERQGDLANTFVLPAYIRTDAALFYRLGDIRIAFNVKNLFDHEYYEGARSRSRVNPGAPFTFQGTLFWQF

SEQ ID NO: 17833 - protein, 668 aa, Wolbachia endosymbiont
MITRFLCVSFYLFFSFNASAEMEDLSSARGDFSDLGSYDDFFDHISVVVTPSKMSQPRVDVSSTLSVLDGEFIRRINMQYVEDLLQFIPGFSVAPYKSSAQKEASYHGTQLDQYRRIQVLVNGRSVYSVGLARVEWATLPLSIEDVARVEVNRGPNAASYGINSYFAVVNIITRSPLETLGDSITAYSGSRGDYRLYGQHSGLNGDWSYRASASTNAVHGFDKDFYDKDRHDGHRSTMGNVLIQKETAGSTFNLDMGANSLKDKVDPVKYGAGSYDINKPMRLIDREHIKLSYSKQVSPSHEVKIQYYYDQSDLNEYHEAILSSGFYNALFGGSSTVSVHESATVDLLETRQDIELQSTWEASNQLRLISAVGYRWDEADSEHYLSGKASDEVFRLSSNVEYRASESWIINAGAMFERSQMGGEFLSPKFGMTYKLSEQESMRFNISKAVRTPDLSDQYFKWHYVLGNGDSSPTSYAVNGEKEEKITSYEMGYYHYWPSRGLSLDIKFYHDEIKDMVLSQKKFTAYTGDTQIEEGITEDVDINGMELELDWRFRSGAITRFTYSYQDTQTDNAALIKSTTPIMLSFFGSLPITERWAVQSYYWYGKELGGNNYELLNTWLSYRLSLGGYSKATMGIGAETRLDNNALISKHNNMTEDTFAYVFTNITF

SEQ ID NO: 17834 - protein, 707 aa, Wolbachia endosymbiont
MIIVNKGTTVNRIACLLLAGTTLAPASAFAVEAVPADAAFDAETAGTVIVVTGSADGYRPVDANAVKTPTPLVDVPQTITVLTREQLDDQAVTQLGDALRYVPGVVLGQGEGHRDQITLRGQNTTADFYLDGLRDDTQYYRSLYNIERVEVLKGANALLFGRGGGGGVINRVSKTPDLDRTKGEASANVDSFGAFALAADWNQPLAESVGGRLNATYEEFDNHRQDFEGRFIGVNPTLAFEPGEATRVELSYNYDDDRRTTDRGVPSVAATKKPLTGHDDTFFGRNDVNIATVKAHIAQARIDHDLADGLSFNVLGQYSHTDKYYGNVFAGSSVNDAGQLTLSGYSSANVRESWVGQTNLVWEGHTGPIGHTVLAGLEISSQDTTSLRSDPDFGTASTTVTLAKRMTIPAVTFKAPSRSSLSRVDTWSAYFQDQVELASFLQVVAGIRFDEFRINSTDRINATSAQRTDRKWSPRFGVVLKPRKEMSFYASFTRSFLPQSGDQFGSLDATQATLAPERFENLEAGVKWDINPGLAFTAAAYRLDRENSRFNNPVTGLPELSGKTRAKGIELQLAGRVLPDWQVSLGYTLQDGEVRSRTTAALPGTKLAQLPRHQFAAWTRYDVTRQLGLGLGVTHQSKSFATISNAVTLPAFTRVDAAVFYDLSERFSIQLNVENLTDTDYFPSAHTDNNISTGEPINARLSVRVKF

SEQ ID NO: 17835 - protein, 185 aa, Wolbachia endosymbiont
  misc_feature (98)..(98): Xaa can be any naturally occurring amino acid
SYYVRLQYNGEILPFYTKVDGIKNVTGKEKDSPLTKSFIAGGGAFGYKMDDIRVDVEGLYSQLAKDTAVVNASETNVADSLTAFSGLVNVYYDIAIEXMPITPYVGVGVGAAYISNPSKADSVKDQKGFGFAYQAKAGVSYDVTPEIKLFAGARYFGSYGASFDKADKDDTGIKNVVYSTFGAEA

SEQ ID NO: 17836 - protein, 350 aa, Acinetobacter sp.
MKLSQLLVLSAVFGVVSNEVHAQGSVNIYGILDTGVLYQSRTANDAGKGFSALDAGGDPTLWGLTGTEDLGAGYKAVFKLESGFSTVNGGFGNSNGNFWGRNAYVGVETPYGTLHAGLEISSFFNAVALTDPVGTSFFASAVTTEINAIGLAGAIVSNGLSYTSPTIAGLQIRIDHGFGNVAGNFRAGSHTGASANYGNGPFSATIAYFTEDDPVSGASTYRGLTANAGYAVGPVTARLSFSKFRNMSTDAPLTNVNVFGAGAEWQITPAVALTAIAYASQDTNVRANKSMLYRVGAQYFLSKRTTLYGQVGLVHNDADMNTTLAVNAPTSFAPPQGTTVGVNVGIRHMF

SEQ ID NO: 17837 - protein, 178 aa, Wolbachia endosymbiont
YNSEFLPFKTEVDGVTGAKKKNADTNVTTDLYKASFMAGGSAFGYKMDDIRVDIEGLYSQLSRDTFETAPAPAIADNLNALSGLVNVYYDVVIEDMPVIPYVGIGVGAAYLSNPLAIKVTGDKEYGFGFAYQAKAGVSYDVTPEVKLFAGARYFGSYGAKFDKPVVESGQQPTKDGIK

SEQ ID NO: 17838 - protein, 182 aa, Wolbachia endosymbiont
YIRLQYNGEILPLFTKVDGITYTKDNSDYSPLKASFLAGGGAFGYKMDDIRVDVEGVYSYLNKNNVTDARFMPDTIADSVTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYSTV

SEQ ID NO: 17839 - protein, 205 aa, Wolbachia endosymbiont
SYYIRLQYNSEFSPLNTKVDGITGAQKDSKDTNDHYKPSFMAGGSAFGYRMDDIRVDIEGLYSQLSKSTLSRAPTPDIVDNLTAISGLVNVYYDVVIEDIPITPYVGVGLGVAYISNPAKAQVIADQKHGFGFAYQAKAGISYDVTPEIKLFAGARYFGSYGANFDKSGEVNKGTSEDRETKVTAGAYKVLYSTIGAEAGVAFNF

SEQ ID NO: 17840 - protein, 188 aa, Wolbachia endosymbiont
SYYVRLQYNGEFLPLFTKVDGITYKKDKSDYSRLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYSTVGAEA

SEQ ID NO: 17841 - protein, 196 aa, Wolbachia endosymbiont
SYYVRLQYNGEFLPLFTKVDGITYKKDKSDYSPLKPSFIAGGGAFGYKMDDIRVDVEGVYSYLNKNDVKDVTFDPANTIADSVTAISELVNVYYDIAIEDMPITPYIGVGVGAAYISTPLDPAVNDQKSKFGFAGQVKAGVSYDVTPEVKLYAGARYFGSYGADFDGKKTDPKDSTRQVTDAGAYKVLYSTVGAEA

SEQ ID NO: 17842 - protein, 160 aa, Wolbachia endosymbiont
SYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGS

SEQ ID NO: 17843 - protein, 128 aa, Pelagibacter ubique
SDTGKKSTLIGFQHQNEDLNRDTFLGNISPITGALVTADSAAYIYTGIQAQYKLGKINFIPSFAPGLYSKGDGKDLGHILEFKSELQISVDFVSNSQLGFSYNHLSNASLGTKNPGANSYMFNFFKSF

SEQ ID NO: 17844 - protein, 699 aa, Pelagibacter ubique
MYIRKKILFIFPLLLSFTVFTQDIEEIIVKGEYREKSIIEEDSSILVIQSEKIKSQAIKHFQQLSYLVPNLNYAASDSRARYFQIRGIGERSGYQGTPNSSVGFLIDDIDYSGQGGIATLFDVDQVEVFRGPQGSRTGANALAGLIYIKTKDPTDKFEGTSELTLGDYGTQNIGVAFGGPLKNEKMKYRLVMRTDYADGFRKNIYLNKSDTSKKDELTLRYKLDWEIDETTNINFLVSKVDMDDPADIWTIDGSLNTLSDRPGMDSQITDSIGIKITKNFNNFDLQSLTSSTKTDVVFSYDADWGNSDSHFPYTYDYFSETLRKRDTFSQEIRFLSKNKDFSQSNPFEWVFGFDFSELDESNLTKDDGVYGDPSDPFGPYVSESSISRNYKSENLSLFGNIDYFLTNKTKLAFGLRLENWDSKYKDSNNESFSPSDNMSGGKISLVKKNNNDSNIYFSIARGYKQGGFNLGLDATDNLVRQSLIYDPEYLTNYEFGISSNLKDSDLNYSFVIFFSERKDQQVLISRQVDPTDPNTFSYLTQNAAEGENYGIEITSNYLLRDDLYLFANLGFLKTKIKNWESRIDLEGRSQAHAPEHSYSIGGNLNLKNNLYLKLDINGKSSFYYSDSHDNQSKSYQLTNIIFGYSNSDFSADLWIRNIFNKYYSTRGFYFGNEAPNFIDTLYRRQGDPRNIGISLRYNF

SEQ ID NO: 17845 - protein, 853 aa, Pelagibacter ubique
MLNKTPLCMAITLTLASVAWSPLAQAAEEAVVTGAASGAAAIDLERLEVRPQLEAQERAVDLKRASDAIQDAVASDAMGRYPDKNVAESLQRLPGVSVTRDQGEGRFVVIRGLDSSLNSVTIDGMSMGTPEDGTRSAPLDVIPSDSTERLKVVKSPTPDMPGDSIGGAIQVESTSAFDRDGRTLRGSIEGSHQSLSGKTSPKGAFNYSDIYNGTFGVAVGVNYQDREFESDNTEVAYDSFDGGAADDLFAGEVQRRKYFIERTRMGANLNLDWRPDADNRYYLRSLYSRFDDAETRQRTIFGLADGQVSANGDGTYDVADLPADSISKRVRYRTKKEDNTAISVGGENRLSAATVDYKVGYTKTTERVNDEMEARFNYDGDDLSATVDQRSGIPRLGFSDNGWQSNQDFVFDRFVVSPKTVDDSEHSAQVNVRFDGEHSSLKMGVLGRWRERDVDVNEQELRRGPAIDLSSWTTAAPEHRGGTLGESIGSDGMRRYWRASGGLYSARPQDVGGNQQVSLQDDYTATEDVFATYAMGTWDIGALRMIAGVRVENTQFNAIGNQVDVAENGRTATVTPREASSSYTNVLPGLHLRYDSGNDWVLRFAANKTLSRPSFGDVSPRVSINRGDEEVSIGNPDLNPYRSTNLDLSFEKYIGSTGLVSLGVFNKSIDDYIVQTLSTTDAEFPGLQVTRSINGDTAKVRGAEFNWQQTLDFLPEGWNGLLVGASATALDSDFDPGLSNRAGDDFMLPRSSKRIYSGHLGYEKYGFSARVAAVYRSEYLDTIGQSRAYDIYVAPHTQLDVSMSYQFNSHVSLYLEAQNLLDEPLELYQGVPSRTLQNEEYGRTYALGLKVAL

SEQ ID NO: 17846 - protein, 717 aa, Pelagibacter ubique
MFTVLPAFRLTLCATGVALLALPLSSRSQTAPTATPANETTLNTMTVVGNWLEAPSEEKVLEHPGARTIVDRKAIVETGANNVRDVLKRVPGVQVQDNNGTGGSDISLNVGVRGLTSRLSPRSTILMDGVPVAAAPYGQPQLSMAPTSLGNLAAVDVVRGAGSVRYGPQNVGGIINFVTRPIPRTFAADASVSTDIYSHGSNIKANPTAFIGGTNDNGLGGALLYSGVHGNGYRESNDNVDIDDLMLKGAYRISKTDELSAAFHYYEAHAGMPGGLTPEQFAANPFQSTRPYDDFTGRRTDFSLKYAHNDNNRKFEVLTYYTDSFRGSTLERQNGGRMLLTKSPRGYHVFAIEPRYSQLFRTGSVSNEVSVGYRYLREASSERTTRTAFYTPGSVYAPNLPGNLYQSSDGSTTANAIYIDDTINWGKWTITPGLRYEFIRSNITDNMIGKRTDNSANEPLPSVSVMYHVTDNWTAFANAGVSFGPVQYSQINRTTNGLTPEKAKTYEIGTHFHDVNGWGGELTLFNINFDDELQLRAGRNGLQDAWTNLGATKHRGMESGLRFDFGSLTKKLAGLTAYATYTFTDATYQQGAFAGRDLPFYSRHVATLGMRYVRNRWAFNVDGFAQSKQHSSGDPAKNNPMYQTQQSADGTLGDIPGYALLNMRMGYDFGKAAQNLKLAVGIKNLFDRRYFTRSVDNNRGMYVGMPRTFYIQASLAY

SEQ ID NO: 17847 - protein, 713 aa, Psychrobacter arcticus
MVCYIVSFNENGTSFYREGNMRFERHPLSAALALALAWQGAHAQASADGTPEAATLAPITVSASPLAGDLDSMTAPAAVLEGDQLLLRRQGTLGDTLDGLPGVHADTFGGGASRPVIRGQTAPRVKVLSDGSELMDASAISPDHAVTTEPLLADKIEVLRGPATLLYGGGAIGGVVNVLDRKIPTAVPQQGIEAEAELRGATGTKERAGAIGITAGSGNFAVRVEGLKRRSSDYRVPDWPDGKLAGSYSESGQGTVGMSWITPRGYVGVAFTHLESKYGLPGHNHEYEGCHPHGSHLHCGGHDDHGHGHDEHEEGEAEHDHGHEHGAGDVPYVKLRSNRTDLRAEYTDPFAGFEKIRFRGGLTDYRHDEIEGGQLGTRFQNRGYDARLELTHRPLYGWHGVVGVQTSYSDFRATGEEAFLPRSKTRAHGLFLLEEYRWADWRVELGARQDWQRVSPQGGAPASRTAGTSLSAAAIWDFAPQYSLALSVSRSQRLPSAQELYADGVHLATNTYEIGDPGLDRETSRNVDLTLRKHSGDTTFSVSAFHNRVKNYIYANTLDRYEDFRLIEYTQRDAEFTGVEGEIRHRFGKVFSAAVFGDYVRGRLTGGGGNLPRIPAARLGVRADAQWQNWAGGVEYFHVYRQDDIAAYESSTPGYDMVNATIRYRGKLDRTAYEIYLRGNNLLNKLAFNHASFISTVAPLPGRSVLLGVRLTY

SEQ ID NO: 17848 - protein, 361 aa, Psychrobacter arcticus
MKKLLLATAIAALSVSAANAAPTVYGKAFVAMDYVNAEFDGPAGNMYDEDTVEINSHASRLGFKGSEAMTANTDVIYQLEYGTKVDGDKNGFTNRDTFLGVNNKQFGEFRVGKNQSTLARIDNVVVNQGYFDNLGTTQNENEVVEALNMADSNRIASSIIWTAPKYNGLPLQLSAMYSSDDVNGNDNSGFGVAMLFDQGTGFTAGVAYDKDQNILGDIIRGTATVDLSKFIAAPVTLGALYQVADYDGLDRNGKITGAEKEKGLVISAEMPLANFARPASIYTQYNKTDNLNGFDNADSDQIVVGGKYMYKDNIIAHAYAGMNKADNVNYAYKATPNATSYTNVRGDAEVFVIGTGLEYKF

SEQ ID NO: 17849 - protein, 796 aa, Psychrobacter arcticus
MGAMLAGLATPALAEEQQVAQSDTGLAEIIVTAQRRTENLQDVPIAITAANSETLAQARVENVANIQAISPSISFRVTNIATSSANLIIRGLGTTGNSRSFEGSVGVFIDGVYRTRAAAALQNFLDIDNLQVLRGPQGTLFGKNTTAGALLLSSAAPSLNDVNGSVEATYGNYDGLIVRGAINAPLSDTVAFRIAGLASSQNGFYTDSTTGDDLNGNKTRAAKAQLLFEPSENLTVRVIGDYSYSNGNCCYATSAFIDGPTQPLIDLLTLYQPSSSAQLLGVLTGALPASSMTPTGRTLPSRDASKWEQTLNGNGKQTIEDYGGTLLVDASIGEGTLKSVTAVRKFKVDQVDLDPDFSGADIFRYNESFESRFISQELTYNTKITALNAEAVFGLFFSDEKLKMGRSLPWADQAQYYWDVIFAQLGVAPGTANAAPGTWTSERMGGSAKSYAGFAHLDFAVNDKFNVIAGLRYSVEKKRGFFNNSFYRSSPFDVFTLLGIAPAPAYDATSTDKALSGTFGLQYRPTDDIMLYATYNRGFKAGGVNMDVNAAGTLINNAEAYNALPAPIRAAFFGNAEAKDPLNPRYKPEKVNAFEVGGKFQYLDGRARTNIAFFYYDLSDLQIAQFIGLRFTVLNAKSAKDYGVEIENMFQLTDGLTLGLDGTWIPHAQYAKDANIDPVLSGSRFRFSPKFSGNATLNLDQPINDNLSLLARAQVQYQSRQLISTATTAEQGAVTLVNANLGFKLPQTGLLIEGWVQNLFDKTWFTQSFPTPLQTGDQNAYPGAPRTYGIRVRATF

SEQ ID NO: 17850 - protein, 460 aa, Psychrobacter arcticus
MRATFHLKTLAVAIATLSIASMANAAGLDRSGQDITAFLQDGTYAEAVYTYIDADVSGFDSANNVPTSNTYVKGNATGDIAESYDFFRYGVKADINDTFSVGILYDEPFGAAAKYEGDNNFVSKGGNGDESAREVTGNPLVNQAALNAAARAAAINAAANPNDPNAQAQAQTLGGAARIVAQQDADAGEGTDVEVRSENITAILGMKLGATKNFQVYGGPVAQRVRADIKLRGLAYGPATGYNAHVNPDQDYGYLAGVAFSKPEIALKAALTYRSEIKHNTQISEDYPVVGINGAVNDMEITTPKSVNFDFQTGINPTTLATAKVRWVPWSDFAITPPVYNQVSKQRFPEGLNLVEYDDDQWQVELGLAKRIAPALAISGTVGWDSGAGDPTTSLGPIDGYYSVGLGAKYNLTENWAVSAGGKYLWFGDAQGQLPTDKIVGDFQDNDGYVAGVKISYQAK

SEQ ID NO: 17851 - protein, 211 aa, Psychrobacter arcticus
MKLQSLVLAAATALTMTTAFAVPAGTWTVAAGAHYVDPKNDNGDVTIGGTSYAVDVDGDVRPTISGEYFIANNVGVELLAAIPFHHDFTLTDALNNEITGRTQHLPPTLSLQYHFDDYNLPMNVKPFVGVGVNYTMFFKEKANVVGTELKLDDSVGVAGHIGLDIPFAATESFRIDARYMDIKTDATLNGTDIGKIDISPWVYGVAFVKQF

SEQ ID NO: 17852 - protein, 253 aa, Psychrobacter arcticus
MNHTPTKNLLFLFSSLLFSSLPPSKAAGEDNGRGPYVQADLSYAYEHITHDYPADNAKVFDDSRDVKTHSTHPRLSVGYDFGNWRIALDYARYNTWKHGKSIHGEETKTVTPSSGRPIEVKVIADHTDKGTFKAESGYSASSAIYDFDTGTRFKPYAGVRVGLGKIRHSITVEDKADVKVISVNASLPGYPKVNNIHESRSIRRVGFGAVAGVGIDITPNLTLDTGYRYHYWGHLENTRFKTHEASLGVRYRF

SEQ ID NO: 17853 - protein, 874 aa, Psychrobacter arcticus
MVLSDYVHTLQGNSGDRLLFAGTLPTIHVETDSELFLIGPDTFYAVDGTLNKTGDGTVELQTVLSGAVLVSDGTLDLGKGAGVTGNVDLESDGRVVVQAPSQSGAPADSAISIGSLSGVGEVTLNGNLLTNGDNTSTIFSGTITGGPGSLIKIGTGTLTLSGDASGFAGGFSVNEGTLAIGSDNALGENTVGLSGSAALELLDGVTIDNGTAVGTGTQLVVTSGTARHEGEIFSAVAVIDVPLEGPATTQLISEEPPSQRISKAGDGELILTGTLTNVDLDVSEGRLIFNGMTEGLINVESGALLGGEGEIGSLVIGSGAALAPGNSIGTVTVLGDTTFAAGSTYLVEVAADGRSDRTDVGGTAAVDGTVTPISVDPAADYSATTRYTIVTAVGGVTGEFDAVVEDAALVEYELVQDDNNVYLVRSVITEEEEPEEPEDGEEEEPGDPEPPTEPDDGDEEEPGAPDDGDEEEPGAPPPVPEDGEDVPGDDGEEPLPNFALPASGANAEGLALVLSEFDFSGDDVVILNSLLGLNEADLNRAYRQLGGQIHAEVGRASAELSQHFNATMMNAAGSVTGASAGTAIGSLPASLTWAEIYGSDLDVDGDGNASGFSRGTFGVASGTEAQLDLFGQASTVGVALGYSEAHVALTDVAETADIESFHLGVYTESGAAPMEPGLAVSTALSFGRHAIETERHIVFGSVDRTATDAYDARSVNVAMETSYNVAVDNPYGILMVSPFAGLQYSRVDVDDVDESGAGSLNLSGSDNGADWATMSLGVAVAGELALGGAGLKTVSTLAYERVLGDEVGSATLSLDGSPASFEVQGVDQSRDRIRTGTRATYSFGNGADMSVALDGIFGEDREELNVSTSFTFTF

SEQ ID NO: 17854 - protein, 252 aa, Vibrio hollisae
MKLSRSVLAVLVGIGGISSASAEVLFQQNNVIVGYEYLLDAEDKNPNLYDQAHLILGHTTIADWGSATGWLRFENPLDSSENQQGKDAGATTKAWLKLDYNLGDSPFNLWVQSFTCANKPVVEQNFYLGGSYDVAIGKLKGTVGVGMQYAYGSFSPTGKSFNGASGTAATIMLGYPLTPHWFAKAYYEAQFNRSDEHREVFGFDSYGHQAIVGVDYRFNSQFFVSTLYKHRQSWGGALNGGGELLFEAGYNF

SEQ ID NO: 17855 - protein, 727 aa, Campylobacter coli RM2228
MNPSFLNGAAATVVYARPGAPFFPRNFVQRAVLTLGAAAALQCGSASAQTPATPVMSAMPEVGSLKEVTITGNPLGAADLIAPAAQYSGTGLLLRSKTTLGETLDGVPGVSSTYFGPNASRPIIRGLDGDRIRILGNGGATLDASSLSYDHSVTADPISIERIEVLRGPGALLYGGSAVGGVVNVIDNRIPREALFDEKGGVGGKVDLGLATGNREKSSGALLEGGNDRYTLHVDAFNRETGDVKVPADLACTKGGVNTTTNRICNSASKVRGGAVGGSMFFDQGYLGASVSTYRSNYGTVAEDEVNIAMKSDRVALEGEVRNLGGPVQSIKGQLSHTDYMHTEFEGATPGTVFKNKGSDFRLEARHARFGNLDGVVGFQAENNRFSADGAEAFAPYSKTSQNAVFAYEEYGTSWGKLSFGGRLESVKVESLGNPLVARFAPLTRDFTPHSYALGALWNTAPGWQVTTNLAYTERAPKDYELFAQGPHVATNAWETGDATLGKERSRSLDVGTSWKSGANRFAANVYMHRFRNYIGLMATGNTYGQELGNLNPADQDGDGVDDADPDNAILPEFAYTGVRARFVGLEASGNIRLLEGASTLDLALRGDLVRATNLNNGQPLPRIAPVRLGASLLWASGPWGSSIGFDHSMAQNRVAAGQRATSAYTLWNLAATYRTKAGPSSLLWYARVDNLTNQLAYSASSVLTTTAFPKAPLPGRSLKVGLQVAF

SEQ ID NO: 17856 - protein, 863 aa, Campylobacter coli RM2228
MRKLLKRSLLSQCVLMSLTSLSAFAANSTNTPCSNNGTAQTCGLSQYNNGSYYQDKGVTDAVMADATSDNIYMDGARGEGDTQSLTVSGTDMSGRYIQGSNGGNVNITVKNNATVDMIEAGSPGSTTNTTVNVDHSTLNGESASGNYNNPKDYMMGSAIYLDPMDNGTHAVNITNGSVLHGSIISAGAGTQNIALSDSSMDKGGIYAGSDKADTTITLTRSSVDAAQSEIAQNIDALAAKLSQYKPFSDMNVDAFGDVAIGMYGTTHDSLVLNNSTVTGDIGAINENGATTLSLANNSVVKGNVTLEGHSANDLLVDNSTVDGNVNASQNSGNTTITLQNNAAVNGDITTGKGDDTLVLTNNSRVDGNVDGGDGSDTLSMDAGSSISGQISQFETVNTTSNNSISIDKINDTTTWDLQNGSRLVAQSTGSNATVTMSTDSFVDFGTITGANNAVVVSSITASARDQKNVILGTFNTASTNTPQAYAGATFTNGQQSVENRSGAYNYNNELNIAAADSAPQTQRAADNSQSWNIEFTSAKGSLASDVQGLVAGLDAAEQAGQQVADDISNHMNQVHLANLYGEQQDGAQVWGDFLYQNGSYSNDVDYKSITQGAQGGVDWTAHLDNGDSVTAGIALAWTRSRVQDTGDGADSFKDSVYGNYYSLYGGWQQALNGKFWGMFADGSISYGDMRYSLSANNVTGDTSGMTEALHSSTNGSLYRAQGRTGVNVVLPGETLLQPYATLGWDQTKANGFSDSAVTFADSQVSSWNSGAGVRLTTTLRDLNKNVQVMPWVDARFQQEFSDDTDIKAADYHNTSGHNNTMGIFGAGVNATIAHNFTINTGVYVGTGDVDNDASVQAGMSYSF

SEQ ID NO: 17857 - protein, 156 aa, Campylobacter coli RM2228
MGYAQSKVQDFKNIRGVNVKYRYEDDSPVSFISSLSYLYGDSQASGSIESEGIHYHDKFEVKYGSLMVGPAYRLSDNFSLYALAGVGTVKATFKEHATQDGDSFSNKISSRKTGFAWGAGVQMNPLENIVVDVGYEGSNISSTKINGFNVGVGYRF

SEQ ID NO: 17858 - protein, 353 aa, Campylobacter coli RM2228
MKKLSKIMCAVVAASGLAAAPSIAATTYVGAKVGMGWLDSACVDGVKCEDDSVAGGLYGGYNFSDKFALELSADYLGDYDTSFNSTGTLKQYSDSIVAISLSPMYRLAIQQKFDIFFKAGPAYIMHDDEDDVVLSLGIGAEKQFAEDWALRVEYQYFDDFDDKFVQDLNSNLVTVGLSYNFGTGNTTASAAAASAAVITQAPAEPIAEPEVIVVEEEVVVTKAKTESFSQGMFETNSTELSSEGKSALMPLVEVLQAHPQSSVNVVGHTDSTGAAEYNMMISKKRAAAVAAYIEEQGIEADRITASGEGEENPVASNATAEGRAQNRRVDATIPSFEYQEKAQMEEVIVETAE

SEQ ID NO: 17859 - protein, 723 aa, Campylobacter coli RM2228
MNAKKGNYPLTLVAIAVASATTFVTLSAQAEDYSSTEETMVVVSSRTPKAISEIPGTVWFVDSEQIEQEYRGGKTLGEILSATIPSLDVSSGARTNYGQNLRGRAMLVMIDGVSLQSSRPISRQLDSIDPFNIERIEVLSGSTSIYGAGATGGVINIITKKADSDELQFESYVGGSSGLNGGDDFDYKVAQSVSGGSDNVSARVSAVYTETQGYFDADGDIITPDISQGSLQYNKTIDLQSTVGVTISDTKNINFLAQYYDSQQDSPYGLYIVNGDFVDVRKGFESDRQHGTERIMLSAAYNDSAFLGQQLMVEASYRKEDQTYTPYYQGASQQTTDVFSLKTALAKSFGKVNLVYGVDAYMDKFDSNQALFDPTIANNSGNLVNKTYAEVGRYPGVEVGSVAGFIQADFNITDDWSIEGGYRYQHMNNKVDDFVDYKIQKKIAAGKGSSADAVPGGETSYSVGLFNLGTIYKLTSDSQVWANFSQGFDLADPAKYYGQGSYGAADANGHYALQDSINVSDSKMSGIKTNSYEIGFRTEQDALSFQTAAYYSQSDKSVKYNKNTLLIEDVDNKKRVYGAEALVSYWVMDNLQVGASGHYVISELQTDGKWDDLSAGEASTSKANSWIGWYESDLALKVQSQTMFDYEDAKDNKLSGYTVLDLVGSYELPVGSLGFGIQNLLNNDYTTAWGQRAQILYSSHYDAAAYDYKGRGRTYTLNYQVKY

SEQ ID NO: 17860 - protein, 807 aa, Campylobacter coli RM2228
MYSSSRKRCPKTKWALKLLTAAFLAASPAAKSAVNNAYDALIIEARKGNTQPALSWFALKSALSNNQIADWLQIALWAGQDKQVITVYNRYRHQQLPARGYAAVAVAYRNLQQWQNSLTLWQKALSLEPQNKDYQRGQILTLADAGHYDTALVKLKQLNSGAPDKANLLAEAYIYKLAGRHQDELRAMTESLPENASTQQYPTEYVQALRNNQLAAAIDDANLTPDIRADIHAELVRLSFMPTRSESERYAIADRALAQYAALEILWHDNPDRTAQYQRIQVDHLGALLTRDRYKDVISHYQRLKKTGQIIPPWGQYWVASAYLKDHQPKKAQSIMTELFYHKETIAPDLSDEELADLFYSHLESENYPGALTVTQHTINTSPPFLRLMGTPTSIPNDTWLQGHSFLSTVAKYSNDLPQAEMTARELAYNAPGNQGLRIDYASVLQARGWPRAAENELKKAEVIEPRNINLEVEQAWTALTLQEWQQAAVLTHDVVEREPQDPGVVRLKRAVDVHNLAELRIAGSTGIDAEGPDSGKHDVDLTTIVYSPPLKDNWRGFAGFGYADGQFSEGKGIVRDWLAGVEWRSRNIWLEAEYAERVFNHEHKPGARLSGWYDFNDNWRIGSQLERLSHRVPLRAMKNGVTGNSAQAYVRWYQNERRKYGVSWAFTDFSDSNQRHEVSLEGQERIWSSPYLIVDFLPSLYYEQNTEHDTPYYNPIKTFDIVPAFEASHLLWRSYENSWEQIFSAGVGASWQKHYGTDVVTQLGYGQRISWNDVIDAGATLRWEKRPYDGDREHNLYVEFDMTFRF

SEQ ID NO: 17861 - protein, 696 aa, Campylobacter coli RM2228
MKKLCLSVCAIGLLASNAISQNVELDSSIISASGFAQDIKEAPATINVISKKELQSKPYRDVAEAIADIPGVDLYASKGKTGSYNITMRGITGYTLVLIDGRRQGIGGEVGPNGFNEISNSFLPPISSIERIEVIKGPMSTLYGSEALGGVVNIITKKVSDKWETSVSLDALLNENKDWGNTYGTSIYSSGPLMNDKLGLTLRFREFYRQQSNVEFTNGSGQRVPGDQAQSPTKANNFNIGTRVSYLANDYNTFIFDIDFSRNHYDNKQGQLGTITSPDSTQGSLTGGYADIMEVDKFVTYLSHEGVYENFSITSGLQYNRVSNDGREVVGQATQPFLGENRDIVAEDIILDTKSVIPLGQNHILSAGGEYRLEKMQDKIANPTNFDQYLLAIFAEDEYSIKDNLRLTFGARYNHHEIFGNNVSPRAYLVYNPTDELTLKGGVSTGFRTPYANRLINGAYNYSGQGRFPIYGNPDLKEETSLNYEIAAIYNNDLFYVSATGFLTNFKDKISTQRYDKNNMIPGIGTCNADRCFRAINHGKVEYKGVELGAGISPLDNLNINFAYTYLDSEVKEAQDKSVIGKPEQDSLKHNIMLKTEYSFYNKITPWIKGEWQIDRYMGDTNINREYYKDIFLASMGVRYDINKQWNINAAIYNLFNKSFTDGWESYQNSGTTTWVNTYNRIEEGRRIYISINGSF

SEQ ID NO: 17862 - protein, 755 aa, Campylobacter upsaliensis RM3195
MKKLSLFCAVGLCFASFAFSEELEFDSLEISGSKIKNDEKPFVTPGATSTREGIGSDTQSIDSIVRSIPGTYTNTDQAQGTVQVNIRGMSGFGRVNTMIDGVTQTFYGSASDDPARFHSQTGTSAFGAVIDTNFLIRVDVTRGTFEGVGGANALMGSANFKTIGINDIVHDGNIFGFLGRFSYGSNGIGPSYMSAVAGKTELENNGYVGALFGYSAKRITQNYTVGGGGKIGSSMVDTDGDGIADTNIAPFDPDFLTQKPNSQLFKLEYVPNSFTNTIFSYRRYQNELAGRKIHNDNYQLDFWHNPNEWLNVNTLIAYNQGIQAYGSKSTFAANDAIANTKAKNTATTFDISDTLEGEWHRFNLNTRFGANILLNDYKNTLNTSIQGVNSIPFQPRGKQNLFTYYLDNSLNYGIFTLDTNVNLLDWNIKGHRPACDEVNFMCFPKAATDIDKNGLRLNASVMLSAAIHELFTPFVSFARTNRAPNVQEMFFSNNEGNGINSFLKPEQANTWQIGFNSFKHGLLKDDDRFGFKAVYYHTKIKDYIYNEQFYLEDPSKDPPSSQFYMHLNSADDTIFKGVELELSYDLGFAYAKAMYSRQDTSSTISQTSGPLLGSFSASKIMELPKDYANVELGFRLNDKISFGGIAKYTGKAKRVNPNTDDWNKDPNNPYYPKPTTQDLPKIPIIIDLYWNIEWFKNLTMRAEVQNLFDKNYMDALNAYNSLDNQLQYNGAGDPIYLFSNSARGRTFIVSFEYKY

SEQ ID NO: 17863 - protein, 504 aa, Campylobacter upsaliensis RM3195
MKKIFITMAVCITAISMKAQDVSDAVLFSSENVTGTARYRAMSGAFGALGGDLSAIGNNPASSAVFLNSTASLSISGYTISNDSFYGDGLAINDDTSGKLNQLGGVFVFNNRDENAAFKKFTLGLNYNLTQNLDDEYFAFGETQNSIDQFFLENAQGIPLDLLQLQDGESISSLYSFLGETQGYAAQQAFLGFQGFIIDPEMDDPDNTTYISNLTNGNFLQDYAYRSNGLNGKFSINGGAQINDDLYLGVNLNTHFIDYERQTVLFETNNNSGSGINEIFFENNLRTFGNGFSAQVGGIYKVSPMFRLGLSLETPTWYNISEETTQYLDTFSNDEGSAVVNPNVINIYPEYNFKTPGKYTLSGAILFGKQGLISLDYSYKDYSNTEFDSQFNSSNTFADLNNNIKNTLQGATSINIGGEYRIREWSLRGGFRYQESPYKDETTIGDLKGYSAGFGYDFGNIKLGLAYDIYEQDRSPQLYSIGLTNRANINTTNSSFTATLSFGL

SEQ ID NO: 17864 - protein, 680 aa, Campylobacter upsaliensis RM3195
MKERTFKKMIFAVFYCQFLSIPLFAQQQKVDTTHTYSIPEITVSDIYQTREVRSTAPLQVFSKDALKNLHALQVSDAVKHFAGVTVKDYGGIGGLKTVSIRSLGAQHTAVGYDGITLTDCQTGQIDIGRFSLDNVDRLSLNNGQSDNIFQPARFFASAGILNIQTLTPQFTKDKKTNIAGAFKTGSWGLVNPSLLLEQQFNKTWSMSVNGEWMSSDGHYPYTLRYGSAEGDLSSREKRKNTDVQTFRAEAGLYGNFSDKEQWRLKAYYFQSSRGLPKATTFYNDHSTQHLWDKNTFIQSQYKKEFSQQWVFQTSAKWNWSYQRYLDPDTKNSLKKTENSYYQQEYYLSASVLYRLLSNLSFSLSTDGSINTMNADLNNFVHPTRYSWLTAFAGKYVNDWLTISASALATIINEDVKKGGSAGNHRKLTPYVSAAFKPFHNEEFRVRFFYKDIFRLASFNDLYYEEVGNTQLKPEKAKQYNIGLTYNKNVCSFLPYLSATIDAYYNKVTDKIIAYPTKNLAVWSMKNLGQVDIKGIDVTGSLSLQPGEKIRINLSGNYTYQRALDVTPPDPNTYESTYKHQIAYTPRVSASGQAGIETPWINLSYSFLFSGKRYALGQNIAENRLDSYSDHSISASRDFLIRKATTSFSLEVLNLMDKNYEIVKYFPMPGRSVRATIKIRY

SEQ ID NO: 17865 - protein, 793 aa, Campylobacter upsaliensis RM3195
MKKSIFIIFTLFASIMYGQNGTIKGKILDKQSELPLIGANVELLGAKISKGVITDFDGYFTLTDVPVGRKTIRVSYIGYETSTIPDIEVSTGKDVDVTVALTESYGSLDEIIITSSTNKIKSLNKFSAVSARQFGVKEVARYAGGRNDVARLVSNFAGVASPDDSRNDIVVRGNSPTGLLWRVEGIPIPSPNHFSALGTTGSPVSALNPNLLKNSDFITSAFPAEYGNAIGGVFDLGFRNGNKDEYEYSFQVGAFTGLEATAEGPLNRKNNGSFLVAARYSLIGLIGGAGTSDTPNYSDVSFNINLGKSKLGTFSLFGIMGTSSIDLIGEDFDEDDLFSAEDENSYVSSNIGVLGAKHLLSIGEKSYLKTVIAGASNSSDFEEDRIIDLATDNERIIRFAENNNEETRLTFSTLFNTKINNKFTLRTGLLLENFSADLDRKQRDEQEDLNGDGDPDLVTIRSINGSYNVFQPYIQTKYRLTEKLTLNTGIHTMYSDLNKQFVVEPRASMSYRIHPKHTINLGYGLHHQNIATPLLFLNEEVNGVITNPNENLDFVRSQHYVLGYDVKIAPSWRAKIETYYQKIDNAAIDGSPSSYSSLTEGADFTFSSDNTDLVSSGTGENIGLELTLEKSFSKGYHALITSSFFESTYKGSDGIERSTPFNGGHIFNFLAGKEFKFGENKKNIFSIDARFVTSGGNRFTPVNLEASQNAGYEVLQDDLAFSEQYEDYLRLDLKFAVTLNSNKKKTSHKFYVDFQNLTNRDNVFVRRYNRSTSSVEQINQIGFFPDFGYRFQF

SEQ ID NO: 17866 - protein, 195 aa, Wolbachia endosymbiont
SYYVRLQYNGEFLPLFTKVDGITYKKDKSDYSPLKPSFIAGGGAFGYKMDDIRVDVEGVYSYLNKNDVKDVTFDPANIIADSVTAISGLVNVYYDIAIEDMPITPYIGVGVGAAYISTPLELAVNDQKSKFGFAGQVKAGVSYDVTPEVKLYAGARYFGSYGANFDGRKTDPRDATKQVIDAGAYKVLYSTVGAE

SEQ ID NO: 17867 - protein, 158 aa, Wolbachia endosymbiont
SYYVRLQYNGEILPLFTKVDGITNVTGKEKDSPLKASFIAGGGAFGYKMDDIRVDVEGLYSWLNKDADVAGDTVADNLTAISGLVNVYYDVAIEDMPITPYIGVGVGAAYISTPLKTAINDQNSKFGFAGQVKAGVSYDVTPEIKLYAGARYFGSYGA

SEQ ID NO: 17868 - protein, 691 aa, Uncultured bacterium BAC10-4
MRNALYALLFNLYRLFCWSLVLMGMLPGAHAATPPDWSKGAYAYSAEQTPLSAVLQDFANGHGVDLVLGNIEDVNIEAKIRADNAVAFLDRLALEHRFQWFVYNNVLYVSPQDEQTSVRIEVSQDAAPDMKQALTGIGLLDSRFGWGELPEEGVVLVTGPTEYINLIRNFSQQRETKEDRRKVMIFPLRYASVSDRTIQYRDQRLVIPGVATILNELMDGNRNTPAGAAGAGSGIGSDGGMATADGAGGGLDASKSIEMNARSMLARLASRNSGAAASASRKKDQLNGRVSADVRNNALLVRDDEKRRDEYQQLIDKIDVPQNLVNIDAIILDVDRTALSRLEANWQGKLGAVTGGANMMSGSSTLFVSDFKRFSADIQALEGEGTASIVANPSVLTLENQPAVIDFSRTAFITATGERVANVQPVTAGTSLQVTPRVVGHGSTSSIQLVIDIEDGQVETNTEGTASGVKRGTVSTQALIGENRALVLGGFHVEESGDRDKRVPLLGDIPWIGKLFTSRQHEVSRRERLFILTPHLIGDQNDPTRFVSADNRRQLNDAMGRVAQRNSKTDLFGTVENALRDLASGQTPAGFTIDGSGPKLSEICRTSPSMSYQSNRYQWYSNLSLSLTVGVVKNTGTQPLRFDEASCANSRTLAVAAWPKTTLAPGESTEVYLALLPAKNAQPSRASLIKP

SEQ ID NO: 17869 - protein, 169 aa, Helicobacter pylori
  misc_feature (5)..(5): Xaa can be any naturally occurring amino acid
  misc_feature (145)..(145): Xaa can be any naturally occurring amino acid
VNLPXYTKVDGITNAKDKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARXFGSYGASFDKAAKDDTGIQNVVYS

SEQ ID NO: 17870 - protein, 348 aa, Neisseria gonorrhoeae
MKKSLIALTLAALPVAATADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQAYSMPSLFVEKLQVHRLVGGYDNNALYVSVAAQQQDAKLYGAKKANSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 17871 - protein, 327 aa, Neisseria gonorrhoeae
MKKSLIALTLAALPVAAMADVTLYGTIKAGVETSRSVAYHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATAAYRFGNVTPRVSYAHGFKGSVYDADNDNTYDQVVVGAEYDFSKRTSALVSAGWLQRGKGTEKFVATVGGVGLRHKF

SEQ ID NO: 17872 - protein, 213 aa, Vibrio alginolyticus
MKKTICSLAVVAALVSPSVFAHKQGDFVLRVGAASVVPNDSSDKILGSQEELEVDSNTQLGLTFGYMFTDNISLELLAATPFSHDISTDLVGSDIAKTKHLPPTLMVQYYFGESQSKFRPYVGAGLNYTIFFDEDFNSTGKGADLSDLKLDDSFGLAANIGVDYMINDQWFLNAAAWYANIETEATYKAGGVKQKTDVKINPWVFMISGGYKF

SEQ ID NO: 17873 - protein, 200 aa, Wolbachia endosymbiont
GPISDEETSYYVRLRYNGEILPLFTKVDGITYKKDNSDYSPLKASFIAGGGAFGYKMDDIRVDVEGVYSYLNKNDVTDAKFTPDTIADSLTAISGLVNVYYDIVIEDMPITPYIGVGVGAAYISTPLKDAVNDQKSKFGFAGQVKAGVSYDVTPEVKLYAGARYFGSFGAHFDKDAAAGKDKGELKVLYSTVGAEAGVAV

SEQ ID NO: 17874 - protein, 199 aa, Wolbachia endosymbiont
GPISDEETSYYVRLQYNGEILPFYTKVDGITNAKDKDKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVVYSTVGAEAGVAFNF

SEQ ID NO: 17875 - protein, 120 aa, Wolbachia endosymbiont
GPISDKETSYYVRLQYNGEILPFYTKVDGITNATGKEKDSPLTRSFIAGGGAFGYKMDDIRVDVEGLYSQLAKDTAVVNTSETNVADSLTAFSGLVNVYYDIAIEDMPITPYVGVGVGAA

SEQ ID NO: 17876 - protein, 199 aa, Wolbachia endosymbiont
GPISDEETSYYVRLQYNGEVLPFYTKVDGITNATGKEKDSPLTRSFIAGGGAFGYKMDDIRVDVEGLYSQLAKDTAVVNASETNVAGSLTAFSGLVNVYYDIAIEDMPITPYVGVGLGVAYISNPSKASEVKDQKGFGFAYQAKAGVSYDVTPEIKLFAGARYFGSYGASFDKAAKDDTGIKNVVYSTVGAEVGVAFNF

SEQ ID NO: 17877 - protein, 200 aa, Wolbachia endosymbiont
GPISDEETSYYVRLQYNGEVLPFKTRIDGIEYRKGTEVHDPLKASFMAGGAAFGYKMDDIRVDVEGLYSQLNKNDVSGATFTPTTVANSVAAFSGLVNVYYDIAIEEMPITPYVGVGVGAAYISNPSEASAVKDQKGFGFAYQAKAGVSYDVTPEIKLFAGARYFGSYGASFNKEAVSATKEINVLYSAVGAEAGVAFNF

SEQ ID NO: 17878 - protein, 278 aa, Wolbachia endosymbiont
GPIQCSIWATAEAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKAKIPATINHRRLFFFFFS

SEQ ID NO: 17879 - protein, 196 aa, Wolbachia endosymbiont
  misc_feature (4)..(4): Xaa can be any naturally occurring amino acid
GPIXDEETSYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARYFGSYGANFGKTAKDDGGIKVLYSTVGAEAGVAF

SEQ ID NO: 17880 - protein, 199 aa, Wolbachia endosymbiont
GPISDEETSYYVRLQYNGEVLPFYTKVDGITDATGKEKDSPLTRSFIAGGGAFGYKMDDIRVDVEGLYSQLAKDTAVVNASETNVADSLTAFSGLVNVYYDIAIEDMPITPYVGVGLGVAYISNPSKASEVKDQKGFGFAYQAKAGVSYDVTPEIELFAGARYFGSYGASFDKAAKDDTGIKNVVYSTVGAEVGVAFNF

SEQ ID NO: 17881 - protein, 199 aa, Wolbachia endosymbiont
GPISDEETSYYVRLQYNGEVLPFYTKVDGITNATGKEKDSPLTRSFIAGGGAFGYKMDDIRVDVEGLYSQLAKDTAVVNASETNVADSLTAFSGLVNVYYDIAIEDMPITPYVGVGLGVAYISNPSKASEVKDQKGFGFAYQAKAGVSYDVTPEIKLFAGARYFGSYGASFDKAAKDDTGIKNVVYSTVGAEVGVAFNF

SEQ ID NO: 17882 - protein, 367 aa, Uncultured bacterium BAC13K9BAC
MKKTAIGLAVALAGFATVAQAAPKDNTWYTGGKLGVSQFHDTGFYGNGYTDVNNNPIKSKLGAGAFVGYQANPYLGFEMGYDWLGRMKYAGSTANPADSASLKAQGIQLAAKLSYPVLPDLDVYTRLGGMVWRVDTHADRSGNHLNNDDTGVSPLAAIGIEYAIDKNWATRVDYQWVSNIGDAGTVGARPDNMLMSVGLSYRFGQDDRVAPVVAPAPTPAPAPVVETKRFTLKSDVLFNFNKATLKAEGQQSLDQLYTQLSSLDPKDGSVVVLGFSDRLGSEQYNQALSEKRAQSVVDYLVSKGIPANKVSARGLGKSQPVTGSTCDNVYKQGRAATKAQLIDCLAPDRRVEIEVKGIKDVVTQPQA

SEQ ID NO: 17883 - protein, 758 aa, Uncultured bacterium BAC13K9BAC
MNRLINITLIISISSVTLPVLSNDSEIEVIEVRAQKRVQPLQKVGITMAAFGEEQLKELGVTDVVNVAANVSNVQVNYGLGNNFFNIRGLGLNEFTSNLDAPVAVHVDEVYMSKGFMTGMTLFDIEHVEVLKGPQGDLFGRNTTGGAVNFFTNKPTSYFEAGVSVGYDNYDTLTTENFISGPLSDNLSGRLSMYITEQGEGYYYNTNRQDDEGAVKEKAVRGQLLWENDDGTSALLSMHYGKDKSELHPYEGVGNTLPDGSGFCPAYLDGTVQGDNANCLRGLDLIFNPGQDISQYYPGESDPYITQNNLSFTVDNESIGGLVRIEHQLDNATLSSITAYEQFSQDQREDSDGSPVTSVEVYWFTEFKQFTQEIRLSSDFDHNNWNYIVGLFYEHDDFDNADYLTAYLPFNGLNNYSKYNQKVDAVAAFAHIENELTEDLRLISGVRYSWEQTSLTGGTYKGEGLKSIGGEEQPVTITGVASTAANLSDGGQRTDENVTFKAGLEWSPQEDVLYYGSISTGFRSGGYSVAFAATQDELTSLEPEEITAYEIGFKSTLADRSLQFNGSIFRYDFQNGHIDVDAPNSPVPITINAAEIETIGAEIDLQWVPIDGLKLSSGVGWVDAELKSELTLQTGIGEVQLQGNRPAFNPKYTYNGQARYVWELHDGYDLIFASDWSWRDEQYLEVNNQPSNLIDDYWIVNARIALESTENDWRISLWGKNITDTQYVTYLNDLPAFGWLLRGYGAPSTYGATFEMKF

SEQ ID NO: 17884 - protein, 447 aa, Pseudomonas fluorescens
MNKSTLALAVAVGVLAQQAGAAGFIEDSKATLGLRNFYINTDNRDGAGANKNEEWGQGFDLRFISGYTQGTVGFGIDAIGLLGVRLDSGGGTNGNSGTAYGGTVFPSESNGKAVDNFSSLGLTAKAKISQTELKLGTLQPKNPVIVTNDGRLLPQTWQGGQITSGEIKDLTLVGGQIEAVKGRNSSNNENLSISGANSRGTGFRDSNKFIYAGGDYKITKDLTAQYYYGNLEDFYKQHFLGLVHNWAIGPGVLKSDFRYFNSSDDGKNGTDPAYFSTGNYTGVRNGRGEVDNNLYSGLFLYTVEGHTFGGGYQVSNGSSDFPWLNQGDGSSNYTITDMQIQKFGRAGEKTWQARYSYDFAKVGVPGLTAGVVYLKGDSIDTVGTNGRESASNRSEWERDFTIGYVVPEGPFKNVGLMWKNAVWRTDLPNTRSQDENRLIVSYSIPLL

SEQ ID NO: 17885 - protein, 736 aa, Pseudomonas fluorescens
MSRPDRLPLQARLSLLTTCCLLGVSTAHAAPDGAARKSDLQGDGSKAAGLLADAPPVLPDGEELEEVTVSGERIYRRRNAGSATRTDTALRDTPASVQVVPQQVIEDQQVTRLDEALRNVSGVTFNGLDTGTDGRFSIRGFENVPLLQDGFRQYNLVGLPETANLERVEVLKGPASVLYGEAQPGGVINAVTKQPTATPLYSAELQAGSFGLVRPRLDLGGPVSADGTLRYRLNTVFESKASFRNYTQQYRKFFVAPVFAWQLDERTRLNLELQYQYSERPWDGGTVALGTGVVRVPRERTFNEPDDFIRRNFLNTGLTLSHRFSDNWSLKSAFRFTENRIYSDKLTIPIFFDEASGTLGRVFAFDDFRSRDYSLQNALTGKFSTGTIDHTLLLAVDLNRNDFTQVATGDLFNPTLINVFNPVYRAVPRPDKAQMGLLFDQQAQTDRLGVVVQDQLSFSPDWKLLASLRYDSVRQKVEDVPALFTPTGLGSFQYNDAFTPRLGTLYRPLPQLGIFVSYARSFNPSVNAFAFDGLPLPPERGEGYEAGLKADLGANLSATLAFYDLTRRNVPTPDPAFPGLGFVLATGEQRSRGVELDLAGQILPGWNVIGFYSYIDAQVSRDSIVPVGNRLPGVPEHSASLWSTYQLQSGAAQGLGFGLGFNYVGERAGDLDNTFYLNSHFLTNAAVFYGRGDWRLAVNFKNLFDVDYIDGTPIGRVSAGVPGEPFTVIGSVSARF

SEQ ID NO: 17886 - protein, 403 aa, Pseudomonas fluorescens
MHKSLATSSKPLAAHVAFAFAALAAAGAPAAVHAQSSVTLYGIIDEGINYTSNVQTGPGQGHSQYNLSSGILSGSRWGLRGNEDLGGGIKAIFVLESGFDVNSGKMGQGSLLFGRQAYVGVSSPYGTVTLGRQYDPVVDYIHPLMPSAMFSGSIGAHPGDLDNLNNTNRVNNAVKYRTASYGGLTAEGMYSFGGVPGSMAGNQIYSLGAGYARGPLTVGVGYLNARNPNASFFGTAVGATAATNNFGSSPVINGYASAHSEEIISAGATYVIGAATLGGIYSNTKFKHLSGAVSPLNPAGVGGTASFNSAEVNLQYQLTPALSFGAAYNYTDGGDANHAKYQQGSLSADYIVSKRTDFYLIGVLQHASGTDSTGRAARASLNGLTPASGNQQATVRFAIRHKF

SEQ ID NO: 17887 - protein, 443 aa, Pseudomonas fluorescens
MRASILAMATMAGVVALPCASAAGFFDDSKATLGLRNFYFNQDYKSGAQAPSKQEEWGQGFMLNFRSGYTQGPVGFGLDALGMLGVKLDSGGRTDKAGRSRNPGQLFPLDHDNSAVDHYSSLGLTGKLRISKTEAHIGTLQPRLPVVVFNDGRMLPQTYSGGQITSREFDNLTLIGGTLERAKGRSSTDRQALSVPGNTTRRSNKFHFAGVDYRVGKDLLLQYYYATLEDFYEQHFLGLTHTLALPVGSLSTDLRYFHSEADGENASRAGRANGWTIGDARLSSDPEKGEVDSRLWSLQSTYKLGGHSLALLYQQNEGDSDLPYLNQSDGATSYTAATRQIGGFSRAGERVLGTIYTYDFAALGIPGLSARLTYNKAWHIDVAGQSRGEREWERDFRLDYVIQSGPLAGVGFAWANAALRSHVSSQRDINENRLIVLYSIPLL

SEQ ID NO: 17888 - protein, 847 aa, Pseudomonas fluorescens
MRVENMKNRAGQPVIGGRRKMLPVAMLAITCNGAAWAQGATAPTEASDVFAAAPEAQPTQTSPAPAPPATSQSMARPPAGRQPGSVDTVQQDTVVVTGTRTTTKASQSLTPVDVISGAQLQATGQSSLRDALVKLSPSISRETYAGDTAQLTDALSLHGLTPDHVLVLVNGKRRHTTANIALDGGLNQGSTGVDVDMIPVGLIDHIEILRDGASAQYGSDAIAGVINIILKKNSRGGTLQTTTGQTYAGDGLKNGESANIGLNLGDRGYLDLAAEYDRQNHTVRTGPDDNFGEFQPGHGFRNPIEGDPASTRESVGFNAGYYLGDDVELYGFGTYAHRDAQAYQNYRAPSVLPTVYPNGFVPTETVNENDYSVTAGVKGQNLLGWSWDLSTTYGGDHDGMGLTDSANTGLYAAQGFTPTSFRLVTVSNTQLTNNLDFSRAFHLPLLAAPVNVSFGVEQRRETYTIGSGDEYSYLLGGAQALPGLAPVSASDNSRNVLGTYIDLSTHLAPKWTVDLAGRFEHYSDVGDTHNGKISTRYDFTPQIAVRGSVSTGFRAPSLAEEYYSNVNVSPASVSGLLAANSAAARLIGAQSLKPEESTNYNVGLVLTPVKNLNLTIDAYQIDIRNRIVEGGTASGQAAIAAMGAAGLSVPGTVPASAVSASYFTNGASTRTRGIDLTGTYHTGFGEYGQVDWDLGVNINNTSVKHVSAGANGQPELNAQQIGWLSTSTPKNKIIIGGTWHSGKWGVTLHETRYGSTSSQETYIVGPNAFSTTQFLHFENAARYITDLEVRYDVTNKFQIAVGANNLFNVYPNKLPYEAQLEGSQYDSFASTIGENGGFYYLRARYQF

SEQ ID NO: 17889 - protein, 341 aa, Pseudomonas fluorescens
MRINKPLLTTLPILCFTSFAHAQTVYDDQTNKLDIYGRVEGQIINNSDDTLGKLGGRLGFDMSRELDVIENSRVIGKFEWQVRTETNDTRLDAGEDLEARYNYIGLENDNWGMVIFGRTKNPLYQVMKMTDKYKNYTPGIYNFGISSIDTSYKYNRQDATLQYNGEFGIHEIQAAYVFGNGENERLDHGVMTSYRMNYKGDGFKISPAIALSQYQRDNKNTSTKRKQHDQILAGIEASFNQFTFSLTGNKTNIELDNGGDEKYFGLDSLIAYKWDQFQLLAGYSFLDEKNEDIYEKEDWRVEGQWTLARRTFLSLTFDRELAAKNTSSEDKSITLGLRYDF

SEQ ID NO: 17890 - protein, 293 aa, Pseudomonas fluorescens
MIFISCVYFFITYISNDTHIEQVQPLKLETDNNKSVIRSEEVTAKEIPIKYQELESSPPSVFQVADQKNMWSRIADQAEPTKEKSKKLDFYVSANGGKVYHDNSEIFVKGIQEIGKRVLTLVESHYGFIIKNIVADEMKSIQQFDGKIDFQWFSSMSLGYYAGENGKIDFEAAYSIANIEDSNSPPVFDKSASIFAFLLNFYYNPSVQDTQFAPYIGLGIGPTVFRLKRINGSPQSSMPLNVPWFAYQIKLGVDYSIIPEIKTFLGYRYFSVPIPVADDISTHNIEVGLIFNF

SEQ ID NO: 17891 - protein, 140 aa, Pseudomonas fluorescens
TGDSTMVYRLGLQSNWDASWWQTSVGRLTGYWDGAYTYWDGDKTASNHSLSFAPVFVYEFAGESVKPYIEAGIGVAAFSSTELESNELGSAFQFEDRIGFGLRFAGGHEIGVRAIHYSNAGIKQPNDGVESYSLHYRMAL

SEQ ID NO: 17892 - protein, 420 aa, Pseudomonas fluorescens
MFKTSHLGGMAFSLSVLALAGGMPSPAQADFFADSKASLLIRNYYYNRDFRQEGGSSTGQSHADEWAQGFILNYESGFTEGALGFGIDAVGMWGIRLDSSPGRAGTGLLPVHNDGDVPNDYGKMGAALKLRYSKSLLRYGTLFPRMPTVMPNETRLFPTYFRGASLVSQEIDGLTLNVGRLTHLIERNSSASEDITMVNKGMEGLDPTDQFDFAGIKYKWSDNLTTAYDYANLDNNYHQHFFTLNHRLPIDGLRSLATDLRFARSSDDGDSNVDNKAINAMFVYKQAAHSFGLGYQKMIGDTGFAYIAGTDPYLVNFAQVNDFANPGEKSWQLRYTYDFATLGIPGLTFMTRYLSGRDIRRVDGSKGEEWERDIYVDYVFQSGLLKNLSLQWRNAVLRNDGSGNDLDENRLIVTYTMPLL

SEQ ID NO: 17893 - protein, 125 aa, Pseudomonas fluorescens
MWKYVRSAPGYARRASAYTQPHNEKSAKTSRAFMNNKALLGLSQIVLSISAAQAAMAAEEKGEGFIEGSSLSILNRNFYFNRDFRKGQSSSTGNGYSEEWAHGVIGRFESGSARPRTITPSSAAP

SEQ ID NO: 17894 - protein, 360 aa, Pseudomonas fluorescens
MPMNRICLATLNRIFRIAAPVAALTIGAHAHAQSTVQLYGIVDAWAGYQRVPGNPGAAQLGGGGLSTSFWGFGGQEDLGGGYKAVFAIEGFFRPQNGRFGSFDGDPTFSRNAYVGIASPYGALALGRQSSLLYLQSAKFNPFYASFTFSPTIVQLYSSLGTYPGFPTDQGIPGGTSWSNAIQYSTPDLGGLSGAAMYALGNEAGENGAKKFAAQAQFTRGALALGAVYQYLNFSAAPGDLGKLLKGFRSQTTAQLGASYDLRIVKLFGEYTYVANTLAGGNFHVNMLQGGVTIPVGIGRILASYAYSRDNSALDQARSTASISYDYPLSKRTDVYAGYLYDHVSNLSTGCTYGAGIRTRF

SEQ ID NO: 17895 - protein, 119 aa, Pseudomonas fluorescens
MSRSSDNDQYRSRNALIRRHIEKMDASLHVGTKEFDISKVSEVDSVDDLLIDNAARYLLKDWKGVGELVNGVEVALEYTAERGIALLKQNPELYWQILAEAASIAQGKEQQKQDTIKKP

SEQ ID NO: 17896 - protein, 438 aa, Pseudomonas fluorescens
MRVMKWSMIALAVAAGTSQLAVASSQDESKGFVEDSKLNVKTRMLYFSRDFRNAPAGTKSRAEETGLGFHGTFESGFTQGTVGVGADAIGLLGVKLDSGKGRAGTGLFPTGSDGRSEDDYSKGYGAVKFRISDTVLKYGGQYTAMPVFATDDSRLLPEVAEGFLLTSKEIKGLELNAGHFTRLDAQAASYKDSIGGLTRDRQKRPGLTEANVFGGTYAITDGLSTSLYYSRIEDHFRKWYGNVNWALPISDKQGLVFDFNIYDTKSIGENRTGAAVAKADGTNELDNIAASLSAAYNIGAHTFTLAYQKISGDGDYAYGVDGGGTVFLANSIARSDFNAEDEKSWQVRYDLNFAEYGVPGLTFMTRYARGTGATTETTDNGKEWERDIDVKYVLQSGPAKDLSLRVRQATYRSSDGVYYGSNSIDELRLIVEYPLSIL

SEQ ID NO: 17897 - protein, 697 aa, Pseudomonas fluorescens
MSPRCKHYPAALNIFYFAIIMAVSMLSNAVHAQTTSAGTKSESRLASADLKEITVTATRTSRKVSEVPESVSVVDTEQIRTRQAADIGDVLRYLPNVELGGGPRNLGLSPVMRGMGDDRILFLLDGARQDFNRGHNARIFTDPSLLKRVDVMRGPASTVWGSGALGGVISLTTLDATDLLRSGERFGMKVRGGFQSMNEQYIPGISAYGLVGEQFDYLLDFSYRNAADDIRHGDGSKLQNSRFESYASLAKFNWTPGDHRFTFSAQTFDQAGKVPSNPQAASTANTLVDRDTEQRNYTLRYRYENVDNAWLNPEVLVYHNTTYSLEKRLFDRRRDETDFSTTGINARNSSRLELNSFTTQLITYGVDYFHNEAKGKRNGATRPEFPRGEADVVGLYLQDEITLWERLSLIPGIRWDYFSSKADGISVSSNQNDRVNFKLGGLLKVTEWFSITGGYSEAFRAPTLGELFTTGTHFTCGPRCSNLFTPNPDLKPETAFNKEIGARIQKSNLLFENDQLTMRGTYFHNKVKNFVDLMVDFVFRPVPGNPGRGGTTTSDNVHDALLKGFEIETSYAAKYSYTGFSYAQTRGHNRTSGGVLSNVQPDKWIVMAGLNWPTHDLSLGWRSSIVSAQHRVPTGGTPTPGYTLHDLTLTWLPQNGPAKGLRFDFGIDNLTDKDYRRHLNVLKDPGRNYKLAVSYQF

SEQ ID NO: 17898 - protein, 636 aa, Pseudomonas fluorescens
MKKQHLLFATFILAGSLTVSGQTPDTADSLSAQRTLTIDEVVVTGTRHQTDIRHLSQTVSVVNRKRIEQSMQPSLLPVLTEQVPGLFTTSRGVMGYGVSNGAAGGISLRGLSGGNARLMVLIDGHPQYAGIFGHPIADAYQTLLADRVEVLRGPASVLYGSNAMGGVVNIVTRKMHEDGIRTHLHTGYGSYNTLETELTNRIRKGHFSSVISGSYNRTDGHRADMGFEQYGGYGRIGYEVTDHWNLRADVNVTHFNASYPGPVSAPLLDGDQHITRGMTSFAVENEYGKTSGALSFFYNWGDHWINDGYTPSAGEGPQDDRFNSYDDMMGISWYQSARFFKDNRITVGFDWFRYGGEAWSEYVSGEDAGTRSDLVDKHENEVAGYVDFRQDVGKWLTFNAGLRVDHHSRVGTEWVPQAGLAFHLPHTIELKASASKGFRYPILREMYMFPPQNPDLTPESMWNYEIAFSQRLLGGSLSYGINLFYIDGKNLIMTLPNPSGSGMLNQNSGEIDNAGVEAQVAYRFNKSWSVDANYSYLHMENPVIAAPEHKLYAGANFTQGRWSVSTGIQYIAGLYTSTDPATTEDFVLWNLRGQFRATPWLDIWARGENLLAQRYEINAGYPMPRATVMAGINLNF

SEQ ID NO: 17899 - protein, 362 aa, Pseudomonas fluorescens
MKKVMLAAVLATAGVAAHAQSSVTLYGRLDAGIEYMNGLPSANGGSTSRWRAESGNWGTSLWGLKGSEDIGGGNKIVFQLEGSFDTMNGNGPGAGSIWNRWATIGISNDTYGTLLLGRELAIANGVWDFDPFGQSSWSTASLVRGRNWNKTSNNISYQSPKFYGFDVYGQYALSNATNWNGNGSTSQGRSAGLQLTYTTSLFQIRGLYDEARDPANGKLDDVFNYSREYFAGVNVFLGQFKLQAAYQASHADGGPVVNNGITTTQQVWGGVTWQATPAAALIAAVYHVNANHGGGNANIFTVGGSYNLSKRTLLDVQVATVRNSKTANFGLNANPAGTDISTGNPKFGGSQTGVYAGIQHLF

SEQ ID NO: 17900 - protein, 347 aa, Pseudomonas fluorescens
MQRLSAPALVAAALALPSLALAQSNVTLYGLIDLNLGYEKSGSQRYEGIGHGELNGSRLGFRGTEDLGNGNKALFVLESGFDPSTGVAEQGGRLFGRQSFVGLENGLGRVTLGRQYSPAFDALDPFDATGNADRSAGLLIRKAGAVKPAYETRFDNMIKVRSAKLAGFELEGGYWFGKESGTDSTARQEGDGHGIAMLYANGALAGSLVTQTVQRDASGGKVRTDGFALSYDFGIVKPYFAWSQDKERGSVGNGKARSWDLSAEIRLDPANTVAISYADRDESDGAASEDASGWSAYYLHALSKRTTLYAGYSQLDNEVGANYAIGNLTPAAGDKHQVMMAGMRHRF

SEQ ID NO: 17901 - protein, 712 aa, Pseudomonas fluorescens
MKPLYQYSLLRRAILVAMLGVTGTASATTLIDKDTFIDANSPVNENYRIENGATLSVNGATTGNITISDGHLAMNGGSVNVLYGEYGATADIADATLKTAALQGDSRLSRTVIEGQLSIWFMNLSANSISAQQFYAAGAQSTVEKGYFEQTERMYAGAVYLTSSEGIFTDSVIKGIKTAVYLEGNGSVDLIRSSIWATEGSAFDIARGNQKILLQGSSASSQTGELLVARTGSSVNLALDTSHAAGDIRAEGSAIVDVALTNGSVLSGGMTNVNSLMLGNASLYEMTSSSDIRTLSMAGGMVKFAPAEAGEHHTLTLGSLEGNGHFMMNIDTENGSSDLLDVTGHAEGSHTLHLAASGREAENTDPLTLVRTGGGDAEFALNGGRVDMGAWQQELVRNGNQWELVQAKGATSASTDAMLAMASAPQFMHQGELKVLRSRLAVKDTDSAAGVWGAMLYNRSDIEGAQGSAYRLTQNGMILGGDKVTGTRAGELTTGAYLSQSTGNIKHARGGDSKVTGYGGGVYARLSAENGAYASTSAQIGHFSNKLNARMSDGGTARADWNSLGYGLMVETGRQITVGETTSLTPFVGVNAWLTPSENVTLSNGMTAETGDNRSLLAEAGVRMSTRLDVAEMAVTPYVTLAVQQELVKSGSTQINDAYDFTNDFTGTGGTIAGGISVAIAPTASVWLEAEYGKSEQTESALAGNVGFRVAF

SEQ ID NO: 17902 - protein, 739 aa, Pseudomonas fluorescens
MPAQFKTRPRTLVSALTCSVFLTPLLASAETAPASAPAADVPATLPTIAVQSSALSDMQVKRSPSYKFTAPLLDTPRSVTVIPEQLIKEKNVTSFADALRSVPGITFLGGDAAANPSADRPVIRGFESRNSIFVDGMRDSGLQNRETFAVEQISVIKGPDSVYAGRGSVGGSIDIVTKTPQNDNFINSSIGFGTDGYKRATVDANRKINDTTAVRLNVMGHDANQAGRNDVYNKRWGVAPSIVFGLNTPTTVTVSYYHMNSYDMPDFSVPFRASGGTPVPTDRGQFFGLNTRDYRYGQTDTGEIRVEHKLNDTWKLKNTTMFGRSTLDYVATNPQILASNPNMLGLQAKSGKYALNGFSNQTEVTGSASLFGMKHTMTAGVEFSHEQARYEGYLVSDSAGNNIRSNSPCAVVGNCTPLAGGWNPNMPWTGSIVLNGDKGFPGATTNTRTDTVSAYIFDTVKLSERWQFNTGLRFDRYDTTGKQAGVADLSNTSNLFSYQFGLVFKPVTNVSLYASYGTSSNPPGSNGGLGGGTDQITATNQDLAPERARNIEIGAKWDVLQDQLSLTSALFQTEKTNARVSDGLGHTVNAGKQRVRGFEFGFAGNLTQKWHVFGGYSYLNAITTDAGPGSPGASGLPMVMVPKHNFTLWTSYDVMPKLTLGAGATVMSKTYASVSPTVKKWTPGYARFDAAATWRVNKTMDVQLNVQNLFDKQYYASAYPIYATWAPGRSAMVTLNFYQ

SEQ ID NO: 17903 - protein, 434 aa, Pseudomonas fluorescens
MRISQRTFRQHAAVCFRSQKSIPFLPFYCASVVSCPLTNDTSIRKEIEMKRTTLSMIAAAAFAAMPAAHAQSTVTLYGVIDTSITYVNHAQGSDNAWMLGNSSAGNLAGSRWGIKGSEDLGGGLKALFQLENGFDPSTGRQGQGSRLFGRQAFVGLSSERYGTLTFGRQYDPLIDLVQGITADNYLGSVFATPGDVDNYDNSFRVDNAVKYTSPVYAGLQFAAMYSFGGIAGSTGAAQSYSAAVSYGNGPFSVAGGYFHATNSPASNGLRSGWTSSSDGTFDGPINSGYATAHSIGIARVAAQYAAGPFTFGVGYSNAQYRRDASSVFGSNEHYNTGQGFVNYQATNALLVGVGYSYTRSGGDTSATYRQVSAGADYSLSKRTDVYLTAAYQHASGQTGDGSGSAMAAQASIGSYGYAGTSSQTMVNLGLRHRF

SEQ ID NO: 17904 - protein, 745 aa, Pseudomonas fluorescens
MIDRSLALRLLPASTLALAVAQPAMAQDTVDSSDSEATGAEQPDNGALDVIVVTANRREENLQDVAVSAATVSADAAQTIFDAGADVTALSARVPGLFVESSNGRAAPRFYIRGLGNTDFDLAASQPVSVVQDDVVLENVTLKSFPIFDVERIEVLRGPQGTLFGRNTPAGIVKIDTTKPGDELAVRGSASYGSFNSVAIDGGVTVPIVPGVASVRLSGLWQQRDDWVDNGFTGQEDVYGAYSDIAGRAQLLLTPTDRISILGSYAVRNLDGTSTLFRANILGPGSNDLNENYDRDTVFYDAGAGNQAQYDAEIATVKADYDADFATFTSITSWASSEGSSRGDIDGGNLVDGPGFIPFPSDTRDSIVLDQFTQEVRLASNSGGIIEWQVGGFYFDSDFDVTTVGFDFPPAVTVNHTNESWAVFGQVTGQVTDLLKLTGGVRYTEDEKQFAVTQTSFISGPGDQARSVEDERISWDVAAFYEVSADASVYARVASGFRAPTIQGRDVAFGSAPSIASSEKIMSYEAGLKSELLDRKVRLNLAGYYYTITDPQFSAIGGADNLVQLVNSDKGRGYGFELDSAFQVTPDFLITAGASWNNTKIQDDNLAVGICAQCTVTDPIVTLSGTDRALVDGNPFPNAPEWIADVSARYAVPVSLDGELFAYTDWTYQGATNFFLYESLEFNSDNQIEGGLRVGYARFDGSLEVALFARNITNEDNVKGGIDFNNNTGFVNDPRVIGLSVRFQH

SEQ ID NO: 17905 - protein, 592 aa, Pseudomonas fluorescens
MSRIFRGLALASPALVVGTFAGSATAADAVLATSSDAQLSAPTAAAESLAPLPQSTTLIAQNHGNKLPLPSVADLEVGRAATPSMGQVTSVSQLSDVRPTDWAYQALASLVEKYGCIAGYPDGTFRGNRAATRYEMAAALNACLDVISDRFATKEELATLQRLMDEFKAELATLRGRVDKLEARTAQLEAQQFTTLTKLNASVIFNISDVLTNTQALAPGLPGPPPVLNTNPVANTRVRLNFDTSFYGKDRLRLRLQASNIVNYATAAPTGTNMGRLGYDGFPTPPGSGAFELQKAFYSFPVSRRGQLILDFKGGEFNDNFNNFNPFLQSSDTGALSRFGRFNPIYRAGNAPNAAGVSFKYDIVQNEERGTGVTLNVGYLAPAANAPTGVAGFFDGAYAALAQVDVRPVKNLALGVTYTHSFGLDPFGATGSSGPRSAANPLSSVLATNNVPNQAADAVGFQFTYRPIKQFNVAGWASYANVYGVKPPAFTPPALRHEAEIVNWAITFASPDLWRKGDLAGLVFGQPPQLISTNVPGPPVTAFNSYHLEAFYRFAVSKNISVTPGVIAIFNPNSNSANDTLVVGAIRTTFSF

SEQ ID NO: 17906 - protein, 927 aa, Pseudomonas fluorescens
MYKRSALSSSIAIAVALTSQYSLAQNEADASLEEVIVTGIRGSLTKALDMKRENTQIVDSIVAEDIGKFPDNNVVEALQRVSGVQVTDRGAGEVNTVSIRGLTDVTTTVNGRQIFTSTGRSVALADIPASLVAGVDVYKTRSASQIESGIAGQVDIKTQRPFNFDGSKVVIAARGTYQEQAEKTDPNLSALFSNRWETSAGEFGALLNVSFAQTNYRDQSVTPGAQVPFMTANAADGWVPFERIFPTDGRVTESPIWEGGLEEGLPATEGSTLTMNGEEIEYLLSRDAIFASDFTGKRERPAYNVAFQFAPNETSEYLFEAFYNGYRNESFNSLLFSFADWWGSLDPADEVVTYPGTNIVKERTVYNPYGFNSGDLTVSQTDSYVYALGGNWDIGDNLTLESEIVHQTSEYSSDFFAMRTDRVAHGIDVDFNSSGGLPAWAFIDNPETADVNEADLTDSAQWNVAELYDNGVEDKGTSTTFTVDGSYSLFNSFFTNIDFGASYDVRTAQSANRDINGFLGQPLSSLDAGASYVTEDFYDGRADIPTTWVVPNGHYIYSHRDEFRDLYGFTSEENIEKLSLKTNFDIEETTTAVYVQTDFETELGNGTLGGQFGVRYVGSSADMSFFDNEDSSTADRSDSALLPSLVLKYEFANDFMARFAYTETLRRPAFGQLNSFIYYNESVTNTDGTATGGNPDLKPVESVNLDLSLEWYFAEGSALYGTLFQRNIEGFVFDSRQRVSYQGPDDTEASDYILSLPDNASNGELNGLELGLVYFPDNLPNALDGLGVQASYTMLDSSQDVPVFGADGELEKYLTRSMFGVSDNSYSVVVAYEKEKFSARLSFLARDNFLNNYEAAVFANPLGVYRKPEKSMDLQLSYDVTDDLMLTFDATNLTDEVFQSYYENPQTNNLGNAIYSRTFSLGLRYTY

SEQ ID NO: 17907 - protein, 742 aa, Pseudomonas fluorescens
MKQLTVIFVVFAFSLQSVAQSLKGKIVDQFNEPLENVYVVNDATNTHTHSSENGNFTIEKTRVNDVIQISILGFEKKNIIVTQDNLKNGILIKLETRVFQLEELVLRKEINALQTITKIDLQVNPVNNSQEILRKVPGLFIGQHAGGGKAEQIFLRGFDIDHGTDITLSVDGMPINMVSHAHGQGYSDLHFVIPETIKNIDFGKGPYYANQGDFNTAGYVNFATKTGIKDNMISVGYGDFNSFRTVAMFNLLENSKKDDAYVAMEYIETDGPFESPQNFNRLNLFAKYNTFLSDGDRVTLTASHFTSQWDASGQIPEREVANGNITRFGAIDDTEGGFTSRSNINIQLQKTLANNSILEANAFYSNYNFELYSNFTFFLENPIDGDQIKQFEDRNIFGMNAKIITEKNYGDIEAKFTKGGGLRFDNITDNELSSTKNRQEILNRIQFGDVQQTNAYAFINSEFEIGKFKISPALRFDYFKFLYNDNLSTTYETLSKTKAIVNPKLNFLYTQNNNLQWFLKSGIGFHSNDARVVLQDNADKVLPRAYGADFGNIWKPTKNIVLNTAVWYLFSEEEFVYVGDAGIVEPSGKSERYGLDLGIRYQITDNIYFDSDATITKARSLEASAGQDYIPLAPNFTLAGGLAFNNLGNFSGGLRYRYLADRAANEDNSIVAEGYFVSDLNINYNLKNITFGLAVENLFDVAWNETQFATESRLQNEANSVEEIHFTPGTPIFAKATITYRF

SEQ ID NO: 17908 - protein, 346 aa, Pseudomonas fluorescens
MKVMRTTVATVVAATLSMSAFSVFAEASLTGAGATFPAPVYAKWADTYQKETGNKVNYQGIGSSGGVKQIIANTVDFGASDAPLSDEKLAQEGLFQFPTVIGGVVLAVNIPGLKSGELVLDGKTLGDIYLGKIKKWDDEAIAKLNPGLKLPSQNIAVVRRADGSGTSFVFTSYLAKVNEEWKNNVGTGSTVKWPIGLGGKGNDGIAAFVQRLPGAIGYVEYAYAKQNNLAYTKLISADGKPVSPTEENFANAAKGADWSKTFAQDLTNQKGEDAWPITSTTFILIHKDQKKPEQGTEVLKFFDWAYKTGAKQANDLDYASLPDSVVEQVRAAWKTNIKDSSGKPLY

SEQ ID NO: 17909 - protein, 756 aa, Pseudomonas fluorescens
MALSSLLAAPLSARPVRIDIPAADLGDALFALSRQTGLSVGMAGAIPRHRTRPISGTIEPAAALERLLRGSGLRAVRAAGLWRLERLPREVTRSGFVGPTEAIEDIIVTGTKRDENLASVPIAVSLMRPGIADRLLYGRGLHDMIETGEGAFATNLGPGRDRIFLRGVADSAFNGPTQSTVSLLLDDARVSYATPDPDLRLVDIDHVELLRGPQGTLYGTGALGGIIRIVPNKPDLADGSGFAAIDAGVTRHGAASGAIEGGINVPLFRDRLAIRMVGYAERIGGWIDDAGRGERNVNRTARYGGRLALRWQATPDWMVDLGGAIQGINSDDSQYAARGLVRSTALAEPHDNDFVALTATVRGVVGAFDFVSASAFVHHEVESVFDAGAVAAARGLPAPLGFSDMRRLRLGTQEWRLSDPAATRPWVLGLALLKADNIYLGRFFAPGGGALQDISLHDDAIEAALFGEASQPLGGALTATLGLRGFYSKVDNEQQGQTRRRARKAGVTPSATLSWAPRDGALAWLRYASAIRPGGLNPDGAPDLADFRSDDLKSVELGWRLLLWRRVRLNGTLFGLRWENIQSDSIGTDGLVRTINAGKGRNIGLELGGSVDLSPWSIDAHLTVQHARLYAPSAAANAAGDDNRLPVLPDRAGRVKIGYDRVIAGIPAGLFVAARYMGKARLSFDPGLARSMGGYWTADAGLVVAPADWRVALTVSNLFDGRGDSFGFGNPFSLRQFDQHTPVRPRTVSIRIERKF

SEQ ID NO: 17910 - protein, 736 aa, Pseudomonas fluorescens
MSIFKPFTFKPFTFKSLSFRSDTLKRVSPVALAISTALTSGYAFSAEPANEPTTSDEMEVIVVTSDFRGASLDKMPSSITVIDQQQIEDEGAQHFEEVLNSIANFNWSGGSSRPKYFQIRGVGEQEEYQGAPNSSVGYIIDDIDMSGLGMISSMYDLQQVEVLRGPQGTRYGANALAGLIYLKSNDPTDVFEHGAEVSMGDDDLTTFSGFSSGPLTDSGKLLYRVSLQQHKQNGYRDNLYLGRDDTNGRDEFTGRAKLRWYATDHLELDLTLLHADYDNGYDAWTLDNNGFDTLTDEPGVDKQRTTGSSLKMTYSGAESFELVSLTSYAQTQHHHGYDGDWANPDYWGDLTCYGEACQYDYTWNKEGERKSVSQEFRLSSTEAGRIFAGSTDWLVGLYGMKLDEDNDTLEIYNGWEDPLTAEYEAENLAVFAQIDSDLGNDYSLSVGARVESRDSEYADSAGDAFNPSETMWGGHIALSKAISLTQQAYVRVARGYKAGGFNMSLPTELSDKKEYDTETLYNYEIGLKSNWLEGQASTNLSFFYMDRRDQQVSASQQNPDEPQKFILYTENAGSSHNYGAELEGNWYATDNLKLYATLGWLETAYGDYEYQDKYGGTVDLSGRELAHSPNFTYSAGATYRTDSGWFANLTTSGKSDFYYSDSNESKSDAYTIFNARMGYETDLWSAYLWGRNLFDEQYGTRGFYFGNEPDQDWADKQYIRYGDPRQLGLTVNVKFM

SEQ ID NO: 17911 - protein, 700 aa, Pseudomonas fluorescens
MKTSRFAICALAGAVTLALHTPAFAQESTIVVSGAEQDSALPGWTNSATKSAVAESKTPQVINTISATEIAQRHANSVNEILRYAPGVSTEVRGNTSYMSEYKIRGFTVEQEYYNGLQLPYNVTGNTKARIDPLLIESVDILKGPASVLYGGGSPGGLVNIQGKKPQKNQHTEVGFTTGTRNLKEGYLDSTGQIADSDWNYRLLGKATEGDGQPHTTRTENYLVAPSVTWQPDSKTRLTLDALAQNTPSLSPSNPLPLSYLRSKYADRRDYAGDEWSGFKQRQWMLGYSFEHEFDSGWGFNQKARYFDVDTHQRSVYSTGVGSELYQLNRFAYTTDEDLHSFNMDNQVTKTVTLGEWKHHLLAGFDYQKLNSHFHYRYASATPGIDMRDPDYTQVSESALGLYTAQKNRLSYQQNGYYLQDQVEFGGLNLLGSLRYDDYRSVTTNYLQNGDKAWVSQDRVTKRLGALYAFENGISPFISYSEGFAPVSPQGTLMAKDVKPTTSKQVEGGVKYLLEEYATTLTASVFNIRQKNVVTTDPGFLNYRQTGEVESKGAELSVVSRPTDNLTLIANYAYTHAINTEDDKYQGKRPTQVPENAFNLWGDYTFDSTPLKGLNLGAGARYTGPMEIAPANDQGKLGGTTQYDLAASYSLGEVMPSLEGLTLKASAQNITNKETFTCYDATNCWIGRDRTYQVGASYSF

SEQ ID NO: 17912 - protein, 983 aa, Pseudomonas fluorescens
MGSRRIAPCACAAPLSLCLEVTMRRCLFLSVALALHAGAAGAQTPPVAVTAIPAQPLARALNTLSRQTGLQFVYAASVGAERQSRGTTDGAAPEQALQQLLDGTGLRYRYLTPTTVTIEPDTATSQAPAAAVPAAPSSTPIAAGAPVRELDSIQVLGSYAGSLSAALREKRYADSVVDVIAAEDIGKLPAQNVAEALQRVPGVSIVRDRGEGVYVRVRGLGPNFQVTTLNGQTMAVNENVRTSGQTGRQFRYDTLPAELVSGLDVIKSPTADLDEGAIGGIVNVRTFRPLELGKTLLNTSLESSQAQRTHANDPRVSGLFNWVNAQGTFGMLVSGAYAQRSLRQDRVNEVSWDYYPNGVPGAPGASYLPTGLRPTLELEQRERTGVAASLQWRPSAAWETNLDLLYARQTVHYDEYSLGVGFDGVSKMSNLQVDHGGVTGFDYRNGQVQVSRETSGITDDNRSARLSSTWNGDLWTLGAVAFHSQAHSYDSDPIRRTRLRSGTNLSMRVEMPQADDDNVPNWSFTNGFDPTNPASVNGRRLEWREIDARDKEDALQLDAKRTLGDGWLRDIKFGAKYRERSRTYDRADLLLNRIAGVRFPGSYFTALPVSDMLVDGKGTLPRQWLAPIEAPFWGDWPTAADLSGTPNSADLQNSYEVREKIGSAYAMTDFGGTLAGRDVRGNLGVRLVRTEQTTDGHADLDGAAQPVHFERSYTNALPSFNAAWDVRDDMVLRTSAAKVITRPDLTDLSSKLTFNSSGEVLTASGGNPALRPFEAWQYDLTFEWYIDGTSALTGGVFYKDISSFIQTQLSYLDYQGQTYLLSSKTNGSQASVKGVELAYQQVFTGLPAPLDGLGMQLNYTFTDSQASYRDGTRRFTDSLEGVAKNTYNAVLFYEKGPLMARASYSWSDNIVNAVGTANVATLNSDAFGSLDANVAWKVNDTLSVFVNAINLTGQVQRQYVGDHLFGGYTDYGRTWSLGLRARF

SEQ ID NO: 17913 - protein, 623 aa, Pseudomonas fluorescens
MHIRLIPGISLLTLSLLSGTSLGAETAKEEPYSLGEVVVTSERLKEYITNHPLDVTTVERGEIVSRNLGSVEEILKTMPGVEVYSSAGVGSRISIRGSGRSGSVMVLLNGRPLNSNQYGSQDLSAIPVDSIQSVSVFKPPVPVWLGPGGSDGAINIITRTPKQGGGKEKQRSSLKGGGGSYGLVEGSVSHQLPVSDSTVLLAATGNHRDGKRTNSDRNDGAFNLNWNRQGDEGRRYEFNGRYYQAEFGSPGPVDNETPHARQEYRKGSLDARYSGLLGQSGTVSATAYGDMIYLKDTDQSGSRYTLNDNKAGLKLDTTWSDESENWDLRLGGMTEWNGYDHTLSGEHERFRNGLSVQYDRRFGPLTTTFGLRGDLTNDFGANPGGTIGLGWGIADKTLLKLRAGYTVNIPLFGQLYQTSHGSIDQTRGNPDLKKERVWSYEIGLEHTFAKDRLLQLTLFRSDTVDLISSRRGSDMIYRPVNIRGAERQGGEIMATYAWDNGPTLEASLTIQDSAVKSTGKKLPYTPGLKMKYTLSYTLPRLATRLETTVRYEGSRYSQAENKSYQRMDDAVLVDLKATQPFKIGKIATEIYLRVDNLFDTAYETHLGHPDDGIRAAAGIQMRF

SEQ ID NO: 17914 - protein, 1044 aa, Pseudomonas fluorescens
MNTRFIRISLKKRIFISYCLIGLFFFLGENCYASKRPVFRETVRKASADNSTVRGRVVDVSGEPLIGATIREKGGTRGTVTDIEGNFILSVPDSAVLQVSFVGYESIEVSVGGRKTLEIQLRENTVMLDNVIITALGLEKKEASLAYSIQKVKGEELTRMKEVNMITALAGKAAGVQINKNSSGIGGSAKVSLRGIRSASGDNQPLYVIDGVPMLNIGTEQAYSAIGGTANAGNRDGGDGISNLNPEDVESISILKGAPAAALYGSQAANGVILITTKKGNTAGQRNIYFSTGLTFDKAFSLPKMQNCYGVSDVVDSWGEKAYLPTSNELNDFFRTGLTSITSVSVNYGNEKIQTYFSYANTTGRGIVDKNQLTKHNINLRETAVMFNQRLKLDGNVNVMRQIVKNKPVSGGFYMNPLVGLYRFPRGEDLSYYKDNYEIYDPERKLGIQNWHTFTEDFEQNPYWIQNRIQSKETRMRSIISLSANLRINSWLTVQARGSVDYISDKMRQKFYASTAPALCGANGRYIEMDYQETLIYGDVMAMGKRKWEDFTLDVAIGGSINDKNVNSTRYDSKNASLKYANVFNLANIVMNGSASIDQKIDSRRQLQSVFGTAQVGYQDKVFLDLTARNDWASTLAYTSHEKSGFFYPSAGLSFLIDKWIQLPEWISFAKLRGTYSKVGNDIPQFITNSVSHITAGGELQANDAAPFKEMEPEMTHSVEVGTEWRFFQSRLGFNLTYYRTNTHNQFFKLPALAGDMYAYRYVNAGDIQNRGWELTVDATPVLTPDFTWKTSLNFSSNRNKIKELHEELKELVYGPSSFSSSYAMKLVKGGSIGDIYGKAFVRDAEGNIVYQTEGDHKGLPAVEGEGNTIKVGNANPRFIMGWNHTFSYKGFSLYFLLDWRYGGKILSQTQAEMDLYGVSQVTALARDRGYVTLEGQQIDNVKGFYKNIVGGRAGVTEYYMYDATNLRLREVSLNYTFPKKWMQKTKVLKDLQLAFVARNLCFLYKKAPFDPDLVLSTGNDNQGIEVFGMPTTRSLGFTVKCEF

SEQ ID NO: 17915 - protein, 210 aa, Pseudomonas fluorescens
MNATDTGMQADPTDLIQRIASLTRMLRDSMRELGLDQAIKDAAEAIPDARDRLRYVAQMTEQAANRVLNATEAAGPIQDGMARGAQALDERWQQWYDQPLELPQARALVQDTRAFLAAVPQHTQQTQAKLMEIVMAQDFQDLTGQVIMRMMDVVGAIERELLQVLLDNVPQERRDEANSLLNGPQVNPGGKADVVTSQDQVDDLLASLGF

SEQ ID NO: 17916 - protein, 703 aa, Pseudomonas fluorescens
MPSPRAMAEEEAGSEVSKSSEVTSDQSQVETLPPLLVEDTKVYGSQSLRGATLSKMPLEMREIPQSVSVIDRQRMEQQNLTDLDDVMEKATGVTVQPYQQLTTQYYVRGFQADSFEIDGSPVGIGYQASSPQDMAVYDRVEILRGSNGMLHGSGNPAATINLVRKKPTDTFQSSVDLSGGSWDTYRGEADLGGPLIENGAVRGRLVGAYEKKGYFYDEAEQKTGLAYGVIEADLSDTTLLTLGGQYQAIDAVPNIAGVPMAADGSDLGLSRSRYLNTDWSANDWRTVRAFGALEHQWGGGWTSKLSLEYEKSSSDLKYGALYGSNIDAETGNGAILMPGAYRFHDENRSVDLHANGPFKLLGKDHHALFGLNSNRRQHKVDTGTFETNIARPVNVYTWDPSSVPEPGVSRYDTTSDSDTREAGFYAMGRFSIADPLTLVLGSRFSGWQQDTLTSSYSTGLQWIPYSGLIWDFADDWSAYAGYTSVFQPQTSLTYDGGILDPIEGRSYEVGIKGALYEDRLNVSAALFRIEQSNRAVEDPDHPSVGRTTYYINGGKVRSQGVELEVNGKVMPDWDVSAGYTYTDTKYLEDPNNQGDEFSTTTPHHMFKLWTNYTLPWEEKRWSVGAGLNAQSEITKTSNSITMKQSPYVTMDLRLAYRIMPTVTASLNVKNISNEKYYQELFSPNWSNRYGEPRSVTFGVRATF

SEQ ID NO: 17917 - protein, 337 aa, Pseudomonas fluorescens
MVAAWQDRDSYYDRYHDTKMSGMAVLEGDLTESSTLTVGYQRQDNTPVDSTWGTVPFFAADGSYANLSRSTNMAPEWTRWQRETSTAFANLEQRFGEDWLLRVNTAHTKGAVQNLRVYGTGYPAADGSGVFLRTGAGHTQDTRDSVDVYLSGGFALFGRQHDVVIGGSWQDLQSTTYRVAQTYPADWASCPNAFGPPERCYFIPNIRNWNGDASEVTYTRTGARRQARTTQRGVYASTRFRLADPLSLIAGARLSAWETRTQAFEASGSYTGTSGRYEVSDEVTPYVGLVYDIVPDVSVYASYTEIFNPQNYRDKDNNLLAPVEGRSQLASATRELN

SEQ ID NO: 17918 - protein, 829 aa, Pseudomonas fluorescens
MKQFPLTLIGLFCAVSSYAAPGDGSPGKQAQSESNREYAGEQLAQVAESGSNAGADKEKGKKKKAGEIAPQNRTVFREMVVTGEIERDSRFTSPSMRVTRTQVEQQNAQTTEEVLKYMPSLQIRQRYVGDPNGVLGIRGADMFSTARSMVYADGLPLHNFLQASFNGAPRWSLVGPNEIDSVDIVYGPFSAEYSGNSIGGVANIRTRMPNKQEFYFEGSLFIQPYENYGSDKGTFIGDRQYISYGNRIQDKFTVFLAYNRLEAQGHPQSYFIDNTGLFNVPGGTPVTGGIRTPDTRGTPSIIYGDTGPEKVNTHLFKGKFGYDITSDLQALFTVAYEERTRNQNHPNNYLHTANGNYFWGGSSPVCNSVVTCSNPGNASLDGTRFDVVRNGFGSSRDKRETLNLGLSLRGALTPGWDVDTTLSYFDVLKDIRAAAFFNHADPGNTGAGQLQDFRKFNWWNYDLKLSTPMLLGYDKLSFLTGYHFDQYNLSFRQYSLTNYDDLTRGALQTNRNNDGRTSTHAIFAQSMFRFLPDWDITAGVRQEWWEASKGVASNVVVPDRTETATSPKVSLGYEPRQWKFRYSFGRAHRFPVIAELFQSLGTPTSILTANALLKPENGVHHNFMVEYGLPKGYARINVFRDDIKDAIRQITSASGVLTTSAFQNIGEVGTTGVELIFEQRNILGTRFDFMFNGTWMNSKVEEGPVVKFTESTGVSANYSLTGKQVIRLPHWRANFFGTYHVTDAWDVSLSGRYTSDSYNDPDNRDHVNKVFGSQSDFFFMDFKTSYRYRFNNGLKSRFSFGISNLNNDKAWVYHPYPQRTYLLEAAFSY

SEQ ID NO: 17919 - protein, 778 aa, Pseudomonas fluorescens
MFHQLAAPGARRRLAAACAAALAWPAAHAASTAAAVPADSTPAAAAEMTASGKTLDTVKVTAQRAAFAPDTPGVVEALTREQIDSHVNVTTEDALKYAPNLMVRRRYIGDRNSVFAGRDFNELQSARGLVYADGILLSNLLGSSYSYPPRWSLIQPDDIARVDVLYGPFSALYPGNAIGSTVQITTHKPQRLEASVSTQFFTQRYRDGYGFADSFGGNHQSARIADRVGRFWYALSLDRLENDSQPMQYASPNGAFDPRLGAPVPVTGAVSDIGPNGRPRTIVGAQTIERTEQLNETLRFGYAFTDHVDATVTLGHWENHYRQHGDTFLRDAAGNPVYGGNVSFGGRNYTVSPGAFAPQTGDQENWLYGLGLDARLASGWKLSATASAYEVSRDVLRSASGAPPGAWDGGPGTVSHGDGTGWRTVDLRAESPDVRGHRFSFGYHFDTYFLRNATYNTADWQNAVPTTLVNRYRGNTRTQALYAQDAWRVAPGWLATLGLRYERWDAYGGELGGATATLGYAERGATAFSPKLSLEWQPASAWRLRLSFATGTRFPTVAELFQGTISNNAIVNNNPNLQPEKAIDWDFTAERDVGFGVVRASVFQSDLRNSIYSQTTLAGASTYTNVSNVDRVRVRGVELAFSGQDVALKGLDVDANVSATNAQTLADAANPNYVGARWPRIPRMRANLLASYRFDEHWMTSVGVRYSGRQYNALDNSDVNPGVYGGTSSFMVVDLKARYRFDRHWLASFGIDNVTDRRYYVFHPYPGRTFYGELKWSL

SEQ ID NO: 17920 - protein, 236 aa, Pseudomonas fluorescens
MHKLLLAATIAALSSTSVFAADLAARPYTKAPPAPVAPIYNWTGLYIGAQVGGAFQGSSGFVTDDPLVTGNRDDSSFLGGGVLGANYQFSPNWVLGIEGEFNGLSNNRYTFTDGFDGIRVKNDWLASVTGRLGYTWGPGMIYAKGGVAFRDNGGIAATTPFLVSRDTTGYTVGAGLEYMFAPAWSAKIEYQYYDFDRTALTFGTLPSTVSYRDDLHTVKAGINYHFNWGGPVVARY

SEQ ID NO: 17921 - protein, 1695 aa, Pseudomonas fluorescens
MKALTESTQRGDPCLDQCRSPAARFSAAVAALISPLVCRAHLILWLTSACIVSVLTPTLSWASASCTAVNGSALNYSVSFSSPGNPDDGKGFNEAYLMSFATGDTIHYSVTISTIAGTIDAGFIADYSFGIPTTFNNNLSGAGFHTSTSGSYTLSASDVMKINSNPDGSWTPGLSSQAIDHTFSGFLGSVSFSATCTAAGSPTVSSVSPSSGPTAGGTSVTITGTNFGGATSVSFGSNSVPSSSFTSSSATQIVVPSPAGSAGTVHVTVTNAIGTSPTSSSDQFTYVAAPTIGSISPSSGPTTGGTSVTITGTNLSGVTGVTVGGASATLGANTSTSIAITTPSGTAGARDVVVTTAGGSVTSTGGFAFIAAPTIGSISPNSGPTGGGTSVTITGTNLSGVTGVTVGGASATLGANTSTSIVITTPSGTAGARDVVVTTAGGSVTSTGGFTYIAAPTIGTISPSSGPTGGGTSVTITGTNLSGVTSVTVGGASATLGSNTSTSIVITTPSGTAGARDVIVTTAGGAVTSTGGFTYIAAPTIGTISPSSGPTGGGTNVTITGTNLSGVTGVTVGGASATLGTNTSTSIVITTPSGTAGARDVIVTTAGGSATSTGGFTYIAGPTIGTISPNSGPTAGGTSVTITGTNLSGVTSVTIGGAAATLGSNTSTSIVITTPAGTAGARDVVLTTAGGSVTSTGGFTYAAAPTISTVTPSSGSTGGGTSVTITGTNLSGVTSVTVGGTAATLGTNTSTSIVITTPTGTAGARDVVLTTAGGSVTSTGGFTYILSPSISTISPNAGPSAGGTSVTISGTNLSGVTSVTIGGAAATLGTNTSTSIVVTTPAGTAGARDVVVTTSGGSVTAVGGFTYAGPPTIGTISPSSGPTGGGTSVTITGSNLANITNVTIGGAAASLGANTSTSIVVTTPSGAVGARDVVVSTAGGSVTSTGGFTYVAAPTISSISPSSGLAAGGTSVTITGTNLSGVTSVTVGGAAATLGINTATSIVITTPAGTAGARDVVVTTAGGPVTSTAGFTYISAATVTAISPAVGPISGGTSVTITGTNFTGATAVTIGGAAATGVSIVNATTITATTSAHAAGNVDVVVTTPGGTATGSGLYSYVSGPVVTSISPASGPSAGGTSVTITGSNLAGATAVSFGGAAATAVSVTSATTITATTPAHAAGAVDVTVTTPGGSSTGAGLFSYIVAATTTTLTSSHNPSEAGQPVSFTATVTANGSVPTGTVTFTDGGVVIGSVGLSGGAATLTTSSLTIGSHTIVAAFAANASFSASTSSPLLQAVNTPQDSLKLRAMQIMASKTIAQTSGAAISGAIDTAISEGFNDGGELITPSGSGLRFNFTDDLSQSRAGTPESTVESRWPAFASHGSGAPGHQATGFGLGDPQSSGRAQARFDDTFAAIDRKPDIAKAPAKAPAVPKDWLMWAEVKGASIGQWNSTSTASVLSGNQVNALIGLTRRPSPDLLIGVIGGYETFDYKSGTLNGRLKGDGWTIGSYAAWRSAAGLRFDIAGAYSGIGYDGSAGTAFGSFDGRRWLMSGGVTGSTEAFGFAIEPSAKVYALWESQNAYVDSLGTTQAQREFFTGRASAGLKVSYPWLYSATLTLAPYTGVFADYYFLGDNAETITLAGGTPLASVPLMDGWSARVTGGIAARFGNGAAVAVGGELGGLGGTVQIWTLRGRASVPF

SEQ ID NO: 17922 - protein, 433 aa, Pseudomonas fluorescens
MRPPFPLITPRQSLGFGAFVLCAGFTAQVQASGFFEDTTAKIESRTVYFNRDFRDGHTSSDQGASKREESAQGFILNLQSGYTEGTVGFGIDALGMAGFQLDSSPDRSNSGLLPSSGDNPRGSKGQYAKMGLTAKVKVSDTVLKYGALLPDLPLLKYNDGRLLPTMFNGAMLTSKEVKDLTFMAARLDKYTARDSSDSQDIRVHCKNKRYACNTTADHFDMYGFDYKINDRLTAQYHYAELEDIYRQHFVGLLANQPLGDGVLKADLRLLKSADSGDAKAGSIDNRALSGMLSYGISGHTFSAGWQRMNGDNSMPYLDGSNPYLVNYVQVNDFAAAQERSWQLRYDYDFKAIGINGLSFLTRYVNGDHIKVPGSDQEGKEWERDSELKYVIQSGTFKDVSLRLRNATYRTNYEKFARDVDETRLIVSYNFSVL

SEQ ID NO: 17923 - protein, 649 aa, Pseudomonas fluorescens
MPHCPYRLSLLGAITFGSLLATQAHGADAALELQAQEITAAAIDRNESVEAEQLQRYQASDLQEVFESNPEVSVGGGPGVAQKLYLRGLEDTLLNISIDGASQPGQTFHHTGRIGIEPELLKRAEVQAGTGDATAGPGALGGAVRFVTKDPDDLLREGEQLGALLKTGYFSNGEGYKSSASVFGRFNQNWSALAMTTYQDQNDYEDGNNDDVLGTAARQKLGFAKLVGKLSDEQTLRLSYEKRIDEGERSQRPQWIPSSFNRLYPLSTERETWTLNYAWQPVNNDLLDVELTTYHTTNELEQDGRFGLYFGDTRSTGFDLRNTSRIGAHQLTYGVDLRDDRATLGPAGNRELDHEDGEVLGLYLQDRYQITSRLQLDAGLRYDRYKLDDRDKQTFTEDGISPNLGLRYQLTPELAVFAGQARALRGPQVRDAFKMDSSGNDPHLKAEKARTDEVGFDYRDGGWELNGKAYITRIEDAIADPIGRPNLYLNVGDLKSKGLLLSTAYHWQQLSLGLSYHRNDARLDGERLNVYEYNGLGTSLGDTWTTFADYRASDNLTLGWQGRFVRGIDTLHTGVGDVSKPGYGVHDLYAEWQAVPESLTVTLTLKNLLDKQYLDHASNEDFEHIPDYEGIRGSYEPGRELRLGLAWRI

SEQ ID NO: 17924 - protein, 482 aa, Pseudomonas fluorescens
MNNKKQQLQIAVALALLGGFGAIGTVQAGGFTTPTYGAPGWGRAFGGGSLFKNDPSAAYNNPAAMAFIDQNVAQMTVDYARIKMKYKGDAYDYQGNPATTLPVDASGVPTGGPVPLEGNGGQGGFTAWLPTGFMVMPINDQFAFGLSQVVPMGMRSTWDNDNSKIRDFSVDTKIETVGLTGSLSFKVNDDFSLGAGVIVQHSKGFVSQNLNLTGAAAVSPGLGGIPLPSGVGANLMRVKVDNTSVGWFTGVVWKPTDRDTLGLNYHAKIKNKMDGKYNVRADAVGRQYMTQPAGPNGESLVELAYPGLKLNPDGANASAQLDIPASAGLDWVHVFDDRFTLGASMLWTQWSSFKDLTLKSDGNTLVSIPYKYKDTMMYSLGGDYRFTDQLTLRAGVAYDQTPTRNSTRDPRIPDNDRWFTSLGFGYDIRAIPGLTIDGAYSRQFVKEAKIKTQNVDRLGASRLDGKVDAKGEVVSLSATYHF

SEQ ID NO: 17925 - protein, 462 aa, Pseudomonas fluorescens
MPSLTLHVIPRRPFTLMGAVQQATAAFMLVLSLQSAALAAGAETPAADIPEPERWNVHGQFTNVTQWHPSFRSPYSGTNSLTPDNNTKETVDVTLYLGLRLWKGAELYANPEIDQGFGLSNTVGLAGFSSGEAYKIGNNAPYRKLPRLFLRQVINLGGEQQAVESAPNQLAGSRSADNVTITVGKFSVADIFDTNTYAHDPRGDFLNWAVIDAGAFDYAADAWGYTHGLAVEWTQSWWSLRGGLFALSVVPNSVTIDTTWKQYQWVGEFEARHDWFGRPGKVKLLAFATRGRMGGYGDAVNLAQQTGNTPDTGLVRRLAWRPGVALNLEQEITSDLGVFARASMNDGSKETYEFTDINQSVSAGFSLKGNRWGRPNDTFGAAMVVNGLSRAARQYFAAGGMGVLIGDGALNYGTERIAELYYNWAAIKHLTLGLNYQYVVHPAYNRDRGPVSIVGARVHAEF

SEQ ID NO: 17926 - protein, 695 aa, Pseudomonas fluorescens
MSSPIMRDLRRLPLRRLQPVSLMLFAAVTPAHAADPPATSPPAPLAPIFVTANPLGDTDPIAATTQLSGDALTRRQADSLGETLDGLPGVSTTTYGPMVGRPIIRGLDGDRIRLLQNGVAAYDASSLSYDHAVPEDPLSIERIEIVRGPAALLYGGNAVGGVVNTIDNRIPREAIEGVTGALDARYGGANAVRAGAAQVEAGNGHFAFHVDAFDREAGKLRIPGYARSSALRSTDDADTPQPYGSVPNSDGRVHGGAVGSAYTWADGFAGLSYSGYESNYGSVAEDGVRLRMRQERVAFASEMRNLDGPFTKLKFDFAYTDYRHKEVDDGETATVFRNRGYEARIEARHRRIGPFEGALGVQFGQNTFSALGDEMLVPSTRTNSVALFGLEEWQVDPALKLSVGGRFEHVQVDPDPAGIAKFADARARDFNAGSVSAGALLSLTPVWSVAANVAYTERAPTFYELYSNGPHDATGQFLIGNPNASKEKAVSTDLSLRYASGPNRGSVAVFYNRFSNYLAEYNTGRIVDDHGDPVAPGTADALDEAIYRGVRAEFYGVELDGKWRAFAQRGHTIDLELTADYTHARNVDTGQPLPRIAPLRATLAADYGYGPFGARAQVTRAWAQHRVPDNDFPTDGYTSLGVLLSYKFRVGATHWLAFLRGDNLTNQEIRYATSVVRGFAPQGGRSVMAGLRTTF

SEQ ID NO: 17927 - protein, 241 aa, Pseudomonas fluorescens
MKSNYKKMLAAGAVMALAGTAQAQSAGSNIVSLGWFRVMPNSSADPLTVDSINGRPVNMTRANTGASIESADTLGIAFEHYFTDNISAELVAGIPPKHDVKGTGDYGQYGKLGSVRQWSPAVVVKYHFFDAKTKFRPYVGLGVNYTWFTDETITNQDFVNHAFGIPGAKMTANAESSWNPVFNVGASYAITDNWFVGLSVSYLPLSTRATLTTQANGVTIVSHTKIKIDPVVTFLSVGYKF

SEQ ID NO: 17928 - protein, 710 aa, Pseudomonas fluorescens
MSMRRTLVSLCVIQAISQTAWADQVPGVQPAMELQNIDIQGAANAETAQGPVDGYRATRSASATRTDTSLHETPQSVSVVTREAVEDIGSTRLQDALDYAGGVGRANNFGGQGLTTFTVRGFTTGEFYRNGFPINRGYPNMPDANTIERLEVLRGPATTLYGRGDPGGTFNVLSKQPLAEPSVTLGSQLNDQGMKRGTLDASGPLDDEGRFAYRLNVVGEGGDTFRDHVETERYGVAPVLSWQVNDATRITFEGDFMRNNAPLDRGLTRYANQTGTASRDTFFGEKSVGKLHNDNNMAQLRFEHDLNPDWTLGGGLQILDGSLQGDAIEANGLAADGRTLGRNFNYRKLEWTDRDVQLNLTGHFSAGGFEHTLLTGVEYEDYDYKSIIQRSSGAVAAYPIDLFNPVYGQARPALTRTTTHDKENLKTWAAFVQDQVALTERLKLLGGVRLERFEHDYDSFLPGTSSWTASDNAVTPRLGLSYDLTDDLAVYATTARSFKPNSGASRLGGGFKPEEGKSYEVGTKWEALDGQLSVDTAIYQIEKRNVLTTDPVDSTFSVAAGEVRSRGLDLNVVGNLTPQWRVMGSYAYVDAEVTKDNTLRSGTRLMNIPEQTFSLLNVYEFQDGALRGLGLGGGGRYVDQRAGRTANTSFSMDSYTVFDLLAYYKVNPHVKLNLDLKNVFDTDYEEGSFGNVYAYPGAPRTVQVGIAYTL

SEQ ID NO: 17929 - protein, 391 aa, Pseudomonas fluorescens
MKHLLTSTSAIALGVVMVAPASAQEWDMKWGGYFSSHVAYATVDTNTAAHLGADFDGVDVYSETEIEFTPSVTLDNGMTFGVNVQMEGTNNGGGATGIDETYMTISSDAFGKIDLGNENSAGYKMMVSAPQIDGSIWINSPSISGFIPISVSAGGNLPWNFRQSAISAYTEVLGNNDVARISYYTPSFNGLTLGISYAASDNIVGTGANAGNNFGVNRNAGVTDIFDVAVAYSGSFGGFDLDAAARWGTAENNTGLAGTDDPETWGVGATVGFNGFAFGGSYSENDNGGLLPDEEGWALGVTYDLAGPWKFGIDTYQGEYSGTGAASGDKAEFEAYQIIGSRELGEGVSWAIYAVYAEGSVNGNAGGTFAPGTANTEVEGTLIGTSINLTF

SEQ ID NO: 17930 - protein, 585 aa, Pseudomonas fluorescens
MSSAVICLSMRPVAAVLPRLVALSLVGGAGFEASPSANAAELNINAVSDYAISSQQVTSITQFSDVVPTDWAYQALSNLIERYGCVAGYPNGTYRGNRAMTRFEAAALLNACLDRVTEVTDELKRLIKEFEKELAILKGRVDGLEAKVGELEATQFSTTTKLKGQTTFITGAVNASGDNGSKVLPNGATRDVSSFSGNGLNGGAKAYNQEYGAFTFNYDQRLYFETSFTGKDLLLAYLRAGNFGKNNALNGGGINLTQLDVAYDSSSGTGSSNFLNIYRLWYRFPVGDQFTLIAGAVARNTEMLAMWPSVYNKGGVKTLEVFSLAGATGVYNKATGQMIGGYWKQATSKGDPAWSVSVNYVAQQGNTSDPNSGGIMTDRSEGNLLAQLGYSGPRFGAALGYRYGQCGTNFRHATEFTAANGYNNSCTATLANGASEPIASSTNSYAVNAYWQPQNSGWIPSVSAGWGYNQVSAANKVTGSPLNSQSWFTGIKWSDVGLKGNDLGFAVGQPVFATGLDGGSTPFDGNYAFELYYSFQVTDNIQVAPSVFYLSRPMGQFTSNLTRQGSGYDGNFSIFGGLVQTTFKF

SEQ ID NO: 17931 - protein, 754 aa, Pseudomonas fluorescens
MSHVTLFVKGPNISAETNKDGRYTISLEKEGSYEIFLRSVGYVTQYKKVVLAKGEQKSLDWKLLPDEQSLNQVTVAGKTEAKKIKDQGFNVDIVDAKRLYNSSADLNQVLNRLPGVRVREDGGLGSGFSFSLNGFSGKQVKFFLDGIPMDNFGSSLTLNNLPTTMVERVEVYKGVLPVTLGGDALGGAVNLVTRDNPQFLDVSYGYGSFNTHKASVVGAYTDKKSGFTLRANTFFNYSDNNYKVDVAPVNLSTGIAGPIQEVERFHDNYSSVGGQVEAGLTGKSFADKLLIGIIAAGNERDIQTGVTMDQVFGARTANSHSFIPTLKYKKANLFTEGLTASVYAAYNMTRNNFIDTTALRYNWLQESVYKEAAELRRTQLKNRDNDGLVTANLSYQLNEHHSLSYNYVLTSFDRKSSDVEDPDNYTFNLTQSLRKQNMGLAWQANYQGFTATAFSKLYLLHGESFENVSTTTQADYQPISQNKQYVGYGMASAYYLLPRLQVKASYERAYRLPEASEFLGDGLYYLANSAIKPERSHNFNLGALFSQPLPDESRLDVEGNFIYRKAEDYIRVDQARLAPVGNRYINVGKVTTTGGEAEVRYTWKNRIFASVNATYQNITDRTEFNSNTNLGGTVVTRNLGYGYKVPNIPYFFGNVNLGTKFNDLGIQHNTLSVNYALNFVEKYYRTLEHLGLNNQDIIPRQTSHDLSADYAMAKGKYTVSLEGRNLTDNDLFDNYRLQKPGRSFFVKLRYFINK

SEQ ID NO: 17932 - protein, 356 aa, Pseudomonas fluorescens
MQIIFGEKCVSLLRLFFAAVLMLWCAQTAAYSGQCHTTQGNPYIGVNFGVKTLEEEANTAGVVKDKFYQWNESNDYYVSCDCDKDNVRSGRWAFAADSPLVYLGDNWYKINDYLAAKVLLQVKGSSPTAVPFENVGTGGDTRWHICDPGGQRLGGQGASGNSGSFSLKILQPFVGSVVIPPMALARLYECYNIPAGDSCTTTGTPVLVYYLSGTINSLGSCSVNAGETIEVDLGDVFAANFRVVGHKPLGARTAELAIPVRCNTGNAGLVNVNLSLTATTDPSYPQAIKTSRPGVGVVVTDSQNNIISPAGGTLPLSIPDDADSIARMNVYPVSTTGVPPETGRFEATATVRINFD

SEQ ID NO: 17933 - protein, 741 aa, Pseudomonas fluorescens
MIFNRATVLLGCLFTLSSSFSVNADDSAYFDERTYLSDLPVVISASRLEQPELEAPGAVTVLDRDDIISSGARTIPELFYQVPGFQVGRFTGSEYVVASHGFSDHYSRRLQVLVDGRSIYTPAFGGIVWESLPIHINDIERVEIIRGPNATLYGSNAFNAVINITTRFAAGTTPQSISYTHEDRDNYSGHASASIVESRYEIGMNANYRENSGFGKIPSDQTTPTNPNTGQPYDEMQDSIRSRAANIMWRYQASTQLEISSDMGLLDAVRDFGDGVIDDPYRDMNIDSDYYRVRFDYTSDHGNHLSLQAFHSAVDLQDGDAVVPLSVPFDNPALGGGVDVSTSFKEVRQEIELQFTPELDSNLRLVMGGSYRKDTIEGEQGRIFRDDKSTLNLGRIFINSEWHASQDWILGAGVMAEDHEHSGSSYSPKLSAIYKVTPHQAFRVIASRAYRTPTAWEEEGILRFYLPVQPLEQLISQATGMPIDFPADRLDYQAYQTEGNLENEEITSFELGYKFVPNENTKLDIRLFREDIDDMIAIYSRPFDLVAQGLLNNNQIQTIEGLNNTIGFDSSALTNAIGSGNAYNFRNLVDIDINGLELEGEHAINDSFQILGGFAWLDSQIERYADPANGIVEDNMENNRKTLNNSVPEYSGFIGGRFTPTNNHLLALTFYHFDEYEWHGAGDDDLGETQFFRLYAQATHEYTHYAWKMGVGAVIRAEPFRDIDNKNAFQNHLFSTVGVDF

SEQ ID NO: 17934 - protein, 122 aa, Pseudomonas fluorescens
MSDTLPGTTLPDDNHDRPWWGLPCTVTPCFGARLVQEGNRLHYLADRAGIRGLFSDADAYHLDQAFPLLMKQLELMLTSGELNPRHQHTVTLYAKGLTCKADTLSSCDYVYLAVYPTPEMKN

SEQ ID NO: 17935 - protein, 480 aa, Pseudomonas fluorescens
MLNPLPGTGEGSMHRVFRAICNRLVASAGLVAIWFCLAQPATAQELLLPASRDEIADRERLSSWTLDKFPAQPFMKEIYWDRRAQELPAFFRDSLVQYVARTYYMNRDNFDGTKSQAYAAGGWLAVRTGLIGDLFGIHAAFYGSERLFGPLDQDGTKLLAPGQNNINTLGQIYGRIQLGDQEIRGGRQLVDTPLINPQDNRMVPNTFEAATLVSLPDKDRFYDYALGYIWNIKPRDSNDFIPMSNALAGTGTEGTPFGMFRLRPIPGLVLTAMDYNVQNFINSGFGQAEYDFRQPKGMPNFILGGNVIAQTSVGDNLLAGSPFETYQASAKAQMAYAGWTLFIAGSATGNQSKIYSPFGTKPNYTDMQQVSFDNAGEKAIGGSAAYDFAAFGLPGLSTGAWYSQGWGALNPVTNVAIPDRRELDVWLQYRPTEGPLKGLRLKTQYSNVWQQGNVRPTQQEFRLIADYTVLFRPEPSVSKH

SEQ ID NO: 17936 - protein, 749 aa, Pseudomonas fluorescens
MTSTFLRHAPTARGDHARRRRRAITLTVPALAAGAFHLAPAVAQTSEAVHGHGTLGASGVASRADTDTASAKSDGAVREAASAAASRTTTGAAPDATTLPTIEIVAAPESTPLVVVTDPKTPRQPLPASDGADYLKTIPGFASIRSGGTNGDPVLRGMFGSRLNILANGMPTLGACPGRMDAPTSYIAPESYDKVTLVKGPQTVLYGPGASAGTVLFERVTPRFKTPSMRFDGSVVGGSFGRNDQNVDVTAGTPDFYGRVSANHAHSQDYEDGNGRTVPSQWDKWNADAALGWTPDDNTRLELTAGTGDGYARYAGRGMDGAHFRRETFGLKFDKKHIGDVLDRIEAQVFYNEADHVMDNYTLRMPDPTSSMPMRMASEVRRRTLGARVAATLRLTDAFKLVTGVDAQSNRLDSRSAMGMQNYGDKPWNPQANMWNAGAFGELTWYASDASRVIGGARIDYAAARDKRATTGGMKMSMRNPTFDDLRSRVLPSGFVRYERDLASLPVTWYAGIGHAQRFPDYWELFSAKRGPNGSINAFSAIKPEKTTQLDIGAQYKSDKLDAWVSAYAGYVQDFILFDYATGPMGQITRATNVNAQIMGGEVGASWRPLAPWRFEGSLAYAWGRNVQSGAPLPQMPPLEARFGVEYTRGPWSAGGLWRVVAPQHRYALNEGNVVGKDFGPSAGFGVLSLHAQYNVSKTVQISVGVDNVLDKAYAEHLNLAGNAGFGYPANLPVTEPGRTAWVRLSTKL

SEQ ID NO: 17937 - protein, 424 aa, Pseudomonas fluorescens
MHNNKKPQRQRYLNSILHLLPLALLLPVASAQAELLEDAKGTLTLRNFYIHRNFVDDRATRSKAEEWTQSFILDLQSGYTEGPVGFGIDILGLWSVKLDGGKGTGGTQLLPVGKDGKPADDFGRLAVAGKLRFSKTEAKLGEWSPALPILRSDDGRSLPQTFQGGMFTSKEIRNLTLYGGRFRGNSPRDDSSLEDMSWVGNASVTSDRFSFAGAEYAFNDNRTLLGAWFGQLEDIYKQRYFQVVHSQPLGKDWTLGANLGYFDGEEDGSAQAGDLDNSLLTGMFSLKHGAHIFYLGLQRVGGDDRWLRVNGTSGGTAANDSYNGSFDNPRERSWQVRYDYDFAPLGMPGLTLMTRYIKGHNVHAGGIDDGEEWNRETQLSYVVQSGPAKNLALRWRNSTVRRDWGADNKFDDNRLIVQYPLSLF

SEQ ID NO: 17938 - protein, 464 aa, Pseudomonas fluorescens
MSAGKLPEGWVIAPVSTVTTLIRGVTYKKEQAINYLKDDYLPLIRANNIQNGKFDTTDLVFVPKNLVKESQKISPEDIVIAMSSGSKSVVGKSAHQHLPFECSFGAFCGVLRPEKLIFSGFIAHFTKSSLYRNKISSLSAGANINNIKPASFDLINIPIPPLAEQKIIAEKLDTLLAQVDSTKARFEQIPQILKRFRQAVLGGAVNGKLTEKWRNFEPQHSVFKKLNFESILTELRNGLSSKPNESGVGHPILRISSVRAGHVDQNDIRFLECSESELNRHKLQDGDLLFTRYNGSLEFVGVCGLLKKLQHQNLLYPDKLIRARLTKDALPEYIEIFFSSPSARNAMMNCVKTTSGQKGISGKDIKSQVVLLPPVKEQAEIVRRVEQLFAYADTIEKQVNNALARVNNLTQSILAKAFRGELTAQWRAENPDLISGENSAAALLEKIKAERAASGGKKASRKKS

SEQ ID NO: 17939 - protein, 429 aa, Pseudomonas fluorescens
MIRKHFAGFAASALALAVSAQAFAGTVTTDGADLVIKTKSGLEVETTDKQFSFKINGRIQADADSFDGFYTKNGERADETYFRRARLEISGVAFTDWGYTFHRNFGNDSSDWQELAIHYNGWEPVQVSIGRIIPTFGLEEAVSSKWITAIERSAIYDLAPWLNSHEDGEGIRVRTTVGMFHGEAGAYRQDGGDGVDMLEDEDGANNTSFVLRGVIAPIVEKDQVLHLGASFGQRDLEEGYLERIRPRLSVRGTTEDSANGNRATFGGTRTDGTDQAWGLEAAYMIGPFSVQGEYLTRTVDAMEGFEDLEATGYNVQLAYTLTGESRSYKLDGGKFDKITPNNKQVGAWEVFYRFEDITVDETGVAPSGYVGALDSAKAGAKTHTVGVNWYANEAVKISANYLKTSVDDVVNANGDDDGDAISLRAQYVF

SEQ ID NO: 17940 - protein, 528 aa, Pseudomonas fluorescens
MPSTDGACFRRRAGPQVCGPGVPCSLRRRSFMNPFHHAPRRRAAHIQVLLLSMSALLWLPAAQAQYWSPGAQAGPHNVGTDGVFDEDEEPGPRPPLPKEDLEALEDLFGSGDTPPEPPPAPPSPGPMAPNVPEDASPHLPDHAGGDAMPPASPPAPPEARPKQPEARPEALPEAPPQAQPEAPPQAQPEAPPVVPPPAEPPAARPPAVPPAWPAGDAVYLPGTRTLTPTANAAVGTASAAQGLWQAEMNALGKRMGELRLTPAAGGVWGRAFTQRQKLDNGVAREFRQTVGGFEVGADTALAAADGRWHIGAVAGYSHGKLKFGRSGTGEGDSVHVGAYATYIEDGGFYMDGIVRVARYAHEFKAPDAKGRRVRGKYRANGVGASLELGKRFTWAGAWYVEPQLEMAVFHAQGGSYRAGQDLRVKDNGLTSLLGRVGLHVGRQFDLGDGRVVQPYAKLSWLQEFDGKNTVRTNGVRHKSRLDGGRAELDLGVAAQLGKHGSLYGSYEYAKGSRQTMPWTFHIGYRYTW

SEQ ID NO: 17941 - protein, 3474 aa, Pseudomonas fluorescens
MSSNVDSENKYFSKKYLTVKKVAQIALPVLAAFSGSASRGSNVSSVGRFSSVATKSYALNEVRLDPQSSAKDGAGLSEDSDRRSVFSAFTYRQNSTQRIEKKNEVNDAISYLEKSGLLTPADSVRSNLSGDVYGLVGRKSFAHESQFDHCHGSFGSTYNTNTTTVTEVSCTASWGGVWETASPNPVVSATSIQNKTATSFDVAVTMSKASTVYAVLLESSKPAPTNAQVEAGTDGSGSAAATTKSAAASNSVTLSFTGLDSNKNYLVYLIGKDGSNNVTTTPAQVNPAYEAGLISNAGTWKFPKTRVDSSGNIYLAHASSGQINFLEWNGSGFSAVTTITAADVAGRTNMGWGNEHRVDYELDSSGNIHVVFNASTSQWAVDNDPFYGVYDGVNWTFTNIGETGYQGGRFDLFLDENDKAHLSFTLTPNADQVKYATNASGSWVINDVITATNDGTDEIHDTYCVVDSSGDAHIFYRREDLQNSSQDNYYYTSSSDNFATHTKVIDGKADAKYYLMANVSIDSSDKIHYAYSNETDGDSFYVTNESGSWVSTEITHASHSILTVYDMEEEGGVYYFASASGSTYFFNSYNGTDWVDGFDFSLTGSLNDRVAVSDAADRIMVVSESSAGWEIHYHSATIASYITPPVSNEAPTITGLSATFSTNEDAAAYLDMSAVTLADTEDDTVTLTLAVNSGALAASDGDGTTAGVTIANSGSASMTLTGAVADLNTYLDTTTKIQFTPTANISGAVTFTATPSDVTSSGTAGTSSITVSAVNDDPTATGVPTDVAVTEDVQSNIDLSAITFADVDAASGNVVLSIAVTAGTLVASDSGGVTVGGSGGSTITLTGTVANIDTYLNTASNVQYTSAANANGNDAATLSLTANDGGNTGSGGGGDVSLGTINLDITSVDDTPSDITLNASSINESDTSAGADVGTLSSTDADSGSFTYSLVSVGAADTGTCTSDTNNSSFQINTVTLETANVLAAGNYDICVQTSDGNTSFEKSFSVTVVDNIAPIVTITSLSTADSTPALAGTVDDTAAAIQVTVNGANYVASNNANGTWSLADNTIAALTHGTWDVAVTATDGASNVGSDATSNELVVDLEAPASHSVSIDQANIDATNESAMSFTFAGAEVGASFSYSVSDGSTNVTGSGTIASSGQQVTNINVSGLNETTLTLSAILTDVLGNAATAVTDTVVKQYNSAPVITEGASTSVNMSEDANPTAFALTLNASDSDADTITWSIATNGSNGTATVTGTGMTKAISYSPNANYFGVDSFIVEVSDGVATDQITVNVSIASINDAPVFSSTAIVSVNEDSGYSYSITTTDVEADARTVVATTKPSWLTFTDNGNGTASLSGTPTNDEVGNHSVLLTLSDGNASATQSFIVTVANTNDAPVISGTPATTINEDSAYSFTPTVSDVDVGDSFVYSITNQPSWASFSTSTGLLSGTPGNDDVGTTTGIIIGVNDGTTTVNLASFDLTVVNTNDAPVISGTPPTSVDEDSAYSFTPTASDVDVGDVLTYSVANAPSWASFNTSNGELSGTPDNDDVGTSSNIIISVNDGTVSESLASFNLTVVNTNDAPVITGTPSTSINEDSAYTFTPAVSDVDAGDTLVYSITNQPSWASFSTSTGLLSGTPGNDDVGTTTGIIIGVNDGTTTVNLASFNLTVVNTNDAPVISGTPPTSVDEDSTYNFTPTVSDVDVGDVLTYSITNAPSWASFSTSTGQLIGTPENTDVGMDSNIIISVSDGAETVSLASFDIEVSNVNDDPVAANDTAATVEDAAVIVSVLTNDSDVDDALNPASVLIVSSPANGTTSLNAGSGAITYTPNANFNGSDSFTYTVEDATGATSNTATVTISISAENDAPVATSDTASTPEDTPFTIDVLVNDNDIDNGDSVDGTTLAIVSQPVNATASVVSGEIYFEPNEHFNGSTTFTYTVDDQNGATSNVATVLVNVTGVNDLPVALGDSASLDEDGSVEVDVLANDSDIDGTIDPSTVSVLSDASNGGTSVNTTTGVITYTPTANFNGSDTFTYVVQDNDGGSSAATTVSVTVASINDAPNGVADTAALMEDNPTTINVLGNDSDVDGSIVVTSVQIVTGPADGTVEVLANGSITYSPDTNYYGDDSFTYQVQDNEGAWSSETSVNVTVSSVNDAPLANNDSVSTDEDTAVSIDLIANDSDADGLLDSSSLVIVSAPANGALVDNLDGTVTYTPSADYFGSDSFTYQIDDDSGDSSNTAAVTITINPVNDAPQISGTPAASVNEDSVYSYTPISSDIEADDLSFSIENMPSWASFDTSNGALTGTPNNDAVGIYGAIVISVSDGVSTTSTSAFEIEVINTNDLPVLGGTPTPSVSQDQEFNFIPTAVDVDAGDTLTFSINSLPGWASFDPLTGQLSGSPNNAAVGFYTGIVISVSDGTSTVALPAFDITVDNVNDAPVAIADLYSVAEGGVLNGVNVLANDFDIDADGLTVTLISGPDSANSFSLSTSGAVSYMHDGSESIFDQFSYQISDGALLSAVVTVDIDIDAVNDAPVFVTAPNVLSLSQGQSYLYDIGVVDPDSVTNLQLVSGPSWLTLNGSELSGEVPLDESVGLTSVVLRASDSEFTVDQNFDLSVVERETSVVSLSASWIGLPSVVDELLTLKIALNHQQGPAIADGNLFVVLTGSNFDASMKNCTALASNEFDCPVTLNSSGNLSFNLKLTPHSEGDVVVNLDVSDFAGDLVTSKIIDVSPSRRTVNQGDNAFPLDNATAIASIEMKADGNREIAAGTGLGDTVKLLDYETGSDDATVLGEIENRGATKALGVADIDLDGSEDLLVVNTAGDATAVYYQRGELNFVEDSATVSLPYANQGVLQDLNSDNYPELILGGSGFNLYIYENILGVYSQSPYVFTSQKSIKKFAKLKQKPDQAPMSGTLVLASSDALVLIDFAIAAGKVTKVGVKESGEVQSRNKLQGYLRSELSIPGITSIRVADLDGDGLEELIVSTRHENNSSSKSGVTIIEVSGTGQMTEVRKLGNASAENVEIADFNGDGLPDLLIANENNTYQFYHGDGTVSGFSLKDTVIYNESDLVLPNDVNDDGLSDLLIYVAESDRVDLYISHSDGDLGARADLAMNSQVETVSSTSYDIRQLVSVTNSGNQTAQDVIVTIDIPLHFNVVSLPDACLFGDAQIICDLGDLAANQNETLTFVLNGDADVNDEVLQSRVTSAALEVAPENNKSTNSLNGLFESTSAGVKGGASGSGAINFGLLGLLLILGMQQKMKYWRQLTVVSLLLLMCGQSHGEPLLNSERVSVEMGIGSTSSNWSESSFLAELQAVTQDVEITRVKTTRTSWQLVGGYELNNWLSAEAGYQSWGDVDVELSLTTNDPDGVRDVLAKDYPVSGAGPYLGARIQYDVSEGITIYARAGVLAWQGEYDVRVGESVQSIKRDGVDLAASFGVNKSLTDNVAFGLGLNLVELAGETQTQVGLQVRYKFLGKKD

SEQ ID NO: 17942 - protein, 205 aa, Pseudomonas fluorescens
MSISISYSTTYSGWTVADYLADWSAYFGDVNHRPGQVVDGSNTGGFNPGPFDGSQYALKSTASDAAFIAGGDLHYTLFSNPSHTLWGKLDSIALGDTLTGGASSGGYALDSQEVSFSNLGLDSPIAQGRDGTVHKVVYGLMSGDSSALQGQIDALLKAVDPSLSINSTFDQLAAAGVAHATPAAAAAEVGVVGVQELPHDLALAA

SEQ ID NO: 17943 - protein, 711 aa, Pseudomonas fluorescens
MFQYRYWNSPMTSRRILPLAGLTLGLLADPLLAKEPEPLELETTRISTEYESATGPVKGYRATRSASATKTDTAIRDIPQSISVIPASVLKDLGSNNVERALEFAGGVSKQNNFGGLTLYEYSVRGFTTSEFYKDGFSANRGYPSTPDAATVERIEVLKGPAASLYGRGDPGGTVNIVTKKPQPEAFATLQTSAGSWDRYRTALDLNTPLDAQGNLLSRVNLAVEDNHSFRDHVDSRRVFVAPSFSWQLNPDTSLLLESEWVRHSSTFDRGIVAPNNRWSGVSRSTFLGEPDDGNIDNHNNMLQATLEHHLNDSWKLRLASHYKEGKLWGFASETRPLNADRHTVNRRYRERDNNWHDSITQLELRGLFDLGSWQHELLIGSEYENYRKNERVTSIAGGAYAIDIYDPIYGQAKPNGKRSGTDFFEHVESQALNLQDQIIFTDRLRGMVGARFEHFEQKIDDHTTGKRSRQNHDALTQRAGLLYQLTPQVGLFANASTSFKPNNGLDAGGKTFKPEEGVGYEVGIKSELFDERLSATLAAFHIDKENVLALDPGTDASRAVGKARSQGFDLQFSGQLTDAVRVIGAYALIDAQVTKGDPAIPAGSRILGVAKHSASLLGVYEFQDGRLKGSDIGAALTYVGDRSGEAGGSFELPAYRTLDLLAHYKASDNLTLGLNLNNLFDEKYYERSYSNYWVNPGEPRNFTLSLTLNL

SEQ ID NO: 17944 - protein, 509 aa, Pseudomonas fluorescens
MRAEPTVSREARATRPFGGGIRLLALSALLCAASGLAEAQSPPAFTLPQPLALLPTGAGGDPQTAIAQSRTSDQLSVTNEGSIQEALGPYGDPFGLRAALAARGITYVLTYIGEGFASTSGGLRRGTTFGGRLDAALDIDLDKLAGWSGARFHTDVFQIHGHGLSRRFVNNLTTVSGIEALPSTRLFELWIEQRFFDDRFSVKIGQVSADTEFAIAQSAVVFLNAGFGWPNIGAVVLPSGGPIYPLATPALRLKYEPTAELSFQGGLFNGDPAGTPPPGDETDPQRRNRTGTNFRVNDPALLIGEVAYAYHSLPGTERLPGTATLGGWHHFGRFESPRLDAVGGRLLADPEASGVARRFRGNTGLYAMIDQTVYREPGRDEAGASAFLRISAVPSNRNLIDLYVDAGIAYRGLFAGRPNDTLGLGLIHSRISPAARAFDRDALLFGTGPAPLRSSETVFEATYQAEVVPGLTVQPDLQYVMRPGGGLADDRGRRLRNATVLGLRATVNY

SEQ ID NO: 17945 - protein, 717 aa, Pseudomonas fluorescens
MKPSSPRSSYIWCLSPVALAISSTFSFAIHAEETIEIVEINGHQQNNASQLGSVDELLKRQGVDFSAAGGMSSLPVLNGMMGDRVKVLIDGADITASCANHMNPPLSYVSANQVQVLNVVAGISPVSAGGDNIAGVISVNEIAPLYLEGNDVRWHSGYGSVQYNSNNQAKSIGLGARMASQNFSLDYQGAFEDAKSYEDGHGNTVLDTLYRAQNHALTVAVKDDKQQLAVKLNHQNIPFQGFPNQFMDMTDNKSYGMTSLYRRQLDEGDFEVQVNWHGVKHEMGFFSDEKTGMMPMKTSADDYSYRLNWQFITSTNNTVNFGHEYFEYHLDDWWPAVEDSMMMGPNNYININDGKRQRIAVFAETSQSLNTNWWLSAGIRLEQVTTNTGEVQPYTNDTLMDMSSMHMSMEPSMSISALNNNDAADIYNAMNRKRSNTLIDATLSTRYLFDASQQLELAIARKSRAPNLYERYSWGVSTMATTMIGWFGDGNGYIGNPNLAPETARTLSVNYSDSTVDNEWKFSANAWYTSVKDYIDAEIVSSFNHASSGAGNRNILQFTNLDATLYGVKLNGSIQFLDSEKWGLWQLNANLSTTRGKRDDNEGDLYQIVPLKSELKVEQKMGNWQNAIAWQWVASKKDTDERRLENSTKSYHLINVSSKLTWQDVTLSFAVNNLFDTYYALPMGGVSIAEYKMDNSQGFSQLAGAGRSVNIGLSYAF

SEQ ID NO: 17946 - protein, 968 aa, Pseudomonas fluorescens
MLSQPTNQPTNPTNQPTNQNSNASEQLEQINVLGSDNNNDNTPPKIAETVKTASQLKRQQVQDSRDLVRYETGVTVVEAGRFGSSGYAIRGVDENRVAITVDGLHQAETLSSQGFKELFEGYGNFNNTRNSVEIETLKVAKIAKGADSVKVGSGSLGGAVLFETKDARDFLTEKDWHIGYKAGYSTADNQGLNAVTLAGRYQMFDALIMHSKRHGHELENYDYKNGRDIQGKEREKADPYTITKESTLVKFSFSPTENHRFTVASDTYLQHSRGHDFSYNLVKTTYINKDEEELRHTNDLTKRKNVSFTYENYTVTPFWDTLKLSYSQQRITTRARTEDYCDGNEKCDSYKNPLGLQLKNGQIVDRDGNPVNLKLINGRHKVVDKNNKLFGLTDEDNNAAFDGKQLGLSGFWFDCTVFDCDKPVRTYKYKYSSSNPAVENVELNKFMQVNGKRFATYEDKIQSSEKRYVILPNSKGYLPLDYKERDLNTKTKQINLDLTKAFTLFEIENELSYGGVYAKTTKEMVNKAGYYGRNPTWWAERTLGQDLSGNQHNCNTNSSYNGMLCPRHEPLTSFLIPVEATTKSLYFSDNIKLHNMLSVDLGYRYDDIKYQPEYIPGVTPKIADDMVKGIFIPLPKGEKIKIGNYETTKPLTPEQIRKNAEENIAYIAQEKRFKKHSYSLGATFDPLNFLRVQVKYSKGFRAPTSDELYFTFKHPDFTILPNPVLKPEEAKNQEIALTVHDNWGFVSTSVFQTKYRHFIDLAYLGSRNLSNSVGGQAQARDFQVYQNVNVDNAKVKGLEINARLNLGYFWHVLDGFNTSYKFTYQRGRLDGDRPMNAIQPKASVFGLGYDHKENKFGADLYITRVSEKKAKDTYNMFYKEEKKKDSAIHWRSDDYTLVDFVTYIKPVKNVTLQFGIYNLTDRKYLTWESARSIKPFGTSNLINQQTGAGINRFYSPGRNYKLSAEITF

SEQ ID NO: 17947 - protein, 809 aa, Pseudomonas fluorescens
MKSRAKSGSVKQWLGVSALSFSALAPLPLSVALAAESVSSQLQKQFSFSLAAKPLPQALSDFSRVTGQSVVYTDEAPYGLTALPINGQMSAEQALQRLLTGSGLTFRRTDSHTLALEPQPTAGALNLGATTITSVANQPMSYQPPETSSVMRSSASLQEIPQTVNVIAAQVIRDQAPRNLDDALANVSGITQGNTLGSTQDSVMTRGFGDNRNGSIMRDGMPVVQGRGMNATVDRVEVLKGPASLLYGIQDPGGVVNMVSKKPELTQYNALTLRGSTYGDGKNGSGGSFDSTGALGDSGLAYRMVLDHEDEDYWRNFGTHRESLIAPSLAWYGERTKLLFAYEHREFLTPFDRGTLIDPRTNHPLDISRNERLDEKFNDMEGRSDLYHFEADHELNDDWKAHFGYSWNRETYDASQVRVTAIDTKKGTLTRSMDGTQGAISTDRFTTASLEGKVNVLGMQHDLVFGVDDEYRKIYRADLIRQKSLSTFSYVNPVYGREVEGTTVSPADSAQTDLLRSDSVFLQDSIHLNDQWILVAGGRFQEYDQYAGKGVPFKANTDSNGQKWVPRAGLVYRYTDELSFYGSYTESFKPNSTIAPLSGSSTVLDGSIAPEEAKSWELGARLDMPGRITGNIALFDIKKRNVLVANAEGPTTIYSAAGEVRSRGLEVDLTGQLSDRWSMIGSYAYTDAEVTEDPDYKGNRLQNVAKNTGSLSAVYDFGSVIGGDQLRVGAGARYVGERAGNAVNDFDLPSYTVADAFATYDTKVEGQKVKFQLNVKNLFDRTYYTSAASRFFVSMGDSRQILLSSTLEF

SEQ ID NO: 17948 - protein, 366 aa, Pseudomonas fluorescens
MKINIVAVVVTGLLAGSTAHAAEVYNKDGNKLDLYGKVTALRYFTDDKRDDGDKTYARLGFKGETQINNQMTGFGHWEYDFKGYNDEANGSRGNKTRLAYAGLNIEQFGSLDYGRNYGVGYDIGAWTDVLPEFGGDTWSQKDAFMTYRTTGVATYRNYDFFGLIEGLNFAAQYQGKNERTDGGHLYGADYTRANGDGFGISSTYVYDGFGIGAVYTKSDRTDAQERAAVNPLNASGKNAELWATGLKYDANNLYLAANYAETLNMTTYGDSYISNKAQSFEIVAQYQFDFGLRPSLAYLKSKGKELGHYGDQDLIEYIDVGATYYFNKNMSTYVDYKINLIDESDFTRAVDIHTDNIVATGITYQF

SEQ ID NO: 17949 - protein, 876 aa, Pseudomonas fluorescens
MTRALLIFTLLLPAWAQEAPALSGTVTDPSGAVVPGVTVQLRGAGRDRRVKTDRTGRYAFGSLAPGSYEVRFTAKGFAVALMKSLRVERPEVFDVRLVIGATAQVINVEDQQRGVSAEADSNGSAIVMRERQIAALSDDPDELALQLQALAGPAPGPGGGQIFIDGFTGGNLPPKSSIREIRINANPFSPEYDRPGFSRVEIFTKPGSDALHGSAFTQYGDTIFNSRNPLFTQSTRPPYRSQMYGLSLGGPLRRNKASFSLDAEHRQIDENAFVLATTPDGTINQALGTPQSRTNIRPRLDYSITPRNTLVVRYQYVNASLDNQGVGDFNLASRGYNERQTEQTVQATETAMLNPRAINETRFQYLRAVTQDTAGQIAATVNVEGAFTGGGATAGNSGTTNSNWELTNISTFTRGTHAVKWGGRVRQSRLSDLSVNNFSGTFTFYTLADYEAGRPAQFSINTGTPLMRVVQTDAGLFVSDDWRVRPNLTLSYGLRYEAQSNFGGTDGLGPRLGIAWALNKKTVVRAGAGTFFDRIPISVTLNERRYNGITQQSYFILNPTFYPVIPSGLTEQPQQVRRVAGDIRSPRLYQTSVGLERQLTQTSRLTVTWVNSRGVHLLNVRNLDQSLRLLTESAGESRQNQVLANLNASYKKLTIFGNYALSYGRDDNEGLPADPYNLRAEWGPSSYGDIRHRAVLMASVPLPGKFAASPFFVVNSGAPYNITTGLDPNHTGAPTARPGLVAGPCEGRSCYTLNPAPGTEIEHNYGRGPGAVNLGLRVSRTWSFGPERSAAPADTGSGHGGMPGMSSTGGGRRYGLTLTASSLNALNHVNFAAPNGDLSSPYFGQYRALGGMIVMNHGGGASTYNRKIDLQLRFTF

SEQ ID NO: 17950 - protein, 800 aa, Pseudomonas fluorescens
MFQTFKSLIFEKKSLKNNYWSLLLLLLCFNIWGQENYTISGTITSAASNETLIGVNVIIPELNKGAVTNEYGFYSLTLPEGNYTLQVSFIGFENIAQPLQLSENKKLNFSLNESTETLDEVIIQEDVEQLSIRKPQMSVNALTAETIKQIPVVLGEADVIKSILLLPGVTNAGEGASGFNVRGGAVDQNLILLDEAIIFNSSHLFGFFSVFNPDAIKDLKLYKGGIPARYGGRVSSVLDIYQKEGNSKEFHANGGIGAVASRLLVEGPIVKNKSAFLVGGRASYAHLFLPLFDIDNKAYFYDLNAKLNYNFDDKNSLYLSGYFGRDLFGVSDSFLNTYGNATINLRWNHVFSDKLFSNLSLIYSDYYYGLLLDFVGFQYDSGIRNFNVKYDFQHYLNSEIKLSYGLNNIYYRFNPATIIPNRPDSGINPSQLTDKFANEFSVYAEAEHDISEALTLRYGLRLSHFTRLGQDAFNRYQNDQALNYNDQLELYQPAAPVEVQTNTGTLATFTNLEPRASLSYLINDNSSFKASYNRMAQYLHLISNTNAPTPLDVYAPSGPYLKPQLLDQYALGYFKKIRNNEYSIETEIFYKDIQNRLDYRNGAQLIANDAIEGEVLSGKGRAYGLEFLAKKNKGKFTGWLAYTLSRSEQQTPGRTPTETGINNGDWYPSAYDKTHDISAYVNFELNKKWNFNANFVFQTGQPTNFPVSQSQFQGLTIANYATRNQQRLPSYNRLDLSATLTPKNKNKTIKGEWVFSIYNVYNRMNAASITFRTNEDTGANEALRTSIFGILPSVTYNFKF

SEQ ID NO: 17951 - protein, 692 aa, Pseudomonas fluorescens
MKLSSLYIALLATITTNTYANSTDLEHIEVKGSFFNDYKVDNANGAMRTSTSLLDTAQSVTVISDIIINEQLATTLGEVLSNDASLTAGSKQRNREVFNLRGFELSSSTGYLRDGHQHWSHYQQPIEILQQVEVIKGPSSILYGQSGPGGLINMVTKKPTAQPLFNASADVDQHGSTRFMLDASGALTDAEDLRARGILVKQDVDYWREYQNGENRERDRFLGAFIVDYDISDNALVRVHYDRTDDEAGLDTGAWIDDNANVIGDDKTIRDMSWAFTDITVENAGIDFKVFLNDSWQVKLGYNEQTFERQRFESAPRKPGNFVEGDSYESRPYDRFDDWQFKTAFIDFIGEFETAGVHHQLLIGANSLDYYYGQRRTSADSFNFISGQTEPSRPTVSYKTDDTISETEYDYYGIYVQDLITFSPQWQLSLGGRYDKQTREDANNESFVPKVGVLYHPNASATVYASYSEGFEPQGSDTLVNEDDINNGMKLDAVTSEQKEIGVKWQLFDDRLMLSGALFDISKNGTLVTETLDVPVGDLISETNQIGEQRHKGVELTAQGAATDRLFVMASTMYLDANYERDEELEGKRPTDAPKWSASLWTRYELNDAIAFNAGAFYEGERFADSANTITKDAYTRVDVGATYKLKVSKTDVNLRLNIENLFDEDYLAGGGTNNVTIGEGTNVRLAAQFSF

SEQ ID NO: 17952 - protein, 325 aa, Pseudomonas fluorescens
MSRQPKPARLAGGALALGLLLGLPNPVEAAQDNGMEHSAMDHGAMPGMDHGAASPAPAQPMEHRGMDHGRMPGMSHAARQPPAQAASSQSRTPIPVPTEADRRAAFPPLEGHKVHDSALNSFFLLDQLEYQDADDGSALAWDASGWIGGDINRLWLRSEGERLDGKTEDAEVQALFGHAIGPWWDLVAGVRQDFKPGSPQTWAAFGVQGLALYDFEAEVTAFLGENGQSALRLEGEYDILLTNRLILQPSAEVNLYGRNDPARGIGSGLADSELGLRLRYEIRREFAPYIGVTWNRSYGNSADLARAEGEDDDEARFVAGIRMWF

SEQ ID NO: 17953 - protein, 618 aa, Pseudomonas fluorescens
MFRYSTISMIALAVATPVVAQETNPDADDIVVTASGIEQPGDEVGQAITVIDADTIETRQTIDVVDLLATTPGIRFNRTGTTGSVTGVSIRGAETTQTLVLIDGVKVNDPSGIGDGYDFGHLLTGNIRRIEVLRGSNSVVHGSQAIGGVVNVMTATPGSGFAGGASAEYGYSDTVNARADLSGTTGPVSGSIGGAYFRTDGISSAAVGTERDGYENIAANARLKVAFSDALSLDLRGYYINADLDFDSFFGAPADSADVARLDQYVGYAGLNLGLFDGRFTSRAAVTWMRNERDYFFVRGTAPDFGYKGTNLRFEYQGVVAPADTARLVFGYEHERPEYDFFGFGSTDSQKANIDSVYALAIVQPLAGLSLTGGVRHDDHNQFGGATTFGANANYSPNGGATNVRLSYGEGFKAPSLFQLYDSFSGNAALRPERSKSYDVGIDQSLADGRALVSLTAFLRNTTDQINFDNATFTYGNIDRTRAKGIEATLALKPVDALNVTASYSYIDARDRSGRPAFDGKRLPRRAAHAVSLSADHDWSFGLSAGATVTMVGDSFDNATNMVRLDGYALAGVRASFAVTERIEVYGRVDNLFDADYATAFNFGTYGRAAHGGVRARF

SEQ ID NO: 17954 - protein, 311 aa, Pseudomonas fluorescens
MNKYLKYFSGTLVGLMLSTSAFAAAEYAVVLKTLSNPFWVDMKKGIEDEAKTLGVSVDIFASPSEGDFQSQLQLFEDLSNKNYKGIAFAPLSSVNLVMPVARAWKKGIYLVNLDEKIDMDNLKKAGGNVEAFVTTDNVAVGAKGASFIIDKLGAEGGEVAIIEGKAGNASGEARRNGATEAFKKASQIKLVASQPADWDRIKALDVATNVLQRNPNIKAIYCANDTMAMGVAQAVANAGKTGKVLVVGTDGIPEARKMVEAGQMTATVAQNPADIGATGLKLMVDAEKSGKVIPLDKAPEFKLVDSILVTQ

SEQ ID NO: 17955 - protein, 606 aa, Pseudomonas fluorescens
MFKQIMGASVATLCFATAPSLAQNWDFTAGKSYVFGDSLSDTGNVFLAAGAGAPPVYFNGRFSNGPVWHEYLTGDTLALSPFLTGIIGDASNGINFAHGGARTYGFASSPGGPILPGSIEQAQFYAAGVANGSIAAPTSSDIFSIWIGGNNFLSALSGAPLDINQGVADIQQTLTTLASAGARRFVLFGVPPIGTSVEAPAPFDAQFDQAAAQFNLGLRSVDAAISAQFGADVLYINVEDLLLDLYADPAAYGFSEVRTDCVSQGLLLDACPADWSDYDGIHPTTQSHAVLAAFVVASGMNDDYAGQSAGGLSEHAYQVSRHLIVDAMDEAGRARQQTGPYLTGGWLDGSVDAEAGRAGVDYDGWSVSGGFNANLDKGFFAGGRVSFADTTSSVDSALAASGEAETFAIAVHGGWSTGAFYVLGGAGLGRTDMDTMRATGFAPRNSVTGSWVIDHSFTALEAGFDFTPAESFILTPYLRGVFTDYELGTNIEQGVLLAGRYQETDFSSTLYEAGLRAEWQVSNAGQLTAGLAYESEDDAERTLGVLLNDVDLSTAQAGGNEDGVLRAQLGYVAEIRDRLSIALTAAGRTGDGTESLQARLQVRLGF

SEQ ID NO: 17956 - protein, 847 aa, Pseudomonas fluorescens
MPAHAQDAASQGEKPEAQEGDLETIVVTAQKREQNLQDVPAAVSAIGGETLRTRGITETSDLMGAIPSLQVTTPYGRTQPNFSLRGISVANEFSASTASPVGVYVDEVYQSFRASHGLQLYDIDRVEVLRGPQGTLYGRNTTGGAISFFTRKPDLGEANGYLTAGYANYDTFTVQGAAEATLVPDILGVRVAGTFAKGDGWQRNVLPGNERDLGTTDTIGGRISIRFRPDPDLDINLKLYAAKDDPWGTAPYAGGQLAGGQDALGYSRYDPQPFLGGRLLRDNEVAVDRVGKNISKSKGIALNIKWDVSDQFSVTSITGYDTGDYINNPDDCDGGPADLCSIGLTSTSKNFNQDLRFSYSNDRLDIIAGLYYGRDKVKTVNYPDFFGALRPLLLGAGLPGSYNNAAIGTPDAIRYIPAFAANPALGPGDAGFCDAIEINPNGFLDARSLIALQTDIAINNTGNGGMGGSFSAGCAGAGAPPFTPILGEQRFDVSRPSKAIYGDVTWKTTERLTVAVGARYTQDKVNYLNGSTFLYALDGTTPVVNLIPYSNPYNPNLAPLEQREKANRLTGRINVSYEFADDIMGYLQYSRGYRSGSFNGLAYQGVNQVYYIQPEKVNAYEAGLKTRLFDRRVQLNLAGFYYEYSNHQVTQAVGATTFTRSANGRLFGGEAELAWQVADTLRFDASLGYLNSKYKGNVIDPANPASPTLNVNGNPFPNAPEVTFQAGFDWDMIDDGTNKLTLRGDASYMGKYYFDPFKNYGQTPCDTPPAGSNITLAGKAITCANPGYWLANARLTYAHDNMSVSLWAKNLFDKYYYTYGLNLNVFGYDYLNRGMPRTYGVEATVKF

SEQ ID NO: 17957 - protein, 748 aa, Pseudomonas fluorescens
MSATQHRVRAHVALGAGLAALSSTVAVAQPPGETIEGAGEIVITAQKRPELAGEVPLSISVIDGETLQAARLSQADDIAALVPNLRFSATVGENTPIFALRGVSMSDFSLNQAGPVATYYDEVYKGNFAFLGVQLYDLARIEVLRGPQGTLYGKNTTGGAINYLAERPRFENGGYLKAGIGNFGRAEGQGALNLAISSTLAARIAFTAARADGWFRNRLAGSPNLSATREYGVRGSILWKPSDSAELVLRLSTSLQTPQNYGTYSVPGPGGTGAGVYEAYGRGMSYFRTGIGKREIEANFTPRRRARTWSAALTGTFRLSDNLSLVSVTGWDRGSLFVPEDTDGSPTRTLEIPYTDRGTQFGQELRLAYDGDGALSLILGLHHHREDLFNATDLNFWTDLDVDGNGRVDVDDCSANASLMACAISNRFDQRKRSWALFGDAHMKLGTRTGLRGGLRFTRDIGLQAGLTSQLRGVDGVLVATPILPLDRSFAGSNLSGKIGIDHKLADGTMFFASYSRGYRASGFNAQAFFDAAEAGVARPETIDALEAGAKTRLAGNALAVAVTGFHYIYRNQQFLSVDPADATQTLVNLDRSRIYGAEIELEARPTSEIAAQIGVGILHARATQGMIGGLDVSGHSLSNAPSLTLNAAVAATIWERGPARMALRGDASYTSSQFFEIVNIPRLRQPGYALLGASVDYARGPMILSIWGKNLGDKVYFTSSIDLSGFGFDYNHVGTPRTYGATARVSF

SEQ ID NO: 17958 - protein, 779 aa, Pseudomonas fluorescens
MSPLQRATAAMPLRTPVCRAVLALAAAAPLSAFAAVDADAVGAAPAFVAQELAPTVAHAGTASAPFARNTPAVVQTVTADQLADRNLVTAEDALKYQPNVMVRRRFIGDRNAIFAGRDFNEIQSARGLLYADGILLSNLLGSSYGYPPRWSMVGPDDLARVDILYGPFSALLPGNSMGTTIALTLRKPEAFEAGAQTQVMRQHYSDAYGFSRNVTGNHESASLGDRIGRLWYALSVDRLENDSQPMQYATPNSVFTGGQASVPVTGAVRDLGPGGQPRVILGAQMLERTQQLQETLRLGYAFSERLEATLTLGHWENHFADRAESFLRDATPAAAGNVVTGGNVLIGGMPYTIAQNAFAPQNGDQENWLYGLGVKGRVGDWKLDANASAYDVTRDILRASNTASAGGPGTVFYGDGTGWSNFDLKAVSPTVSGHTVTTGYHYDQYHLRNQTFNASHWPTETLSTLKSSYQGDTRTQALFAQDAWAFAPRWLATLGLRYETWRADNGRLGNAGTTLGYAGRTEDAFSPKAALQWQATQDMLLRLSYGRAVRFPTVAELFQGSISGNTIVNNDPNLKPERANDLDFTVEQAVPSGMLRASLFQSDVRDSLYTQTNITVTPNVTSVQNVDRVRTRGIELAYSGQDVARDLGVRGVDIEANAAFTQARTLADAANPAYVGKVWPRMPRVRANLFASWHASAGWTLGAGLRYSGRQYGTLDNTDVLPDVYGGTSRFFTVDLKAGYRVDKHVTLALGVDNLTDRRYFVYHPYPSRTFYGQLKWRL

SEQ ID NO: 17959 - protein, 668 aa, Pseudomonas fluorescens
MPYQPIKLALMLASILGTTAPQLGWSAEATDCGEDQKCKDYLLVTADVMRQPVHLVSDPKQNRLPLPAYDGSGFLRSIPGFNITRKGGSGGDPMFRGQGGSRLNIVDDGQHVYGACGGRMDPPTNYIYPETYDQITVIKGPQTVKYGPVGTAGTILFEKNRHRFNQADLEGRASATGGSFDRRDAMVELNAGDKNYYLDFDINQSSSDHYQDGNGNKVQSSYDRQNSNLALGWTPTERTVVELAYGESSGEAEYADRLNKARQIDNRDAALLIQHEFESSWLAAVELQAFSNKNDHIMDRFDEGVNSGSNVRRMTDGGHLWFDLTPLDALELTLGLDYMSSVHDGRSMATGDVGLDDLLNKPFKEDMRYKNYGLFAESRYGFDNQGVGNSSLHAGLRVDRWDGELLIAQQGEREDTLYSGYVRYEYQLDAHQYYAGFGSAQRMPDYWEIMKASADNPAQKAFDLKAETTNQFDIGWIYQGPVEASVSLFYGEINDYILIDSTSNTTVARNIDASLFGGEASLDYALNEQWSTQLTLSYTHGENDTDKVALGQISPLEARLTVNYQWQAWTMAAQWRLVASQDRYTLGHGNIVGQDLGPSSGFGTLALNASWSYSKDLSFIFGVENLFDATYAEHVSKAGTGNDLPGSEAMFRVNEPGRNLWAKLTYQF

SEQ ID NO: 17960 - protein, 372 aa, Pseudomonas fluorescens
MAGCLLPGIATAQSSVTLYGVIDEGIDYVNNSGGQHLWRMRDGTYDGMYGSRWGLKGSEDLGGGLSALFKLEAGFSLENGQMRQGGREFGRQAYVGLSKTDLGTVTFGRQYDSVVDFVQPVTAVGQFGGPFVRGGDIDNTDNSFRVDNSIKYASPSFGGFTFGGMYSFTNSNAPGLGTTGMWSLGAAYSHGGFNAGAAYFYAKNPAARFTDGNFIGNTTGAAIGASGPFSYVGAPRNERIMGIGADYAFGSATAGIDYTNTKFDDANGTTSSVTFSNYEVWGQYKVTPAATLGAAYVYTDGKVNYNGARPKYHQVSLMGSYSVSKRTSFYAMAGFQQAAGDAKQADIFDFSIADASTTNRQLMFRLGMLHQF

SEQ ID NO: 17961 - protein, 1036 aa, Porphyromonas gingivalis
MKRMTLFFLCLLTSIGWAMAQNRTVKGTVISSEDNEPLIGANVVVVGNTTIGAATDLDGNFTLSVPANAKMLRVSYSGMTTKEVAIANVMKIVLDPDSKVLEQVVVLDYGTGQKLSTVSGSVAKVSSEKLAEKPVANIMDALQGQVAGMQVMTSSGDPTKVANVTIHGTGSLGASSSPLYIVDGMQTDLSVVATMNPNDFDNVTVLKDASATSIYGARAANGVVIITTKRGKMGEAGRITFNYSYGVSSIISKKPMSRMMTGDEQLNYQFNNGYWDTTKPEYATIEAVKATLIKNAEDMYAKYPELAPLVKSGYLKPIDFDNDTDWLEYFIRPTAPTHQGDISFTGGSQGTSYFVSLGYFNQEGISREPSSFKRYSGRMNLESRIKEWLKLGLNLSGAIAEKQASSFSGTNYYNTGTFGALSMPKYLNPLTSDGEIADVYYIIGTTPRQSPLRIAKWYPEEDYTYQANVGGYLQFNPIKGLTIKSQAGLDFTDSRATVKTLPNNIFSPNPLGNRTERFYGGRLFTVTNTGEYKTNFEELHDVTILLGQEFIDADVDVFSARANGFENSKVMLLSQEKTGNFLQLPAQRKEEYAYLSFFGRGSYGFDKWMYLDVSLRNDQSSRFGDNNRSAWFYSFGSMFDIYNKFIKESDWLSDLRFKLSYGTTGNSEIGNYNHQALVGSNNYTDTALGLTVSTIGNPDLSWEKQSQLNVGIASGFWNNRLTAEVDFYVRTTDDMLINVPLQYISGFTNQFQNVGSMQNTGVDVNLRGTIFQNKDWNVYAAANFNYNKQKITKLFFDLKEYVLPNTGTIWQIGKPNSFYIAEYAGIYKGTEPYTDPDGNVYHGGDQLWYVPGKTWADGTPATTNVYSADLEQAVDKAVNPPITGGFSLGASWKGLSLDADFAYIIGKWMINNDRYFTENGSGAAMRTNKDKILLDAWTPQNPNSDVPRLGQDNQFDSRLLENASFLRLKNLKLTYVLPQSLFKTQGVVSGARVYLMARNLLTVTKYKGFDPEAGGNVALNQFPNTKQFVGGIQISF

SEQ ID NO: 17962 - protein, 1036 aa, Porphyromonas gingivalis
MKRMTLFFLCLLTSIGWAMAQNRTVKGTVISSEDNEPLIGANVVVVGNTTIGAATDLDGNFTLSVPANAKMLRVSYSGMTTKEVAIANVMKIVLDPDSKVLEQVVVLGYGTGQKLSTVSGSVAKVSSEKLAEKPVANIMDALQGQVAGMQVMTSSGDPTKVANVTIHGTGSLGASSSPPYIVDGMQTDLSVVATMNPNDFDNVTVLKDASATSIYGARAANGVVIITTKRGKMGEAGRITFNYSYGVSSIISKKPMSRMMTGDEQLNYQFNNGYWDTTKPEYATIEAVKATLIKNAEDMYAKYPELAPLVKSGYLKPIDFDNDTDWLEYFIRPTAPTHQGDISFTGGSQGTSYFVSLGYFNQEGISREPSSFKRYSGRMNLESRIKEWLKLGLNLSGAIAEKQASSFSGTNYYNTGTFGALSMPKYLNPLTSDGEIADVYYIIGTTPRQSPLRIAKWYPEEDYTYQANVGGYLQFNPIKGLTIKSQAGLDFTDSRATVKTLPNNIFSPNPLGNRTERFYGGRLFTVTNTGEYKTNFEELHDVTILLGQEFIDADVDVFSARANGFENSKVMLLSQEKTGNFLQLPAQRKEEYAYLSFFGRGSYGFDKWMYLDVSLRNDQSSRFGDNNRSAWFYSFGSMFDIYNKFIKESDWLSDLRFKLSYGTTGNSEIGNYNHQALVGSNNYTDTALGLTVSTIGNPDLSWEKQSQLNVGIASGFWNNRLTAEVDFYVRTTDDMLINVPLQYISGFTNQFQNVGSMQNTGVDVNLRGTIFQNKDWNVYAAANFNYNKQKITKLFFDLKEYVLPNTGTIWQIGKPNSFYIAEYAGIYKGTEPYTDPDGNVYHGGDQLWYVPGKTWADGTPATTNVYSADLEQAVDKAVNPPITGGFSLGASWKGLSLDADFAYIIGKWMINNDRYFTENGSGAAMRTNKDKILLDAWTPQNPNSDVPRLGQDNQFDSRLLENASFLRLKNLKLTYVLPQSLFKTQGVVSGARVYLMARNLLTVTKYKGFDPEAGGNVALNQFPNTKQFVGGIQISF

SEQ ID NO: 17963 - protein, 775 aa, Porphyromonas gingivalis
MKRMMIWIILLGGMVQGAFAQNLEIKGMVRDARNKEILEFANVVLQTMDSSFVAGTTTDMKGHFLLNKIKKGSYILSVSSLGFKTEYISLEGLSKNISLGEISLNDDAVSLDGVTVSASAQTSHADKKVVFPSDRQMKASGNGMDLLQQMMLPRVQVDLLNNEIKATGNGVVQVRINGVKVEQDEIKALNPSDIIRIEYHDNPGLRYGNADIVLDYIVRRPDTGGSFGLDMAQGINSMWGEHNAWGKINHKNSEWGASYRIGPRDFYGMKRNNEEEFHLANGTTLNRVEIGEPSRARLFMHNLNVNYSYQKPDKYMFNATFRYRNNHQPHWDYQGVLMNKANPEDKVDMIDLSGSAYQAPALDLYYQRDLKHNQTLVFNVVGTYNQTKSTRIYQESKHEQLLTDVNNVVDGDKYSIIGEAIYEKKLTNGNRLSGGLRHNQSFSDNSYINGHNYKTHMEQMESSVYAEFKGKVKKLDYSLGVTVNRSSYSQRGEDADYERYTVSPRLTLFYALPGESSIRLKSTMGNVTPSLGELSAIDQVIDSLQIQRGNPNLKSYMSYYTELNYEFRKGLFYVNALGAYEYQPDAIMDEKYLEGNKIIQTWDNQKNWQRVVASANLRVGPIKDILQFSVNGGMNHYMSNGNTYTHRYTNWWCEANVSATWKKWSLWYMVMTNWNWFKGETMSGGENIQGIQLGYRHKDLMVGLRVINPFTDNYKQETENWNQYASFRRSNYIKESSRLFIATISYNFSFGRKFSAGQKKVNNADNDSGVMSTGK

SEQ ID NO: 17964 - protein, 1872 aa, Bartonella henselae
MINVFKNRTHLCALTTSILFFLQGVDISVGDTSPARSSSYECKAENGDSNNRGPVFCDDSNKDQKLTIKDGSIKAKKYNDYAVHAEGAAIDVTQVSIDFEPTNMPSSSGYSFGTDTASVVSFGDFGGAVYSSGNYEDSTVINLDKSYVEGFYYGLRSEARGKIIMKGGSIIETYIAGVASSESSIVLDNVDIEAIGIGLVSNNQSSVMVRSGLINLSGYGIGVMSTDMGFAQLNEVGIVMSSYIAKSSQERGGRTGEEDSKEDSIVDPDHYVLLSGGGAIFFNNGDINVSNAAVLLVDKSSQVSPSENIRADLEFLVDGLEDGNTAEVGKLENGVYLINSHDDENKELFVKMDSAIHNDIVSFGHEVAEVLKAANHEESLGILNLDLSASFKSSVVKANGKRSYGIYFRGLGSKNVLSFVGGMGVSVGEDNGVEEGNDSYEGRINTVLLKDSSFKVPEGVAIYGDEGFGGYVIVKDDSTLSGGLLLKAEAGSDLSVFVHDSLIAGAARIDKDSHAKLFLSGGSEWHLTESVYSSDFGNSDAGCVDSCISSMRLANSNIRFFLSSVSSEGGDASRSESENRRKGRSNNKYRTLRIGNGEGTVYSAHGISRIYFNADLISGNASNVQVSDRLLIHGDVSGKTIVHVNSVSDNTLSERSEQQSQSNSVSIIQVYGSAGENSFELHNGYVTLNSAPYKYTLRAYGPSSRQVSSSGSASKFFDPKLAQADGIQFWDYRLENQPMVVDSTSAQNGEVLAVASGVQTVSVVSPVSEISESETSQSASLASSQEESGISASVLSNPLDSNGAQTMLRAPQPASLARSEETSDIVDNVVIGPEKVIVAEYSETSNSESTATSEASLSENVSNPSSEAPATVPTVIQSSGPRGRILLNTSARSETSPVAPSTTSPVQRVLSAASQKSPVTKEPDVSTVENVGGRVVSSTCDYTGSIGRVRRGVTGSKHTPYSCSDGESHTISSATLGVSDSSQHSVSVGESTILNMENVTIIGAVSSDSENQIDLNTLRPMSAVLAEKDAEIVLNKKSTIQASEIGLEAQSGGRVKMIDGTINANYAGVLVGAGSSVQLDTTNISMKSRAVAGLASNGGEIIMSSGTITLADGIAVRSELGGNVKLDKVDITAKRGQIESASTEVSGRAAFLLSDRSSVDFANGNVVTDANGLWFRDVNGSVGTGAPRRKRSSDVPSSINRAYIESSNVKVEGDSSYGIYFDGMARVDERNQNRISEEIVSESVGRPVNGSSVFSQEQTFIGITGTVLLEKTNFEVPKSVAIYGSNSGGLVSLEKKAFLSGDLLLKSENNSNILVWVNDSVIAGGAHVDESSTAKLRLTNNSKWSLLRPKHGKLQDLGSLGDSSISALHLVNSSLSFEKPESNTADGYQTLRIGKGVGAVYNAQGNAHIYFNARLNPSDPSNTQVTDRLLIHGDVSGKTVVHVKGVSGSVGENNRSDKIAHSVSIIQVYGKAEKDSFQLSGDYVALDDSPYKYTLRSYAPKATSTRDHVDEKFMKDGGEFWNFRLENQYVELSDSAYTSTVSKDRSPGQAVRSVVPQVPTYLLLPNSFFHAGLVNISNQNKHLERLRATSGGMSGIHENPALFLRGYAGHYRYSSNLSALEYGYGGELGYNALEAGVLLKTIENAYSNTFFGVIGAYERLSLQPLAVEQSQKSAFDKWSVTAYGTMQYDAGFYVDGLLSYGLFKGDVLTLARGKTATLKGNPLSVSLTGGQPFATGYEGFVFDPQVQVVYQHLRINPARDIDNFEIELGKLDQWTMRVGGRLTKTFPVTDEARLVSFYSKFYLAHGFDGKQSVHFKDAFQLGAFGSSLEAGLGFNARLSSKFALHGDLVYQHKLSKAGFSGTSFVGGLRYQF

SEQ ID NO: 17965 - protein, 409 aa, Anaplasma marginale
MNHPTTPRQIAAAVAALAAALAAPCIAQAQSSITLYGDVDAGITYTNNQQVTHADGSIGGGHNFQFTGGNSAPSRFGLTGSEDLGGGTAVTFKLENSFYTGTGSFVQGGTLFNQNAWVGLTSERYGTLTFGRQFDSYTNALAPYASSNNWATLFGSHLGDVDNLNAALNLNNAVQYVSPTFAGFSVSGTYSLGGVAGDFAQKRGWAVAASYSNAPFSFGIGYLDLNNPLDAALGGQQGYIGDFACSNPTAMYCELQNARSLKTFGAGGTYTFGPATFGLVYTHTKLDDSQYFASAALPQGSDVRFDIVEVNATYAVSPALSLGAAYIYNSMKTDVSGSPKFHQANLGATYNLSKRTTLYAVGIFQKAAGSGIGADPVTGQAVNYAQIPNLPNSTTDKQVSVTVGLKHNF

SEQ ID NO: 17966 - protein, 282 aa, Anaplasma marginale
MNYRELFTGGLSAATVCACSLLVSGAVVASPMSHEVASEGGVMGGSFYVGAAYSPAFPSVTSFDMRESSKETSYVRGYDKSIATIDVSVPANFSKSGYTFAFSKNLITSFDGAVGYSLGGARVELEASYRRFATLADGQYAKSGAESLAAITRDANITETNYFVVKIDEITNTSVMLNGCYDVLHTDLPVSPYVCAGIGASFVDISKQVTTKLAYRGKVGISYQFTPEISLVAGGFYHGLFDESYKDIPAHNSVKFSGEAKASVKAHIADYGFNLGARFLFS

SEQ ID NO: 17967 - protein, 282 aa, Anaplasma marginale
MNYRELFTGGLSAATVCACSLLVSGAVVASPMSHEVASEGGVMGGSFYVGAAYSPAFPSVTSFDMRESSKETSYVRGYDKSIATIDVSVPANFSKSGYTFAFSKNLITSFDGAVGYSLGGARVELEASYRRFATLADGQYAKSGAESLAAITRDANITETNYFVVKIDEITNTSVMLNGCYDMLHTDLPVSPYVCAGIGASFVDISKQVTTKLAYRGKVGISYQFTPEISLVAGGFYHGLFDESYKDIPAHNSVKFSGEAKASVKAHIADYGFNLGARFLFS

SEQ ID NO: 17968 - protein, 282 aa, Anaplasma marginale
MNYRELFTGGLSAATVCACSLLVSGAVVASPMSHEVASEGGVMGGSFYVGAAYSPAFPSVTSFDMRESSKETSYVRGYDKSIATIDVSGPANFSKSGYTFAFSKNLITSFDGAVGYSLGGARVELEASYRRFATLADGQYAKSGAESLAAITRDANITETNYFVVKIDEITNTSVMLNGCYDVLHTDLPVSPYVCAGIGASFVDISKQVTTKLAYRAKVGISYQFTPEISLVAGGFYHGLFSESYKDIPAHNSVKFSGEAKASVKAHIADYGFNLGARFLFS

SEQ ID NO: 17969 - protein, 740 aa, Anaplasma marginale
MNYQKNFKKQVLPALISVCMVPLYANVAVGATVLEEVIVTARKRQESIQDVPVAVTAITPGQLERGSIRSVVDVAKLVPNVELHQTSQGSHSLSPSIRGLSYDDIEKSIESTIGVAIDGVFMASNSGAIFDFFDVESVEVLRGPQGTLFGRNTIGGVINVQRTEPTGEWGGKVEATFGDESMTDLKGIMNMPLGENGGIKIAVKDIQSKSFLYNVTNDNRPDNRDSQTASISVKYNFTENTSALLTYDDYDHDTTAVDIINTTTAAGALCAGTPAQNCATVSSDISKASGYKNSVQLNPLTATLEGENVTFKLTHEGDGYQIKYIMGTMEYDELATLGSWGTNGVMFPVVREQTFEQESHEIQYISDLDGPLNFVLGAYYMEADSYITSGPIQNFTANHSLEASAFFGEMTYDLNDDWSITAGARYTEEDKELYSRSWAILDFANRIAENLDAAINVGNPTFSDDNTSYRVVLQREFEKGMLYTSFATGFRSGGFFNRGSNEAELLPYQSEEVESFEIGMRSNPTENSQLNVTYFSTDYTDKQVQVIVPGDDPVCGKGTAENGVTCSFTRNAGQVSMDGIEIEAALMPTENLTLRAAIGTLDGGYDKYDYDGVDISDKAYLMYAPELTASLVAEYTTEISGGSLTVTGSFSHKDEVYTQAAWATYDPVTGPEVVIESFETVDLSATYLKDMGNGTLKLMVYGTDIFEADNRINRRYDAGSFSWAELAPGRQFGVTLGYEF

SEQ ID NO: 17970 - protein, 283 aa, Ehrlichia ruminantium
MNYKKIFVSSALISLMSILPYQSFADPVTSNDTGINDSREGFYISVKYNPSISHFRKFSAEEAPINGNTSITKKVFGLKKDGDIAQSANFNRTDPALEFQNNLISGFSGSIGYAMDGPRIELEAAYQKFDAKNPDNNDTNSGDYYKYFGLSREDAIADKKYVVLKNEGITFMSLMVNTCYDITAEGVPFIPYACAGVGADLINVFKDFNLKFSYQGKIGISYPITPEVSAFIGGYYHGVIGNNFNKIPVITPVVLEGAPQTTSALVTIDTGYFGGEVGVRFTF

SEQ ID NO: 17971 - protein, 997 aa, Ehrlichia ruminantium
MKNKLHFDFRKLCFVLALILTQCLYAQNKTITGTVTDSTQEPLIGVNVTVKGNSSVGTITDMDGKYTLPVPSGKITLVFSYIGYMAQEIVVGSQSTIDVVLLDDAQALEEVVVVGYGTMKKSDLTGSVSSISSDRFKVGTDLSPQQLMQGAFSGVNISQNSGKPGGSNTIRVRGGTSISASNDPLYVIDGVPINSSAGVSSSHIASNGSNTDFFDQESVNPLASINPNDIESINILKDASATAIYGSRGANGVIMITTKKGKKGVKQLDYSYSLGISNVSNKLDVLTGDEYRKAVNDLGLTLDDKGDNADWQDRIFRTAISQNHYLSFMSGGEDTNYRASLGYSDQEGVMLGSGMTSANARMNINHTALDGKLKLSMNLNYGETNADQAPVSNTVGSEMGSSMLYEAYVFNPTYPVYNDEGDFYDVPPYRVNPVSFASEILDERKNRKFLGNLTADWNFYKPFTFQVNLGYTYNSIERNSYISKSNLLGNGNGGYVSVQKLQDYSRLLETILKYNQKFGKHSIDAMLGYSYQYFYDEGNHTRAYGFLSDTFKWYSLAAAKTVESISSFAESNTLISMYGRINYNYGDKYLFTATVRRDGSSRFGADHKWGVFPSAAASWRISQEEFYHSDILTDLKLRVSYGITGNQEIGNYNSLNTLGASTNGYLVGGEKVTIVLPQQYSNPDIKWEQTAQTDIGLDFGLFNGRIHGSIDYYYKKTTDLLLSVAVPSPSLITSQIANVGSVKNQGIEIDLGFDVLRTKDFSWDINLNFSRNKNELISLSNDKWTGENMKVAPCQGQGLSGSYAQLVMPGQPLGTFYGKKFIGIKDGKEQFANDGESEIIGCAQPDFTYGISTTLRYKNWSLSMNLRGSVGNDVYNCTANNLAYLNNLPGRNVLKEAVTAGVNREEAKVFSSRFIEDGSFLRMDNLSLGYDFSFKPLRITHARVFVSGQNLFTITGYSGLDPEVNSEVSRTGVAPMGVDYLSYPKARTFTMGINVSF

SEQ ID NO: 17972 - protein, 315 aa, Ehrlichia ruminantium
MTNKLTFTGTVLALLLCIPNTSFSEIKYNNNTHIQYSIYVSGQYKPSVSNFRNFSVKETNTYTKNLIGVKKDITSLEVHTNNNKPIVSRRNPNPGPTIKATGISHPSNFNIPYNPEFQDNIINFSGTIGYQFSKSKRIEIEGSYKIFDVKDPGGYMLYDAYRYFALAREMNDTKFEPKPYQLDNVFNNFYHTVMKNTGLSIISVMINGCHDFHVNELKISPYICAGVGINTIEFFDTSHIKFAYQGKIGISYPLSNNIKVFSNGYYHKVAGNKFKNLEVIHVANLHNAPWYTSAIATLNIGYFGAEVGIRLGLKL

SEQ ID NO: 17973 - protein, 283 aa, Ehrlichia ruminantium
MGKFMNYKNTLLGIMLALSLLPTKSFSESISNNDNSQNFKLYISGQYKPGVPKFNNFSAKETNVKTQKLLGLLSGTSRKIDKYKDFSNTYIPDFQDSSTGFGAAVGYISYKGIRFEIESSYEEFQVNIHDNCEGTIEPCRYFALARSVGRRGWPDQNNYTVMKNTGLSMTSVMFNGCYNIMSNKLEISPYICIGIGGDFIDFFDSTHIKLAYQGKLGISYSLLPDVTLFVDGYYHRIANNQFKNLNVLQPVELKYEPKITSATATMNVTYFGGEVGIRFIFNS

SEQ ID NO: 17974 - protein, 282 aa, Ehrlichia ruminantium
MNKNKSIIIGTALTFLLAFSPIESFSANQTDETIPITAPISGIYFTGQYKPGISNFSNFSAKETNFNTQKLVRLKKDAKESNLLGTTTNFEDTYSVKFQNNIISFSGIIGYATSKGIRLEIEGAYESFDVKSPVGYSKDNSYYRYFALARSMTKDNPKEFTVLKNNGLSVASIMINGCYDFALDGFALSPYICAGIGEDFIEFFDALHIKIAYQGKLGISYRVSPKISLFVDGYYHHIIGNQFKNLSVHHAVELSEFPKNSSAVATLDIGYLGGEVGARFIF

SEQ ID NO: 17975 - protein, 278 aa, Ehrlichia ruminantium
  misc_feature (91)..(91): Xaa can be any naturally occurring amino acid
  misc_feature (139)..(139): Xaa can be any naturally occurring amino acid
MNNKNFIIIGTVFASLLSFLSIESFSAVNHNIDNNINGIYVSGQYRPGISHFTNFAVKETNNDTKQLVRYKKDVASIALETNTNFQDSYTXKFQDNVAGFSGAIGYSYPDGLRFEIESSYEKFDVKDPKDYSLKDAFRXFALARTLNNNNPSTGEYTVMKNNGMSITSIMINGWYNLSFNNLIVSPYICAGIGEDFIEFFDTLHIKFAYQGKLGIDYYLSPKINIFANGYYHKVIGNKFKNLNVNHVVALTQFPKMTSAVATLNAAYLGGEVGVRFIF

SEQ ID NO: 17976 - protein, 677 aa, Sodalis glossinidius
MKVQQKIIKMSAIALAIGSSGAVFADDIDRDPILNVNEVIVVHGERPTATEVATTHWSIDEDEIKALGAQSLEQVLKNVPGVYVRTGGQGTPRVDIRGFKTRHVTLLINGVPANGAEDGQFDPSVIPTSQIASVEVSVGPTSVLYGPGGAGGVINIITKQGDDASTLSGRLEASGEDTFNGDISAAGSGDNWQGLVSVSHQQTNGFPLSGDYPHNDVQLDDVRANSDKEIDNIYAQGSYWLSDNTQVTANMSLRSGQWGKPSRDGSGSGTVKFERADDYDAKTFQLGMAHKFSEMFTLRGFGYHNQSDVLETQYTDSSYTKVKQSQDGRSKVQGGNLQFITNFGDVGLLTSSLIAENQSWESTTSKPSTGDKSSQKQSRVLDGYSGGSGGGNGGGSSNFDDSAWLYTLAAEYQYQDDGYYGFTIGGALHDQDRVKESENDYSGQLSGFWQAFEQTRFNAGIARKVRFPSMKNLYSQSSGNADLVAETSKHFELGVEQELGASTALSVAGYYTDAENYIAKDMSGVYQNMGRYQFKGVDVSLNNQFIDDLSLTFVYSFLDTEDKDAFDGMGTLEYRPRHQLRFQADYELPFAMRINMNIERIMGQVYYEQEKVNGNKVWTEQSLKDYTLLDLNLVQPVLDDKLELYIRATNLLDENYYQSDAIPQAGRQVFVGISWQI

SEQ ID NO: 17977 - protein, 278 aa, Vibrio alginolyticus
MRKSLLALSLLAATSAPVMAADYSDGDIHKNDYKWMQFNLMGAFNELPGFPDGSNHDYLEMEFGGRSGIFDLYGYVDVFNLASDPGSDKSGAEKIFMKFAPRMSLDAVTGKDLSFGPVQELYVASLMEWGGGGATNCDFSTGTCIPSTTVNNQKIGLGSDVMVPWLGKIGLNLYGFYDGNNKDWNGYQISTNWFKPFYFFENGSFISYQGYIDWQFGMKDEYSSSSYGGAMFNGIYWHSDRFAVGYGLKGYKNIYGIKEVDGVDSTGFGHYVAVTYKF

SEQ ID NO: 17978 - protein, 332 aa, Neisseria gonorrhoeae
MKKSLIALTLAALPVAATADVTLYGAIKAGVQTYRSVEHREGKVVGVGTGSEISDFGSKIGFKGQEDLGNGLKAIWQLEQGASVAGTNSGWGNKQSFIGLKGGFGTIRAGSLNSPLKNTGSKVNAWESGKYTGEFLEISKMAKREHRYLSARYDSPEFAGFSGSVQYAPKDNSGSNGESYHVGLNYRNNGFFAQYAGLFQRYGEGTKKMEGYSYNIPSLFVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQEGKGADK

SEQ ID NO: 17979 - protein, 348 aa, Neisseria gonorrhoeae
MKKSLIALTLAALPVAATADVTLYGAIKAGVQTYRSVEHREGKVVGVGTGSEISDFGSKIGFKGQEDLGNGLKAVWQLEQGASVAGANSGWGNKQSFVGLKGGFGTIRAGSLNSPLKNTGSKVNAWESGKFTGNVLEISGMAEREHRYLSARYDSPEFAGFSGSVQYAPKDNSGSNGESYHVGLNYQNSGFFAQYAGLFQRYGEGTKKIEYDGQTYSMPSLFVEKLQVHRLVGGYDNNALYVSVAAQQQDAKLYGATGVNSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 17980 - protein, 913 aa, Haemophilus influenzae
MKKAIKLNLITLGLINTIGMTITQAQAEETLGQIDVVEKVISNDKKPFTEAKAKSTRENVFKETQTIDQVIRSIPGAFTQQDKGSGVVSVNIRGENGLGRVNTMVDGVTQTFYSTALDSGQSGGSSQFGAAIDPNFIAGVDVNKSNFSGASGINALAGSANFRTLGVNDVITDDKPFGIILKGMTGSNATKSNFMTMAAGRKWLDNGGYVGVVYGYSQREVSQDYRIGGGERLASLGQDILAKEKEAYFRNAGYILNPEGQWTPDLSKKHWSCNKPDYQKNGDCSYYRIGSAAKTRREILQELLTNGKKPKDIEKLQKGNDGIEETDKSFERNKDQYSVAPIEPGSLQSRSRSHLLKFEYGDDHQNLGAQLRTLDNKIGSRKIENRNYQVNYNFNNNSYLDLNLMAAHNIGKTIYPKGGFFAGWQVADKLITKNVANIVDINNSHTFLLPKEIDLKTTLGFNYFTNEYSKNRFPEELSLFYNDASHDQGLYSHSKRGRYSGTKSLLPQRSVILQPSGKQKFKTVYFDTALSKGIYHLNYSVNFTHYAFNGEYVGYENTAGQQINEPILHKSGHKKAFNHSATLSAELSDYFMPFFTYSRTHRMPNIQEMFFSQVSNAGVNTALKPEQSDTYQLGFNTYKKGLFTQDDVLGVKLVGYRSFIKNYIHNVYGVWWRDGMPTWAESNGFKYTIAHQNYKPIVKKSGVELEINYDMGRFFANVSYAYQRTNQPTNYADASPRPNNASQEDILKQGYGLSRVSMLPKDYGRLELGTRWFDQKLTLGLAARYYGKSKRATIEEEYINGSRFKKNTLRRENYYAVKKTEDIKKQPIILDLHVSYEPIKDLIIKAEVQNLLDKRYVDPLDAGNDAASQRYYSSLNNSIECAQDSSACGGSDKTVLYNFARGRTYILSLNYKF

SEQ ID NO: 17981 - protein, 170 aa, Haemophilus influenzae
MKKSLLAVIVGAFAFASVANAKIYAEGDIGLSQTKANGSNNTRVEPRVSVGYKVGNTRVAGDYTHHGKVDGTKIQGLGASVLYDFDTNSKVQPYVGARVATNQFKYTNRAEQKFKSSSDIKLGYGVVAGAKYKLDGNWYANGGIEYNRLGNFDSTKVNNYGAKVGVGYGF

SEQ ID NO: 17982 - protein, 359 aa, Haemophilus influenzae
MKKTAIALVVAGLAAASVAQAAPQENTFYAGVKAGQGSFHDGINNNGAIKKGLSSSNYGYRRNTFTYGVFGGYQILNQDNFGLAAELGYDDFGRAKLREAGKPKAKHTNHGAYLSLKGSYEVLDGLDVYGKAGVALVRSDYKFYEDANGTRDHKKGRHTARASGLFAVGAEYAVLPELAVRLEYQWLTRVGKYRPQDKPNTAINYNPWIGCINAGISYRFGQGEAPVVAAPEMVSKTFSLNSDVTFAFGKANLKPQAQATLDSVYGEISQVKSRKVAVAGYTNRIGSDAFNVKLSQERADSVANYFVAKGVAADAISATGYGEANPVTGATCDQVKGRKALIACLAPDRRVEIAVNGTK

SEQ ID NO: 17983 - protein, 912 aa, Haemophilus influenzae
MTKKPYFRLSIISCLLISCYVKAETQSIKDTKEAISSEVDTQSTEDSELETISVTAEKVRDRKDNEVTGLGKIIKTSESISREQVLNIRDLTRYDPGISVVEQGRGASSGYSIRGMDRNRVALLVDGLPQTQSYVVQSPLVARSGYSGTGAINEIEYENVKAVEISKGGSSSEYGNGALAGSVTFQSKSAADILEGDKSWGIQTKNAYSSKNKGFTHSLAVAGKQGGFEGLAIYTQRNSIETQVHKDALKGVQSYERLIAKTDDKTKAHFVIQDECPNGDYDKCKTSPKPPAILSTQKETVSVSDYTGANRIKPNPMKYESQSWFLRGGYHFSEQHYIGGIFEFTQQKFDIRDMTFPAYLSPTERRDDRTGPFYPMQDHGAYQRIEDGRGVKYASGLYFDEHHRKQRVGIEYIYENKNKAGIIDKAVLSANQQNIILDSYMRHTHCSLYPNPSKNCRPTLDKPYSYYRSDRNVYKEKHNMLQLNLEKKIQQNWLTHQIAFNLGFDDFTSALQHKDYLTRRVIATASSISKKGEIRNGDSKTPYFYPKPKVGFVGEDHCNYQGSSSNYRDCKVRLIKGKNYYFAARNNMALGKYVDLGLGIRYDVSRTKANESTISVGKFKNFSWNTGIVIKPTEWLDLSYRLSTGFRNPSFSEMYGWRYGGKNDEVYVGKFKPETSRNQEFGLALKGDFGNIEISHFSNAYRNLIAFAEELSKNGTGKGNYGYHNAQNAKLVGVNITAQLDFNGLWKRIPYGWYATFAYNRVKVKDQKINAGLASVSSYLFDAIQPSRYIIGLGYDHPSNTWGINTMFTQSKAKSQNELLGQRSLGNTSRGVKSTRKLTRAWHILDVSGYYMANKNIMLRLGIYNLFNYRYVTWEAVRQTAQGAVNQHQNVGSYTRYAASGRNYTLTLEMKF

SEQ ID NO: 17984 - protein, 1852 aa, Haemophilus influenzae
MLNKKFKLNFIALTVAYALTPYTEAALVRNDVDYQIFRDFAENKGKFSVGATNVEVRDKNNHSLGNVLPNGIPMIDFSVVDVDKRIATLVNPQYVVGVKHVGNGVSELHFGNLNGNMNNGNAKAHRDVSSEENRYFSVEKNDFPSTVNPQNEQKRREDYYMPRLDKFVTEVAPIEPSTDSSKKGTYNNKEKYPAFVRLGSGTQFIYEKNGSYDDRWVISGREQPVHYSNLKLVGKAYTYGIAGTPYTVNHVTDGLVGFGDSTQKHIDPKEILSQDPLTNYAVLGDSGSPLFVYDKEKGKWLFLGSYDYWAGYDKKSWQEWNIYKPEFATEVLNKYNAGSLTGANTQYNWNSTDNTSIISSDSKSLNVDLFDSSQDTDSKKNNHGKSVTLRGSGTLILNSNINQGAGGLFFEGDYEVKGTSENTTWKGAGISVAEGKTVKWKVHNPQSDRLAKIGEGTLVVQGKGENKGQLKVGDGKVILKQEADSSGKVKAFSMLGIVSGRSTVVLNDDKQVDPNSIYFGFRGGRLDANGNNLTFEHIRNIDDGARVVNHNMTNTSNITITGTGLITNPSQVTLGYIQARDEDNPYAPRRIKDGYQLYFDEENRNYYTLRKGAKFNSQLPYNDNESNETWLYMGKNSDEAKKKTMEYINNSRMNGFNGYFGEEETKATQNGKLNVTFNGKSEQNRFLLTGGTNLNGDLNVQQGTLFLSGRPTPHARDIAGISSTKKDKHFSENNEVVVEDDWINRNFKATNINVTNNATLYSGRNVESITSNITASSTAQVHIGYKAGDTVCVRSDYTGYVTCHNGTLSTKALNSFNATNVSGNVNLSDNANFVLGKANLFGTIQSTGTSQVNLKENSHWHLTGNSDVHQLDLANGHIHLNSADNSNNVTKYNTLTVNSLSGNGSFYYWVDFTNNKSDKVVVTQSAKGNFTLQVADKTGEPNHNELTLFDASNATRSNLDVTLANGKVDRGAWKYELRNVNGRYDLYNPEVERRNQIVDTTNIATTNDIQADAPSVSSNNEEIARVDEAPVPLPAPPAPATGSAMANEQPETRPAETTQPAMEEANTANSTETVPKSDTATQSDTSNSESVPSETTEKVAENNPQENETVARNEQEAAETTPQNGEVGEVAKEAKPTVEANTQTTETARQPEINSTEETAVKNDLTRSEPKSRPRRSISSSSNNINPAGTEETAKVETEETQKAPQMASQVSPKQAEPVPEKVPTDTNAKEAQPQTQPTTVAAAEATLPNSKPAEETQPNEKTNDEPVTSVSQNQPEKAVSQSTKDKVVVEREEKATVEKEKTQEAPQMASQASPKQEQSETVQPQAELESEKVPTVNNAEAQPQTQTSATVSTEQPAPENSINTGSATAMTETAEKSDKPQTETVASTEDASQHKANTVADNSVANNSASVKPTENSSTKAEQPVTESTTVNTRNSAVENPENTTQPAVNSESSKPKSRHRRSISQPQETSTEETTVTSTEKTTVANNSESSKPNRRSRRSVSQPQETSTEETTVTSTEKTTVADNSESNKTNSRRRSRRSVRSEPTVTSGSNRSAVALRYLTSTNTNAVLSDAMAKAQFVALNVGKAVSQHISQLEMNNEGQYNVWVSNTSMNENYSSSQYRRFSSKSTQTQLGWDQTISNNVQLGGVFTYVRNSNNFDKASSKNTLAQANLYSKYYADNHWYLGIDLGYGKFQSNLQTNHNAKFARHTAQFGLTAGKAFNLGNFGITPIVGVRYSYLSNADFALDQDRIKVNPISVKTAFAQVDLNYTYHLGEFSVTPILSARYDANQGSGKINVNQYDFAYNVENQQQYNAGLKLKYHNVKLSLIGGLTKAKQAEKQKTAELKLSFSF

SEQ ID NO: 17985 - protein, 803 aa, Haemophilus influenzae
MGLMDRGMTNVSAAMPRALMALSIAAALLPSLPALAQNSGNDRGSKAAGAAPQAPTATLDQVLVVGSNIRDAIGGGASPIIVIDKEAIDRTGVATVQQLFEKLPQNFGGGANGANVANLGVDRDTGNNFGQGTAINLRGLGTGTTLTLINGHRVTSSNRYQYVDVSLIPLSAVERVEILTDGASAIYGTDAVGGVVNIILRRDFTGYETAVRYGTVTAGGMEEYQASQSAGWSWDGGHVLASYEFLKQSNLPAVDKDFSKNVRVKPYDLYPGSKRHSLYVDGVQQLSDVLTLNVTGSFAKREMDTTISGTADETRLFPHTRQFDLFAGLTLDLPRQWQARLNSGFGRSDVSYQRTTITGSSASTAPPTDTNSESRYLDVVADGELFSLPAGPIRAAFGAGYRRDGYELIDHRGLEKPLDLHRTIRSAFGELNIPLLKDMPGVRSLSFTAAARYDDYSDFGSTLNPKLGLLWEATQGLSFRTSYGRSYRAPVYQDMQLNNTVVVANVPNPSAANGNTILMMLSNGNPDLGPERAKTWTGGFSFAPPSLPGLKIDANYYHIEYADRIGSGFGGSFPSLFLQSTAPYADILTSNPTQQQIQQARQLGISGLGLFVSRVGPYALPPGTDETNSRVILDNRFRNNAFTQQRGVDFSAGYDVDAGQTRIAMSLAGQYIIESKRRVTSTSPEVDAVNSVYYPVDLKMRGGIALSRQQAAAGIFVNYVDSYRDPANVARPHVSSWTTVDLNLAYHFGASADPQRGTSLAFNVQNLFDRDPPFIVNSINTGYDPTNATALGRFLSMSLTHRW

SEQ ID NO: 17986 - protein, 387 aa, Haemophilus influenzae
MKLDRVNKLVILSNILAGCLLPGIATAQSSVTLYGVIDEGIDYVNNSGGQHLWRMRDGTYDGMYGSRWGLKGSEDLGGGLSALFKLEAGFSLENGQMRQGGREFGRQAYVGLSKTDLGTVTFGRQYDSVVDFVQPVTAVGQFGGPFVRGGDIDNTDNSFRVDNSIKYASPSFGGFTFGGMYSFTNSNAPGLGTTGMWSLGAAYSHGGFNAGAAYFYAKNPAARFTDGNFIGNTTGAAIGASGPFSYVGAPRNERIMGIGADYAFGSATAGIDYTNTKFDDANGTTSSVTFSNYEVWGQYKVTPAATLGAAYVYTDGKVNYNGARPKYHQVSLMGSYSVSKRTSFYAMAGFQQAAGDAKQADIFDFSIADASTTNRQLMFRLGMLHQF

SEQ ID NO: 17987 - protein, 581 aa, Haemophilus influenzae
MPIGAPSCAWIPAITTGFRRICLASTPKPTCGRGRNRRPPRGSSTPRVCTKFDGGKLTTFADTSRTSQADYLSKSGMARGLGWDWNLYAPDWNRALAAAYCAPATRNAARCGFSGGVDNIEDAYYQSRALRDDDLFYMAGDFQPNDAISLHTQVYHHENKGQGHWWSPGQASNSGTPQALPISIRSTNDWINRTGGIASLGWDLGPHHLEAGLWYERNHHDLERNFYWITGPVSDDTFLQNPNRRLFSQNDVITTRQFYVQGNFKFLDERLSLDVGIKSPSTEMTARKTPGVAVKAPVATGLLTASESVLPQIGLGYRLAEGQEVFVSYAENIAAFQGAGAGGPLLVTEASFDASVGALEPEKSRTLEAGYRFVRDRFEASLVGYDVTFDNRLLSLNPCASIQQGTTPACTTRFFNVGSVSSRGGELTVIWKPTSDLQWYNSASINRSTYDDNYVQNGVTIPTAGKYTVDTPKRMFASEIAFNYENWNVNLRGKYTGQRYYTYTNDQGVGGYTSFDAGAGYAFGQVGVLQALKLSLNVTNLTDKRYASNLTAFANTDPNGRQLAFHASAPRQVFLTLDAKF

SEQ ID NO: 17988 - protein, 456 aa, Haemophilus influenzae
MKKFNQSLLATAMLLAAGGANAAAFQLAEVSTSGLGRAYAGEAAIADNASVVATNPALMSLFKTAQFSTGGVYVDSRINMNGDVNSYAIISNSIKVTNDGSASARNVVPGAFVPNLYFVAPVNDKFALGAGMNVNFGLKSEYDDSYDAGVFGGKTDLTAINLNLSGAYRVTEGLSLGLGVNAVYAKAQVERNAGLIADTVKDSQVKTTLIVQQEPLKSIDKYLPSKDTSVVSLQDRAAWGFGWNAGVMYQFNEANRIGLAYHSKVDIDFTDRTATSLEAEAIKAGKKGDLTLTLPDYLELSGFHQLTDKLAVHYSYKYTHWSRLTRLYASSENGKKAFDKELQYSNNSRVALGASYNLYEKLTLRAGIAKDQAASCLQRSAAIPDTDRTWYSLGATYKFTPNLSVDLGYAYLKGKKVHFKEVKTIGDARSLALNTTANYTFQAHANLYGLNLNYSF

SEQ ID NO: 17989 - protein, 215 aa, Haemophilus influenzae
MKKTVCGIAVIAALMSTSAFAHKEGDFIIRAGAAIVSPNDSSGDVLETSGSKFGVDSNTQLGLTFGYMFTDNISLEILAATPFSHTISTNHGGLGDIAETKHLPPTLMVQYYFGEANSKFRPYVGAGINYTVFFDEELNGAAKDAGLSDLSLDDSWGLAANVGMDYMINDDWFLNASVWYADIDTTAKYKAGGKQYSTDVDIDPWVFMIGGGYNF

SEQ ID NO: 17990 - protein, 369 aa, Haemophilus influenzae
MKKTLAALIVGAFAASAANAAVVYNNEGTNVELGGRLSIIAEQSNSTIKDQKQQHGALRNQSSRFHIKATHNFGDGFYAQGYLETRLVSAQSGTESDNFGHIITKYAYVTLGNKALGEVKLGRAKTIADGITSAEDKEYGVLNNSKYIPIDGNTVGYTFKGIDGLVLGANYLLAQERYKYTTAAAAGAAGAAGAVAGEVYPQKISNGVQVGAKYDANNIIAGIAYGRTNYREDIASPDLGKKQQVNGALSTLGYRFSDLGLLVSLDSGYAKTKNYKDKHEKSYFVSPGFQYELMEDTNVYGNFKYERDSVDQGKKTREQAVLFGVDHKLHKQVLTYIEGAYARTRTTESKKGVKTEKEKSVGVGLRVYF

SEQ ID NO: 17991 - protein, 163 aa, Klebsiella pneumoniae
  misc_feature (157)..(158): Xaa can be any naturally occurring amino acid
VEGITNVTGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDAGIKXXLYRTV

SEQ ID NO: 17992 - protein, 140 aa, Klebsiella pneumoniae
VGTLLSYDFGGSDFAVSAAYTSSDRTNDQNLLARGQGSKAEAWATGLKYDANNIYLATMYSETRKMTPISGGFANKAQNFEAVAQYQFDFGLRPSLGYVLSKGKDIEGVGSEDLVNYIDVGLTYYFNKNMNAFVDYKINQ

SEQ ID NO: 17993 - protein, 140 aa, Klebsiella pneumoniae
VGTSLSYDFGGSDFAISAAYTSSDRTNDQNLLARGQGSKAEAWATGLKYDANNIYLATMYSETRKMTPISGGFANKAQNFEAVAQYQFDFGLRPSLGYVLSKGKDIEGVGSEDLVNYIDVGLTYYFNKNMNAFVDYKINQ

SEQ ID NO: 17994 - protein, 348 aa, Pasteurella multocida
MKKTIVALAVAAVAATSANAATVYNQDGTKVDVNGSVRLLLKKEKDKRGDLMGNGSRVSFKASHDLGEGLSALAYAELRFSKDVKNKDGEVIKQPIGNNVHAKRLYAGFAYEGVGTLTFGNQLTIGDDVGVSDYTYFLGGINNLLSSGEKAINFKSAEFNGLTFGGAYVFSDDFDKNGLRDGRGFVVAGLYNRKIGDVGFAFEAGYSQKYVKQEVASVLPAPSGSVTVYKDEKEKAFMDGAELSYAGLALGVDYAQSKVTNVDGKKRALEVGLNYDINDKAKVYTDFIWAKEGPKGATTRDRSIILGAGYKLHKQVETFVEGGWGREKDANGVTTKDNVVGVGLRVHF

SEQ ID NO: 17995 - protein, 234 aa, Fusobacterium nucleatum
MGIYHWSRKTKMKRTKSIRHASFRKNWSARHLTPVALAVATVFMLAGCEKSDETVSLYQNADDCSAANPGKSAECTTAYNNALKEAERTAPKYATREDCVAEFGEGQCQQAPAQAGMAPENQAQAQQSSGSFWMPLMAGYMMGRLMGGGAGFAQQPLFSSKNPASPAYGKYTDATGKNYGAAQPGRTMTVPKTAMAPKPATTTTVTRGGFGESVAKQSTMQRSATGTSSRSMGG

SEQ ID NO: 17996 - protein, 200 aa, Wolbachia endosymbiont
GPISDEEPSYYVRLQYNGEVLPFKTRIDGIEYIKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAEAGVAFNF

SEQ ID NO: 17997 - protein, 199 aa, Wolbachia endosymbiont
GPIRDEETSYYVRLQYNGEVLPFYTKVDGITNATGKEKDSPLTRSFIAGGGAFGYKMDDIRVDVEGLYSQLAKDTAVVNASETNVADSLTAFSGLVNVYYDIAIEDMPITPYVGVGLGVAYISNPSKASEVKDQKGFGFSYQAKAGVSYDVTPEIKLFAGARYFGSYGASFDKAAKDDTGIKNVVYSTVGAEVGVAFNF

SEQ ID NO: 17998 - protein, 200 aa, Wolbachia endosymbiont
GPISDEEPSYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAEAGVAFNF

SEQ ID NO: 17999 - protein, 198 aa, Wolbachia endosymbiont
GPISDEETSYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARYFGSYGANFGKTAKDDGGIKVLYSTVGAKAGVAFNF

SEQ ID NO: 18000 - protein, 199 aa, Wolbachia endosymbiont
GPISDEETSYYVRLQYNGEILPFYTKVDGITNATGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTVIKNVVYSTVGAEAGVAFNF

SEQ ID NO: 18001 - protein, 202 aa, Wolbachia endosymbiont
GPISDEETSYYVRLQYNGEILPFYTKIDGIEYKKGTESHNPLKASFIAGGGAFGYKMDDIRVDVEGVYSYLNKNDVKDAAFNPDTVADSLTAISGLVNVYYDIAIEDMPITPYIGVGVGAAYISTPLKTAANNQNSKFGFAGQVKAGVSYGVTPEVKLYAGARYFGSYGAHFDKDAAAGKDKGELKVLYSTVGAEAGVAFNF

SEQ ID NO: 18002 - protein, 196 aa, Wolbachia endosymbiont
GPISDEETSYYVRLQYNGEVLPLFTKVDNMKIKKGTDDVDPFKASFIGGGAAFGYKMDDIRVDIEGLYSQLNKNVNNDEVLTPDTVAGSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAELE

SEQ ID NO: 18003 - protein, 200 aa, Wolbachia endosymbiont
GPISDEETSYYVRLQCNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAEAGVAFNF

SEQ ID NO: 18004 - protein, 146 aa, Wolbachia endosymbiont
GPISDEETSYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGLAYQAKAG

SEQ ID NO: 18005 - protein, 268 aa, Vibrio parahaemolyticus
MRKSLLALSLLAATSAPVLAADYSDGDIHKNDYKWMQFNLMGAFDELPGKSSHDYLEMEFGGRSGIFDLYGYVDVFNLTSDKGSDKNGKEKIFMKFAPRVSLDALTGADMSFGPVQEMYLATLIEWGGNSDVNSQKIGLGSDVMVPWFGKVGLNLYGTYDSNEKDWNGFQISTNWFKPFYFLENGSFISYQGYIDYQFGMDNDNKALNTSNGGAMFNGIYWHSDRFAVGYGLKAYKDVYGLKDDGLAGKTSGFGHYVAVTYKFSEFEA

SEQ ID NO: 18006 - protein, 628 aa, Rickettsia felis
MGTLSIKESNKGSIKLSQVALLVSSIISLSSYSAMAEDVTANAVDVDEKITVTGSRFDRTADQQLTVINTIEREEIARLNPKSVADVLETLPGVSISRNGGAGQATSVSVRGSNSNHVLVLIDGVKVGSATLGTVSFNTLSPENIERIEVLKGPRASVWGSDAIGGVIQIFTRQLKDGEWFAGAEYGSNDYIRGSFGTGMSHGKGSTTLAVNHEQSDGYDVYNGAPVENDDDGYNRTSLSLKGSQQINQNWQALWNGQYDKGNTQYDDIYAFGSADESDFDNYLWNLAAQYSNEQFTSKLALSQSSDANENFRGDDITVPVSVFETKRDQINWSNQYLAANDLTFIGGIDWSNEAVKGDYAQDERDIFGAYILAQKQWSQLLAEVAVRYDDVENIDSEVSYNASLAYQLTEEWRLAASTGTAFKAPTFNDLYWPGSGNPDLISETAKSYDLTLHYQANDIHAYISVFKNTIDNLIAWVPTGEKDDYGFDIWKPANINQAEISGVELFTKFGLFGFDNQLAYTYLEPENKKTGEMLIGRSVEELNYSLSYQWQSFDFLANYHYQGKRYAGYDLYLEAYHKLDLSIGYHLDDAWSLRLKANNLFDEEIISAQNYFSPGREFFFSVSYQAF

SEQ ID NO: 18007 - protein, 242 aa, Rickettsia felis
MKKLLLIAAASTALLTSGLSFADCDMNSSVDASTNSSMSSSVENQWYLKLNVGGVIFNKTKHKGADFKLKSNTGFTGEIGAGYYIMDNLRTDLTIGTVASSHLKKSKTYPDGASFSVKNKPTIVSVLFNGYVDFVDLSMFKVFTGAGVGAAFIKEKINSKDIKDGVTKTFNGTTKNKTNFAYQLSLGTSFEVAQGVKAELVYSWRDYGKTKNTTKTIDGDKVKFGGTRYKGHNLMAGLRFDM

SEQ ID NO: 18008 - protein, 260 aa, Rickettsia felis
MLESSKVPALTRAIDILNLIARIGPCSAATIIDTLGIPKSTAYLLLNELRRQRFLSLDHQENFCLWTRLVELSGHALSKMDLRELARPRLTQLMDTTGLLCHLGIIDNGSAYYILKVESSATISVRSHEGKSLSLYRSGIGKCLLAWQPAAVQQSIIEGLVWEQATPTTITHPQQLHEELARIRRQGWSYDNGEDYADVRCVAAPVFNANNELTAAISVVGTRLQINEEYRDYLAGKAIACARDISRLLGWKSPFDLQAS

SEQ ID NO: 18009 - protein, 922 aa, Rickettsia felis
MKFNLRFLFIALFICTISIAQNKGTISGVLTDKEMNNDPLPFANVLVKGTNISVNTDVDGKYSLSVNPGNYTLIFSFLGYESKEAPVNVKANETVVINQALSSGSFTLKDVVVKSAAVNRQKESALLLEQKNAVDIKQSIGAQELSKKGVSDAAAAVVKTTGITKQEGSNNIFVRGLGDRYNSTTMNGLPIPSNDPEKKNINLDIFSTDIIEFVSIDKVYNGKFFGDFAGGNVDIVSKDYKGNGFFKIDAESKVNTNALGEDNFALQTGPSAFGFSKPSIPNNPLTEYNFGSLQFDKKTPLGGAFGVSGGDSFNVGEGKINIFGTASFTNEYSSRTNGTAKGSVNAAGVAGKDLDYHYLSYNTNTTGMFNAGYKINNNNKINFNSLYINTSAQRKEESSGYIVDLANDGNGYIRRNEYEKTDLWVNQLLGEHKLSDRSTLNWGGSYNIVNQTIPDRTYNTFNLVEGGYVINSQSAPNNNRYFQNLKEKELAANLSVNYKFSKNDEGDYRGKFTAGYNGRFKNRDFEATQFNLKTTTFPVSHTGDIVDPNNLDLFYNQQNFANNYFTISTFRGGPEVPNALDPQTYSGDLTINGGFLNTEYKFNKLTAVLGLRAEVITQNVEWSTQLDPEGGSDKLEKTAFLPSLVLKYELNEKQNLRLGVSKTYTLPQFKERSPFIYEEFLQAKIGNPFLYASDDYNFDLKWELFPSSEEVLSVTAFGKYILNPINEVIINSSTNDISYVNSGDKGYVAGAELEYKKVLFNFDSENAKKLTGGINISYLYSKQDLDNEKVNEETNGTRPTTFTNTTGKFTGASPLLLNADLSFYNEWNDKNSNLTTTIAYNYFSDRVNAIGTLEKGDLVDKAVGSLDFIAKSKLNKNYGLGLVVKNILDPTINRVQENKSGDVNVLSYKKGLNLSLQFSYEF

SEQ ID NO: 18010 - protein, 878 aa, Rickettsia felis
MAKLPSKLPGRKFQVSNTNPASAGHTALRAMLCLGVGLTALSAVAAPALAQESETEDTRTMQTVTITATKREQTLQDVPIAVSVVDEATIERAAIVDLNDLQSIIPSLRVGQLQSSANTNFVIRGFGNGANNAGIEPSVGVFIDGVYRSRSAAQISDLPNIERVEVLRGPQSTLFGKNASAGVISVVTKKPQYELGGVVDATLSNENGYRANGYVTGPLAENLAGAVGVTYNKRDGYVDDIGTGTETNERNRWGIRGDLIFEPNVNTTFRLLGDYDNIDELCCAAGNVINGPTGGIIQAIGGTLVPEDPYSYRVAYNLPSTNKVDNGGVSLQGDFDFSGMRLTSITAYRISNLETNQDSDFTGANLLGENSNKTDIDTFTQEIRLTSTDGDRLDWMVGGFYFDETVEIENALLFGDDYRNYANALAGGLNPATGTITDILAGLESALGLPVGTTFAQEGQGFRDDAGQDNTAWSLFGTVDYRLTDRLTATVGLNYTEDKKDAYNNIAASDVLSSLDLVAIGFAQALGGVGVDATDPAQVGAFAAAFPTEFAAIQAAVQDPASNPLLALQPLQFLPPFLGFPNVVEDGRTKDSSTTYTLRLAYDVNDNLNTYVSYATGFKATSWNLSRDSRPFARDFISGSPVTNPPSSPIRDAGLALPNLTSGTRYAGPEDSAVFEVGLKGVYSTVAFNLAYFDQTIEGFQSNVFTGTGFALANAGKQSNKGVEFDVSWNPINDLQLVVAGSVQDPVYDEFPNSASGDLSGQTPAGIPEVATSTAATYFFDVGSWDAYVRGDWQYESPVDHFDSAADQALIGEQKEVSTFNASSGFTNENGLGVTLWIRNIFNDEYITTAFPAVAQAGSIMGYPSAPRSYGVTVRKTF

SEQ ID NO: 18011 - protein, 2340 aa, Rickettsia felis
MKKSKILRKFLATASLCGTLFTNSNATGTIIPNNGSVSLNTDAGLVGGVFNNGDIIQIVNGGREIKISADKANAIIGGINTLKELPDFGGVEVSQNVSIGPLNAGEDLNTNFGPLKFISNNVTSIITGVGTKTFSNIDFAGKNATLQINKDLNITTKIDNTVAGNNGSITFEGSGIISNHIGYTNSLLGINVGNGEAKIYAPEANNITINAKNINLTHNNSILTLCDGNITTLKGNINNTTEIDGQGILNLAYDLGSSSIITGDIGNIGSLDTINVLLGSATFNSTILKATNINLKHNTSTLNLDDNIIVIGNIKGNNNKDILNFKVHGTNLDNEMIIPAPQKTHGTLNFKGNATLNGNINNLNILKFSGGHGKTLNLQGNTKVDNLVFADSVLDSGTISVNGLLDTDCVTFNNSNVNGGTLIINAKNTISAKLLNATKAKIQINANLTMNHPSAGDISDIRIADNTIYTIDAKNGNVNLLNNNAKIIFEGADSMLALINTGVTADRTFTIYNNLNQSGNDEYGIVKIEAIKKVITIANQSGPYTIGQDNTHRLKELIVEGAGDIIIDDTIFTKLLSINSTGQITFNRTLDLGAGGNIAFGKHGTLVVNGVTGSITTSENNQGILTINSGNITGVIGTNELGLKLVNIGADPVTCSANVFASVALTNPSSVLILADGVTLTGEVTTHNNTKGVLSLGTGSNITGQIGTNSAALEKINIGAGASNIDSNIYAGSTVLTDQTSELTLNNDVVVNSNIITTAGNNSGKLIFTGNGGITGNIGANGAALQEVVFNGTTNIGGTANSQNFTVAHSAANVVITGLTTGALKYKDTGTIIAHGGLVGDIDFNNKAGKFILGDGAMIDGSVLCNGGVAGTLDFIGDGNVTQNIGADNANSISTINIQGDNTKNVTIANDIFVDNIHFTNGGILQLGGNLTTHNIDFGANGGTLEFNGNNTYNLNAIIVNGQNGILNAFTNLKASDDTIGTVKIINIGQIGTPQNFTIQVNNKNLTLVSSVNSSINFGDANSQLILSAPVDQTIKFINNLNETGGGIITLDSNGNNLTISGNNGIKLGSKGNELSSLNIKGKVTVTNDLDIQNIHQLNINNGALFDDQSLTSAKIKNINIGTVAGGATYTLDAINDNFDLNTSGMVFKHQDSILELKNSSNTNDHTITLTSALDPGNNQFGIIKLITDTNKLTIDNNGNVAYTLGTANHMLKQLTFASIDNGAIALKVGINVENVTLNIKDIELNEVNANVLFNKNTTYTATGNINGHVDFQGNAGVINLNDDIEIDGSVTSTGNVNGTLNFNGSGKVTGLINNIVMLQAGAGDVSLSASGNYSITEIQGNGNNNLTFAANSHLTTDINKTGGQDLNLVFINGGSVSGSIGANAAVGDIIINAGSVNFSNTLKSGNIVISDGATMQVNNNVTATDISGKNANNGTLKLNNHTPINITSTLGNNNAIGTIEVANNDVTITGTLQAQNIHFSNATQAATLTLGAASQVTNITTAGNNIHTLEVTDFDTGNDGIIGDANNRLKSIELTGNGTVTINSPHVYSSITTANNAQGNVKLNIEGGITYDLGSKIKSLANVQISEDTTIRGDVYSKYLNIDAGKTINFDRGDNNMNPKNLDIPDALIDLDVLPRSLSLFNYFTDIKADNLNFADDTATANFKDAVVIDAHIDNGGILKFNDNAWLTQEIKNANIIEIASDKFMLLQKNIKAATLIADNANLVLLDNVEVNTNLNVRDIVLDLANYELKYTGNVTHNGLLTIITYFDTALQKGGHILVSQGSNVDMSDLDNLIIKIKAHSDITNITSDTKHQIVKLETGAIYTPVPQTKVIIDASEEQNKFVKWVADANGLVLLTDTGGRDDTGGRDDTRGRGNTDNGCRDNCDVGNISNNSSNEAGGSSSDKNYGITDVVPIFDPSPILDYTKNNYVASGIANQLINHVKDFGNTTDAGKLLNDLGFMSPNRVTETLDRLSNRINVNGLNEGVVGLNGIEVENFLTDIAINMDNFTAKEIGNRLEELSDANTVNGLNKTNTLLNNKINLKRLNTNNQAIIAAGDEDNIVTGIWGMSFYGKIKQNSKNSASGYQSNTGGGIIGFDYNIDNSIVIGAAYTMADSKVKHKNDKNGDRTKAKSNIYSIYGLYNWLTNNFFVEAIGVYGRNKIKNYEKRITTITDQIAIGKFINTFYSYELLGGYNYLISHRTTITPMFGMRYATFKNNGYKENNTTFQNLSIKKNYYDKFETILGLNSVTHYLSQDIIIKPELHWFINYQCKNKLPNIDARLDGIDEPLTTIRFKPAKITYNLGGGISTKNNMIEFGIRYNLSLAKKYTAHQGSLKIKVNL

SEQ ID NO: 18012 - protein, 520 aa, Rickettsia felis
MIGTLTTSSAQAQSGNGSDAEIALLKQQLRLMEQKLDRLQRQTSANAQAAASASAKADTAKAEIKTAVANANAAIPVKGAVAPSGVVVTMPNNRPTICTADEQNCISLTSRVHWDVGGYDFRPNSAATAPQRLDNGENVRRARIGVLGKFLGDWNYALVYDFGGTSDGFGGTAAGSLPGGGVSGIENAYLSYTGIRPFGGKMAIEGGIMDVPWTLAEATSSNDILFMERASSNVIATNIAAGDFRSAIGSRWWNDTFWAGAYVTGPTTGQIHSYSSVTPNGSTEQYGVVARAAGQLVSGSDYSLHLGGNFEDLIQPARNTVTGAQTLTLSDRPELRIDPTTLISTGAIANVSNAQVYGIEAAATYGSFFFQGEYYWYNVERGANTGLPPFGARNLKLDGGYAEASYVLTGERHKYNPATASYSGITPARPFAWQSGDWGAWEIAGRFSTVDLNDQLATAAGIAGGRQNIYTAGLNWYVSGNIRFMLNYLHGDIARQASATSTVNTGSKFDAVGFRTQVAF

SEQ ID NO: 18013 - protein, 711 aa, Rickettsia felis
MSNFVLQSFTMSKFYVHPLTWSILLAQSSMVSVTLAAETGTQVQTVQLSTLILTAEKQDERHASSQAITQFNHDLIDVPFTKSHVSEQDIKNHNIQRVSDALALVNGVVYQDSYGGGFWDNYSFRGFSTDPNMGTIYMRNGLSSLSGIHAPRDMVNIQSIDFLKGPMAAMYGQGAIGGIMNITTKQPEWQRKSELTLSGSTLEEYRTALDTTGAINDQLAYRLGLAYENNQSFRDQVDSQHYYIAPQLAWKISDRTQLNLDTEFAKNQGVFDRGVPMVNGQFVVNKKTFLGEPSDGDIKINDQMYQLRLNHQFNDDWNLTTALSHEQGEREGTSTEISSIAADGQTANRFRRYRWFDTETTQFQTILRGKLNTGTIKHELVANVEAGHYTIDQLQLRSAKDASSSINIYNPVYGETILPLTRIAKYTKETQDMLGFNLQDQIFLNDQWNILLGGRFNRLQQQINDYANQQNSKQSFSPFTPRAGINFKPIDHLSFYSNWGKSFELNTGLNKNNQLYDPEKTTSWEVGTKYEYLPQSWLGFTYFDLDKRHLLTEGITDTYVDSGRVQSHGVEFELQHQVSEHLRLNANYTYTDASVVESEVEAKGARLKNIPKHTANLSADYQFSAWGKDAGVTGNINYYGKRSANYIDNGTSLPEFTTVNVGAYIKLRSDLRAQLNIDNLFDKDYYVSSYTNYWVQPGEPLKATLSFSWMF

SEQ ID NO: 18014 - protein, 234 aa, Rickettsia felis
MQSVNRNDSKSDVLALCGAVPMHRKSTGNGVPLLKKGAINLYMNMPCPLKVVTKMVITEFAEIYNASHAVPIYSPMLHDGYVKDGKNNIPAYELQNISRAMTRGIELTASIKLPYGLTVSDELTFLDSEDKSKGQDLLYVPDVTNTLKLAYGAERSGFNGNIRVVSVGTQWVENNVRADGYTLVNAYLAKKVSSDTSLFFGVDNIFNEDPAAYGNIGGAGSTGTCFYGGLTFTL

SEQ ID NO: 18015 - protein, 1652 aa, Rickettsia felis
MAQKPNFLKKLISAGLVTASTATIVAGFAGSAMGAATQQNRTTAGAATTVDGAGFDQTAALANLAVAPNAVITANANDGINFNTPAGSFNGLFLDTANNLAVTISEDTTLGFITNDANKANFFDFTLGAGKTLTITGQGINAGQATVTKNAQNIVVQLNGGNAIANNDLSGVETIDFGAAASTLVFNLTNPTTQKAPLILGDNAVIANGANGTLNVTNGFIQVSDKTFATVKTINIGDGQGFIFNTDATNGNVLNLQAANVTINFNGTDGTGRLVLLSKNGAATDFNVTGSLGGNPKGIIEFNTTAVAGQLIANAGPASAVIGTNNGAGRAAGFVVSVANGNAATVAGQVYAKDMVIQSTNAGGQVNFDHIVDVGTDGTTAFKTAASKVAITQNSNFGATDFGNLAVQITVPNTKTLTGNFTGDASNNGNTAGVITFAANGTLASGNADANVAVTNNIKAIEAAGVGVVQLSGTHTAELRLGNAGSVFKLADGTVINGKVNQTALIGGALAGGAIQLDGSATITGDIGNGGGNAALQGITLANDASKTLTLGGANIIGANAGRMIDFQANGGTIKLTSTQNNILVDFDLAIATDKTGVVDASSLTNAQTLTIKGNIGIIAANNKTLGQFNIGSSKTVLNAGDVAINELVIGNNGSVQFAHNTYLITKTTNAAGQGKIIFNPIVNNNTTLAAGTNLGSATNPLAEINFEAPAGGATTLNVGKGVNLYATNITTATPNVGTFSFTAGGTNIVSGTVGGQQGNKFNTVELDNGSTASFLGNATFNGETTIEGNSTLQIGGNYTTNLFTSVDNTGIIEFVNADPITVTVNKQARVVNELKQVTISGPGNVVINQIGNAANPGAVTDTVVFANASLGASLGASLSLASGILLDGLTIKSTVGNKVAGGGFNAPRLIVTNVDSTIAPGQVIGDQNNIIGLGLASDNTITVNDATVYATLFAVNNDEGTIELNGGVPNTPGTIYGLGFKNGDPKLEEVNFTTNYNNLGSIIATNAIIEDGVTVTTGGTAGKDFDGKITLGSVNGNSNVIFVDGTNSTATSMVSTVKANNGTVTYLGRASVGNIGSSDTPVASVKFTGPAGSLEKLLGNIYSTATNFGNVNLNVAGSNVTLGGGTTAINGNIDLVTNTLTFASGTSTWGSNTSLSTTLNIASDSSGVIGHIVIAENAKVNATTTRTTTINVQDNANANFSGTKTYILIQGGARFNGTLGGPNFAVTGSNRFVNYDLIRAANQDYVITRTNNAANVVTNDITNSPFAGASGVGQNVATFLAETNTAAYSNLVNNAKNSANSANFVGAITTDTSAAVTNAQLDVAKDIQAQLGNRLGALRYLGTPETAEMAGPEAGAIPAAVAAGDEAVDNVAYGIWAKPFYTDAHQSKKGGLAGYKAKTTGVVIGLDTLANDNLMIGAAIGITKTDIKHQDYKKGDKTDVNGFSFSLYGAQQLVENFFAQGSAIFSLNQVKNKSQRYFFDANGKMNKQIAAGNYDNMTFGGNLMVGYDYNAMQSVLVTPMAGLSYLKSSDENYKETGTTVANKQVNSKFSDRTDLIVGAKVAGGTMNITDLAVYPEAHAFVVHKVNGRLSKTQSQLDGQVTPFISQPDRTAKTSYNVGLSASIRPDAKMEYGIGYDFNAASKYTAHQGTLK

SEQ ID NO: 18016 - protein, 1032 aa, Rickettsia felis
MLQVGEGELKNTLSGTGSLVKIGTGELTLSGDNTYSGGTTIDDGVLIAANVNALSGGDVDNSGTLMLDANGAFELANITTHTGATTALAAGNTLDAGQLTQEDGSTLSIDLGAATDDAVITADSVTLGGTLNVTGIGSVTDSWTPEAYTYTLIDSDSAITSDFDDLTIAGMNREDVDFLTIDGKVDEADNTHYDLTASLSWYADRDNATTDAHGTFTLSDPDGSFNVAATLTDVDDTLDPGSRWDGKSLTKEGAGTLILSGDNDYSGGTTINEGTLVAASTTALGTGLVDNNATLVLDVDGEVSAVGGITTHSGATTQLALGTSLDLGDSALIQQDGSTLNVELNSDSVQPLITGGSATLGGDLVVSDASLQARASDAEFQSFKLMDMTSDISGDFTSLTMNLTDKPDYLTVTGTINPEDASEYLLTEGLSWNATATSATPAHGTFTLGAGDSFEVTSVLGDKTGNGDWDGKTLTKLGAGKLTLSGVNTYTGDTNVQEGTLWLAGDGTIGEVGSQQAVNVASGATFGGSNGTTVNGKVTNEGTLVFGDSEETGAIFTLNGDLVNMGTIASGSTSSTPGNTLYVDGNYTGNGGSLYLNTVLGDDDSATDKLVITGDASGTTDLYINGIGDGAQTTNGIEVVDVGGVSTSDAFVLKNEVNASLYTYRLYWNESDNDWYLASKAQSDDDDSGGDDSDVTPSDGGDDGGNVTPPDDGGDVAPQYRADIGAYMGNQWMARNLQMQTLYDREGSQYRNADGSVWARFKAGKAESEAVNGNIDMDSNYSQFQLGGDILAWGNGQQSITVGVMASYINADTDSTGNRGADGSQFTSSGNVDGYNLGVYATWFADAQTHSGAYVDSWYQYGFYNNSVESGDAGSESYDSTANAVSLETGYRYDIALSNGNTVSLTPQAQVVWQNYSADSVKDNYGTRIDGQDGDSWTTRLGLRVDGKLYKGSRTVIQPFAEANWLHTSDDVSVSFDDATVKQDLPANRAELKVGLQADIDKQWSVRAQVAGQTGSNDFGDLNGSLNLRYNW

SEQ ID NO: 18017 - protein, 767 aa, Rickettsia felis
MNFRLLLFGALFLLLSNFSADIFAQPMLRGKVMNSHGEPVFQATLEVKESGSRTSSKMDGRFEFQNINAGTYHVKASHLGYEPVEITTKLGENDSSHVVIRFEKEKEHVLDGITVTATRQAARPEDVPQPVAQISSEEVERSYRYNVGEMMDFIPGLRVIRSGATIGADYGISIRSLNGGPSSDKTLVLIDGRPLNNGWDGGINFNMLPTEMVERIEVVKGPASALYGSQATAGVINVIAKDPASGWHGKVSYIREFDASQEISDSDADGYARPDIGGTNVSFNSTFGDVNTDHFLSFGYREATEDYLTNLSNDWENYDFNYRLKHQLTDKLHTTVSTDVHQNSWLYNAESTPTDEHYRFVGADFALKYFAKNGQLNTRIYLNNVDYNELVLSTDSETGFNTSRIGLMSDYTIPVFDGKGSLKIGLDGYLDVASVEYDDAVENLQFQGVQTILVKQKSGAWKETTVDLYTGTYASRSDDYDLTNIALFAQYEHSFAQKLNILAGARLDNHSEFGTVFNPKFGATYRLLTIGENTTTLKANYGKGYRAPNMRDLYSKSLGGYGDTDIEPEENESFDIGIFQRFGDWGYLEVSYFTMKVKNLIINDKVGTSNGGYYVVVQNSSGSTDTSSFNYRKNLGDYSPSGIEVGLKIRPIENITFSASYTYLDPEDFTFQTSENRYNASLYGWTDLESVRLEAELTYNVTGDGYFFDYKSTPYEAFSLLDMMLAASFENYRISLIGKNLADTKYRLWHYEWQPGRTLALRFEMSY

SEQ ID NO: 18018 - protein, 1006 aa, Xanthomonas campestris
MLCRNIKRSALSLALGMCVVGGVQAQSAVGSIFGSGQPGSTIAIQSPQTGVSRSITAGADGRFTFSQLPPGKYMITADGVTREVDVKVGSGSQVLLGSDAKTLDRVEVVGVQAFNPIDVSSVESTTVFTAEQMVSLPVASDVSSVALLAPGAVRGDSGLGAGNLASFGGSSVAENGYYINGFDVTNMRTFLSFANIPFQGIGQLQIKTGGYGAEYGRSLGGIVSIVTKSGSNDWHYGASVEWAPDWGAAAGKNVRERDPDASDPLYQYRSDDQFDSTIYSAYASGPIIKDRLFFFAMVEGRQETEDNFYALTSRRVSDTTPQGLVKLDWYINDSNLVEFTGIYNQAKTKYRTYEYDTDANGDNRYNVGRHEVPIEQYEMENGGKVGILKYTGYFTDNFTLSAQYGYLSNLIDSRLPANPAGGECPWAYSFGLTTSVIDRYIGCNPGTITTIADLDAEPDEDVRKAFRVDGEWVLGEHRLRFGVDQEKYESSHRGQTYAGGINWAYYTVPGNAVATGAFAGQPGRTVNGQLVPRGALYARSRVYQTSSSSYENTNSAFYLEDNWQVTENFLAVLGLRGEKFENKNGDGIAWIESDYKMAPRLGFSWDVLGDASLKLFGTAGRYYIPVATNSSIRATGAESTVSNWYFVNGWSEADGTPVGQGAQIGQTQANGSLTAPNPASVASTNLSPMYQDEVILGGQLQLTENWMAGVRMIRREVKSGMDDTCTTNPWIDWAADNGYPDFDPGSVPSCYFLNPGSDVTLNVDLNGDGEVELATLPASYLGLPEYRRLHTALEFFWERTGEKFNFQGSYTFARTRGNVEGYVNSTLEQEDAGLTQDFDHRLFTDGTYGPTPNDRQHTLKLFGAYNLTPEWQFGGNLVLQSGRPINCQGYIPLDDIPQPDQGNLSGYSGSSFYCLNAEGTRELRQRGDEGRTPWTWTFDLAAAYIPNWADNKLRIKLDVFNLFNNDRVTEYNEFSEASRDVISPNYLNDGNYQTPRSFRLTARYDF

SEQ ID NO: 18019 - protein, 655 aa, Xanthomonas campestris
MPPSARHYKLTTLAALISAASYSATLLAEESTVDLDKLVVSASGYEQQISDAPASITVVTQQDLEKKAYRDVTDALKDVPGVMVTGGGSTEEISIRGMSGKYTLILVDGKRQGSRETRPNSDGSGIEQGWTPPLSVIERIEVIRGPMSSLYGSDALGGVINIITKKVQDKWGGELSLSTTIQDSSTSGDSQQADLALSGPLVKNKLGLQLYGQISQRDEDKIVDGYADQEIKNATAKLSWAVSKNQQLTFEAGKEEQSRYRNPGYSIASNGSVSEQDYDREHYAITHSASGNGNSIDTYLTHEEIDNPSRDMNYQNTVLNNQTVLPFNSHVLTVGGQYDYQKLKDEGNEAGNGIDELTRWNAALFAEDEYFITDNLSITGGFRYNEDENYGSNVSPRLYSNWSFAPDWTLKGGISTGYRSPDLRQGSEGWGQISGRGSALILGNSDLKPEESTSHEIGLYWDNQRSTQISATLFHTNYKDKITEQRVCDTTAGDASCSYSGNSYTFISERMNVDRVEMQGIEFTLSHEFSDALTVVGNYTYTESEQKTGRFAGEALNRLPKHMANATLNWDVTPKLTSWTRINYRGESSEGLNRTSMQEAIPSYTFVDTGISYNVNDTISVYAGVYNLFDKKVDVDTYETVLDGRRYNAKVKMTF

SEQ ID NO: 18020 - protein, 372 aa, Xanthomonas campestris
MTDSNGRAGRLAVPLAALLACAALPAAAQSSVTLYGRIDTAIEYANAGPNHVTRMGSGNLWASQWGLKGVEDLGGGYATIFKLEDGFNAASGALSNPSALFGREAWVGITGPFGGVQFGELYTILHTTLVTYSLPGLGAGLAWGNATNNFVGPAFLRVRNSLRYTSPRYAGFMLRAMAARGANGAAGQPSTLGDTYGAGINYVRGGLSIDVDYMQQTFSPVAASTLGATSRAANGNYTLGAISYDFRVVKIAALYLRHRGGPDVAAAIDAQSAYPHSDIVELSATVPIGRASLLLSAGHYRKVADSDGNADSYGIRFDYPLSKRTVLYTGAAMVRNGAHARFVVNGAAGGGVAVAAAGATASSLVAGIVTSF

SEQ ID NO: 18021 - protein, 986 aa, Xanthomonas campestris
MWTTGATWDTGTPTALGQSLLRRNLQIVVDRANSRTLAQETAAYFDDRRDQSYSATSGLGSLTAAYRAGAGAFTTITQFDDSNKTVKYDDKGNGAGSSTSALGKVVDLVGAVRNDASTTPAKSHYLYPRPWRQSLDGQSLAFVVAPSLRPAQSTTPTSDSGFPSGHTNAAYLSSYALAYAIPERFSELMLRASEIGDNRIEAGMHSPFDVMGGRITATYFAIDNLSNPANAQLRADARAQALNYFTAQCGGDVNNCMATIDPATDRTSQHALDKALYTSRMTYGFDPVGPTNLAPVVPTNAEVLLETRFPYLDASQRREILATTEISSGYAVIDQSGGYGRLNLYAAGDGYAAFNSNVTVNMNASLGGYNAIDAWRNDISGSGALIKNGGGNLMLTGNNTYSGGTVINGGVLTGHAQAFGRGTITDNATLVVDQSTNATLANTLAGNGALIKRGSGSLNLTGNNSLSGATTVQAGRLAVNGNLGNSIVSVQQGATLGGNGTVGGINVAQGGVVAPGNSVGQLNVNGDVNLAQGAVYQVESDANGNADRIVASGRATINNSTLSLVEGGNWLAASRYSILSAAGGVSGAFAAVQTNFAFLTPTLNYTATDVGLTLDRNAQRFSSLATSDNARAVAQGLDSSGANNALWRQVVQSDASTAQATFKALSNELHASTQSALIEDSRLVRNAMNDRLQQAQSAQAFGSSTQTLAGDASRGVVWTQAIGATGKTESTRDVSGLDTRTSGLLFGADVPLDDTWRLGAMAGFSNSSFDLRHASGSTDSDNYHLGVYAGAKWGQLGLRLGAVRTWHELTAKRTLDLPGSSEHFKEDYKAATNQVFGELGYAIDMGNAQLEPFANLAHVRLDTDAFDENSNAIRLENKAQDNHITFSTLGLRAATHLNAGSVAIKPNATLGWRRAYGDVTPESRAAFSGGSTFELSGAPIARSAAVLGAGVDLGLSDTLSVGLSYNGQVSSDASDQTLNARVTLAF

SEQ ID NO: 18022 - protein, 620 aa, Xanthomonas campestris
MTPLPRRSRSSRLIPAFLLALGALASARAQFTLAGTSAIVLDDYVISASRTPQDPRYTPSSVSVLPLADLAAAQVPDLRLALAQEPGVIINTTGATGGQSSVLLRGAASHQVLFIVDGVRMNDRSAAYFNFLGGADLAGLDRVEVLRGPQSTLYGSSAMGGVILMNTTRGAGAAHGALSATAGSFETWGGGATVQGSTGSWGYSGALSRYATANDEPSNDYEQWSYSTRQEWIVSPLLLVGATLRGQQSEFLQTGSRDYPAPGRMNARNHLGTVYGEARVGDDFASRLTLALHRRGYDWTDLSGSPWAMNSRLRNTRKILDWQNTWQALPALELVGGANWERSRYDVEGVPSRDEVRAGYVSATARPREDFTVTAGARRDDFDSAGAATTWRMGVSWLAAKATKLRATYGTGFSAPGSDDRYGVPSWNQLPNPELRPEKSRGWDVGLDQTFARADLTVGVTYFHNRFRNLFEWQTVDWTTYAGQTVNLARAETEGVELAARAKLGAAAQARLSYTYLEAKDSATGQRLIRRPRHSGDAEVRAHLTKAWLVGVGVRVVADRTESTGPFEDFTTARVFASYTVRDDLELKVRIENALDETYDEVRGYASLPRGVFGSVEWRF

SEQ ID NO: 18023 - protein, 363 aa, Xanthomonas campestris
MKKHRRLAGTTAISASLAACAGLASGHALAQSSVTLYGIMDAGIEYVNHAAPDGGGAFRMKSGNKNTSRWGLRGVEDLGGGLKAVFRLESGIDLANGAFDDGPDSIFARRATVGLKGQWGELTLGRNFTPTYDYMLPFDPMGYAQNYSWATSSTATGGRKDGLFTRSSNAVRYDGAYGGLRFGAMYGFGNVPGSMKTSSKYDFALGYESGPFAAVVTFDRQNGAADSVTPADPVNYVQGIHAGVSYDFGRLKTMAGYRNYRRTYHTAAATQLSDMYWLGGSYDFTPAFSLTGALYHQNVKGGTDADPTLVSLRAQYALSKRTVLYAAGGFAIAKHGQNVSVSRDSVGYADTQLGVTVGMQQRF

SEQ ID NO: 18024 - protein, 1201 aa, Xanthomonas campestris
MNTYPNYPRKKLNGLFLLTCALSLSATVAYAQDDDEEDVFELSPFEVTADESNGYRATSTLAGTRIRTDLRDVGSAISVVTDQFLKDTGATNSDTLLQYTTNTEVGGAAGNFSGTGGRSDTTEPRLRPHESTRVRGLARADNSRDFFITEIPWDSYNVDRIDLQRGPNSILFGIGSPAGMVNATTSGANFEDENSVELRFGSYGSYRTAIDVNKVLIEDELAVRVSALNDKTLYRQDPAYSHQRRAFAAVRYDPKWLTTDSARTSFKLNYEKGDIDANRPRITPPRDSITPWFTDPTLAGKVYDARTISDNSPEAIAADPTGTTGANTRYLPDNVTPNPNYSAWIQNGAGGGIFDQPVTWFESVDSSEQNGIFEPSLSTTGKPALPAGVGIPWTVYMGITNYRTWAEQGAISLPGTSVGAVKTPTLQDREIFDFYNHLIDGPTKHELTEFEALNASMSQTFFDNKFGIEAAFDKQSYNDEVSQLLGSDPMLTVEIMGVLPDGRENPNAGRAYVAGLPNGGNQGRWSEREAMRLTAFGEVDFREIMDESDLGNVLGRHVFTGLYMQQRRDLQTRNWYNYVFNEDYKSGISMTLDSRRVNSIHYLSPSLVGSTLGNFDISRIQVPQFPTTGTIYDFNTNLNSDAVPDGDGNYTVDDVVGWEPHRMRVLDGYSGRDRDQLYNNANKTRDDIESQALVWQGFFLDGMVVPTVGLRKDVAENFNAGDVPQDPVDQSRFVFDPDWTITTGPNDPRLDPDTLIGSNNERYSRSEGDSTSWSIVVHTPNSLRDRIPFGSDISLFYNKSDNFEALTGRTDVFGNTISNPAGETTDYGFVLSMLEGKVNLKTTWYETSVQNATIEPGTGSLQAVYRIGLNENWGRAFGNWAKSVVPGTGFDNNYALEDPAQPESDTNPRIDPNVGDLRYQPSPTETIAEALTRQTTAIDTLLANPPPANLAAHWTIQLEQDWAGGWGTHVGANQPSSLAVTGDTISEGVEFELTANPKPNWNVSVNASKTTASRTNLAKGFADWAEERAEFFRGPGGQVQLWNGNFGQQTVGGVWLQEFYSSYLLYKQLEGSDVAELRPWRFNAITNYSFKDGGLKGVNIGGAYRWQDKSVIGFGVADAGTENEAWDVNQKYYGPAEDALDLWIGYERSLNDSIDWRVQLNVRNVVGDDDLIPISTQPDGSMAVGRIPEPTTWSVSNTFTF

SEQ ID NO: 18025 - protein, 124 aa, Xanthomonas campestris
MASTARSLRYALAILTTSLVTPSVWAHAHLTHQYPAANAQVTAAPQAITLNFSEGVETGFSGAKITGPKNENIKTLPAKRNEQDQKQLIVPLADSLKPGTYTVDWHVVSVDGHKTKGHYTFSVK

SEQ ID NO: 18026 - protein, 306 aa, Xanthomonas campestris
MAASADAKLYGEVDLAVALETAEENAFAVTGSPVGDNRIGFGGETEMYDGGAITYQAEVAITPEQNNAGFASNYHSYIGYKTDGYELRAGNQHLPLRKVMDQADLFMGTYLDQSPLMPTTTVGASVPNSVMALGGDDAMKWAFSVDFQSENPNDPDSFDGHRYGAAVDMSASDTLSFAVGAEFVTDNYMALGATANMDLGGGTALVAGVNMQDNDANDTTPMGMTFGLSMAASDRTTYKAQLGMLDPDTGADNAMLIGAGVDHKVADNATTYALVGIGQDGGLTTTGGVDADAAANVFAVGVKLSF

SEQ ID NO: 18027 - protein, 1003 aa, Xanthomonas campestris
MREPRTLPRTRRLTSALLFALSAPLAAQTAPAPQSASTVPGSSQADPATLDTVQVSGIRGSLTSSMNVKRDAQGIVDGIVAEDIGKFPDTNLAESLQRISGVSIDRSLGEGSRVTVRGVGPDFNLVLLNGRQMPGASIEESNASNSRAFDFANLASESISGIEVFKTSRASTPTGGIGATINIKTARPLDNPGMHANVGLKGVHDASNENLPGRLQGDALTPEISGIFSTTSADGRFGVSLSGSYQERDFGYSQVGVPNGWRSFRGDSTAYGTIPQPGAPGSENITNRPGPNDIYSVPQNLNYRVVGVERQRTNGQLVLQYKPLDNITTTLDYTYSENKIQQQRNEMSVWFNYGPSASAWTNGPVAGPVTYSEIVNPATSDLATAGSNAATRNQNKSLGFNVDWAVNDQFKLNFDIHRSTAEAGADSPYGSSNSLGVSGFYRGTSVVDFSKDFPVLQQQLGFGLNGLDPSRTLVTGSAFRNSYMKSEIDQAQVNGDFTFENYSQLKFGIGSTEVKNRSAFSNVQRDTWGGNGTAADYPDDLWIPSSFAQYFDAIDGSGNPPQFNQLFLFDFERARQAAAQVAGDDALYRISPVFTTDRRVTEKSKNAYLQWNNSWDDLRVPISLAAGVRYEETKVDAQALVPVAVGIDWVANNELPIRVANSAFASGSGKYEYWLPSLDLSFKLTDDLVLRASYGETIGRPGWGDIQGGQTLSEIARVEGGTGQEGNPGLKPLLSHNIDFSLEWYYSDASYASVGFFRKNIDNYIGVTTRNDTSLGLNTPIGGAYWNEALGNGCASADLTCIRNYIFRNRGGAPGVVRGADANGNATGVISGQPGDPVANFAITAPANQRSASLDGWEFNLQHMFGDSGFGVSANYTMVDSGLTYDNYVIGEQFAMEGLSDSANVVGFYDRDKWQVRAAYNWRDEFLAARFDGSGQPNPVYTEAYGQLDLSIGYQWTENLSLSLEAINLTDEVQRQHGRQSNQIVYATQTGPRYMLGVRYKFW

SEQ ID NO: 18028 - protein, 712 aa, Xanthomonas campestris
MSSLLPRRHVVSALPLLGVLACAAAPATAAEPQARSLDAVQVRSDYAPYRALTVTGATKTEAPLRDLPISARVLDHSLLEDAGVTDLAGALDMASGITKANNLGGLWDSYSIRGFTGDPNFSSDYMVNGFNASRGYNGLRDGANTQSVEVIKGPASALYGRGEPGGAVNIVTKKPLFDAQHSVDLSAGRFDSYRAALDSTGPLSETVAYRVNLMHKDQHSFRDTVDSDATLLAPSLLWMPTPDTTVSYELELLRIHTPFDRGVTAIDGDANRLPASRFLGEPGDGDIDLHSTGHQVFAVHGLNQTWLLQGGATYRDSGMRGFSTEPWTLQADDRTLRRERRYRDYQGRDIAARAELLGTLGSGKVAHHVLFGIDGNRFNDSRYQLRARSAATPHSIDVLAPRYGVAQPGRLAPITDTDERQQVWGVYAQDQIDLGARWKALLGVRYDHYQQDIANRLRATTQQASDGVISPRAGLTVHLDDTLSLYASAAAGFRPNSGVGANGQSFAPEKSRSLETGLKYVQPGEGLEATLAVFRIDKENVLSLDPADTSFSLPVGQMRSEGAELDLLGRLTPHLAASVGLAYTDSQVTRSSAAAMGTGLAEGRRFPNVPRFSGNAFVNYAQPLSGTRSAAVGVGVSRTGERLGSVDSNTGFVLPAYTVWRLVGHYDLSERLRLYAKVENLTDRRYAAFSYSEQWVYPGAPRTWTVGARLRF

SEQ ID NO: 18029 - protein, 850 aa, Xanthomonas campestris
MAASFKRIALLAAVSSVTLGAASQAQVFDQVGGGERRTVDVITVTAQQREESAQDVPISIGAYDTEALANAGVRDIKDLQAIAPGLIVTSTQSETITTARIRGIGTVGDNFGLESSVGVYIDGVFRARNGVGFNDLGELERIEVLRGPQGTLFGKNTSAGVLNIVTAGPEFEPGGSIEATFGDYGYSRISAHVTGPIMEDVLAGRLFAVQGQRDGYMDLYVEDDNGQLRQTDSDDQDFWSVRGQLEWTPSASVTGRLIADYTERDEVCCSAASWDYTAAGIALVNSVGGQTLFPADPSERVAFANREYDQIVEDWGVSAEFDIEMPIGTLTTVTSYRNWENARSQDIDYTSADLAFRDKDNNFTDIERLSQEVRLNGQWGDLDWLVGAFYSHEDLVLGDGIRVGEDWEAFLGRSLTAGSVPPLGTPAGVSVVLSQLTGGLINIPPGMAFIDGQGVNQDLYDQTADSWAVFTHNSYRITDNLSVTAGLRYTRETKDVYATFDTNQPLACAALEQAFGFDPINGFIAAATAQNLPASTISGGATAIGNICLPYHRSGLDANGYDNERTDEEVSGTIRLTYDISDDAMIYGGFSRGFKAGGFNLDRQLNGPIGPDGYTNSDNSFAPETVDSYELGFKSQLFGNVVQLNGSVFYQQVGDFQLNTFNGIAFVVESIDEAESYGAELDFYYATPIDGLDLSAGYAYINTEYTEVNTGDPLVDALQGQDFSLVPDQTFTTQVIYSRPVFDTLLATASLDARWVSEYNTGSDLDPEKVQDAFTTVNARIGLGREDGAWSVELWGRNLTDETYAQVAIDAFAQGRRAGSGTSLDARGSASYAAFLGAPRTWGVTLRTEW

SEQ ID NO: 18030 - protein, 722 aa, Xanthomonas campestris
MYAPCPSLLSRRPLALALALCITLPALAQQQPDGAAVQLDAVNVRGERADAATTLSGFGATSLLDAPASIAVIERQQLLDRQARVLSEVLRADASAGDAYAPIGYYENFVLRGYSLNAANSYRINGLSAVGEQSIALENKQQVQILKGLAGLQSGVNEPAGLIDYRTKRPEHVRSVTLGTDEQGSRYIAADLGDWFDADRTLGVRVNAAREDFRSYVDHADGYRNFLSLAGDWKPTAQSLLQVDVEYQHRQQRSVPGYQLLGGTQVPRNIDVHRLLGYQPWSRPVEMDSLNAQLRYTYQFNEVWRASVEASRSRSTINDFSAFAWGCYGAASCADIATPNFFSAQGEYDVYDYRSPDDTRVHDQLRASLDGRVTTGALDHQLSIGADWLRRTIDRYGSVNEFVGSGSIDRDPEVFAQTDVALDPKQRRLDSRQRALVVADRIGFGSQWELSLGARYVRLDERAFDRDGVLERRTRKDALLPQAALLFKPQQQVTVYASYAKSLAAGGTAPWFADNADEILTPTNAYQLETGAKWQLQGVRLGAAVFDIRQAYQFTQPQADGGLLYVQQGRLHNRGLELSADGAVTGQLQLFASVAAIRARAEDTGIAAYEGHQAINVPKLRASVQADYRVPGIDGLALLAGVQYSGRKFADRLGSASVPAYAVANLGTRYATTLGGLATTWRLNVDNVFDKRYWRDAGEYQGDAYLFPGAPRTARLTVQVDF

SEQ ID NO: 18031 - protein, 933 aa, Xanthomonas campestris
MAGRCTFGSFMMRRCVLLRPSRLSQALCLSLCIVGGHAAAQDTQANAPAQGQMATLDKVTVAATRYNATDMQMAATNTVNVLSADDLKTTAVHNVAEALGLMPGVNVINTGQSYFGGIDGAARGEGMFSSVRGLNAEYNVNLINGVNVAQGMPYSRGVQLSLLPPSGLQTIVLNKTSTADMDGDAIGGTIDYRTPSAFDSPDRQGGSITLSGRMESRARDYGDSGLGSGAAGDWHARFGADGQFGVAVSAYYDERHFVNSEVAGASAARSDGSWEFARTDASGALAAGTDPQDALQSTGVNIGYSQGDTRRYGGNAAFDWRVDPSLHLYARMTYAFAKTEQNTGYTQFVPANVSYTQIGTSGIYQPQINRVAVRYWYETNPEEADLATIQFGAEKQLGHWTFAPNVFYGTGNNDRPDHVEISARNDQYSSTNFAYGANRFISYDGDGFPIPLLTPAMQAQASDVGSLFARRTGQISKQYSGQDKGGGKLDVSYDFDDGVLSRIAFGVKYVDSSRSFTDRDWTNAKYTDGTLLRDTGLVAQRYDAVYPGQYALPTLRLSNDALNALIARTLTPESFDSCGRLAVNNLNCNTMRATEAVSAAYVMATLRTGNWEILPGLRFEHTSIDNTFWAQPAAVGGVEQVGAFANNQTRYNVVLPSVFVNYRPDGDGAVYRGSVWTSYTRPAFVQLGGGRSTDISADGQTTITEGNPDLKPIKSLNVDLSGEWQNDAGGHAMLAGYYKRLTDYIYESGSDAANAGESGTASTRFVRPQNGGDGRVLGMEAAVRQTFQGLPAPLDGFGIGGNVTRQTTRVDLGEEGFAHERIQNAPDLLANAEVFYEKGPWSVNLSYHYSGEYVSVYDYLNQGARWDNLWIKPITRVDLHVGYAPTDHLRVDLSVANLTRQHSYWAHVGHDNTAISDIVDSGMTSLVTAKYVF

SEQ ID NO: 18032 - protein, 791 aa, Xanthomonas campestris
MRGQSLLPWRTGRMARLLTTALLCGAALPVLAQSLPHRFDIPAKPVTRAVNDIGRVAGLSIVMPDEGAVAVRGNPVQGAMSVEAAMETLLAGTGLSWRFANAGTIHVFQRIPAGAADGSAGVMLERIRVAGDSNGATSFVAGASGTASKSGTPVLEVPQSVSVIGPRQMEAQGARSVTEALRYVPGVNIETYGPDPKGFEWIMLRGFNGQSSSAYLDGLRQIASNYSHFRTDPHQLETIEVLRGPSSALYGQSDAGGVVGKTSKRPVTEPLREAELSYGSFATTQAAVDVGGALTEDKTLSYRLVGVARDGNTQFSYGDGTRMKDDRLMLAPSITWAPTDATSLTVTAQALRDRSGGTAIFFTPTDILVGDPNFSRSEQDQKTLGYEFSHRMDNGWTVRQNLRYGRVDFDLDMIAMIGADATGLTRQARRFSESLDSLAVDTNLLGEFQTGRLSHKLLIGLDHSRSDTDARRWNGTAPSLDPYAPVYGVAVPTPTTVAYDYTEEYRQTGLYVQDEIRLDRFLFTLGGRQDWLSTRTDDHLTGTARDVDLDNFSGRVGVSYLTDSGLVPYLSYSESFLPNAGLGSDGRTFDPTRGQQWELGAKYQPSGTDALLTVALFDITKSNVLTPELGPGGISTGYNIATGEIRSRGIEVEGKASLGSGWDIAANYSYSDVEITEDNAGNEGNRPALVPKSQASLWLNYSFGAGALDGLSLGGGLRHVGTSFGDNGNTIKVDGRTVIDLGASYALSETARLALNVTNLTDKEYFTTCASAYSCYEGDRRMVTAKIAIGF

SEQ ID NO: 18033 - protein, 806 aa, Xanthomonas campestris
MFHEPLTPCVAKRRLCTVRPPSAVPEQDSPMTSARRFHVTPLALALATLLPVISQAATPADPAAVAPAEAALTADAAANATQLDAINVVSQGSTRQVQRISQQDIEQLTPGSSAFKAVEKLPGVQFQSADPFGTYEWSTQVTLHGFDQSRLGYTLDGIPLGNMSYGVTNGLHITRAIISENLGSVEIAQGAGALGTASNTNLGGTMQFYSADPQTTPGARLVQTVGSDATRRTFVRADTGDRDGLSAYLSYANASTDKWKGYGDQTSEQANLKTVYQWGDGNRLSLFVDTSRRKEYDYMDLSLTSQRALGWNYDYLQPDWATAVQMARAYQNTGATSGVANGYPQSLAGLPSDYSWLDASYYAGGGLRRDNLAGLSGTFVFGGATLDASGYYHGNRGEGQWVTPYVRTSAQIPVSMRTTDYGLDRFGGTSALKWSWGNHDLEVGAWAENARTTQGRNYFALGNEGYTSLYNVYEAQTPFRRDFLQRYTTQTRMLYVQDTVRLLDDRLTLNYGAKALSTTTRAQSLVPTTALAQGRIRAEDNFLPQLGINYKLDERQDLYASYSKNIAAFGFTPFATSQAAFDRSRSTLEPEQSQTVQVGYRVQDAQFQLSADAYFTKFSNRLLTTSPCTAVQTCASILSNVGAVHSAGADLALMWRPTEGLSWLNSLSWNRSRYQDDYLNNGVVATSGKDVVGIPALMFSSSASYQIGNLRLDLDGKYVDKRYITFLNDSQVPSYWLFNAGARYDFGRVGGVADVALALNISNLTDKRYFASTGTNGYVASDPDGYNQTMVVGAPRQYFMSLDVKF

SEQ ID NO: 18034 - protein, 738 aa, Xanthomonas campestris
MSASRSLKISALAVAVVSLLPLHAAAQQTPGDDGVVRLDAVKVTVERRSEDSKDVPVSASVLRPEFLDAISTSGSDIRVLAGKAPSLNIESSNGRVFPRVYIRGYGNTDFNTYASQPVSLIYDDVVQENAFLKGFPIFDLEGLEVLRGPQGTLFGRNTPAGVVKFNSVKPTIGANDGYASLSYGTYGTMTLESGLSIAMGDHWAARLSTLGQRRDDWVENRDGRDLEGYTDSAVRLQLLYQASDDFSALFNAHARHLDGTARLFRANIIQPGTNQLVDGFDAEKSFIDGANRQELQTYGGSANLTWDLGDIALHSITAYEGIGKYYSRGDIDGGFGAVFAPPSGPGVIPFPVETAGGIKSLDQYSQEVRAESQYDGPLNWQAGLYYFHDDVEGENYTYNTLSGGDLASYQLTRQRNTSWAAFGSLNYAATDRLSLRAGIRYTYDKKTFDVLALDRVTLVEPSSGETDNSKVTGDLAATFSINDAVNVYARAARGFRGASFGVPSGTAPLTVAEPETVDSFEVGIKSDLFDNRARLSFDIYDFRVKNQQLTAVGGASNDIRLLNADKTKARGAEFDFEALLTQNLRVTAGGAYNWTRIDDPNLSVGICRTCTVTDPINAAGRAVIDGNDLPQAAKWMANATLRYGIPMGNDGELFFYTDWSYRSEVNFFLYDSKEFTGQPLVEGGAKIGYNWGAGAYELSVFCRNCTNQIRVTGAIDFNNLTGFINDPRIVGAQFRANF

SEQ ID NO: 18035 - protein, 903 aa, Xanthomonas campestris
MQTLDAMQVTGVRRANAAAVESKRAATNITDVISATDVRALPDSTIVEALRRVPGLSVLPATDNEHPRDEAATPVLRGLGPSYNNVTIDGLTIASPGTPNGTLGSITRGVRLDLLPASIVSELQVVKTFTADLDPNATGGAINLKTRSAFENGGKPFFSAEAALGHANDVGKPRDQDDPGYRLNATGSRTFGSEQQYGFTLSANYQTLSSYTETHMTTDMVHYGFYDNNGVLQTGADLGNGWAVPQQDKYWYVQNQRDRYGVTGKFEARPSAAFEAYAMAGYYYFKDDMERNEVIIDPRNRGQVFNQTATSGSYPGGDIEVGYSNQIVTTRTKVAQLGSIWRPTDRQQFSARGSWSDATYDEPIRMIKYATGINRPAAVPVGQTGSGVTVNATPNYAFNYDTSGFDQRFGVSPQAYNNLDNYSLSYWRPDYKRTAADRILTGRLDYGFNQGESDQGIGFAAGVSYTTDKPSYDIFRVEYQPNTSVPTFGLADVAGTGRAPMRYAGLNLITIDPDKANRVLAATPLSAFNSTDQQAFSNQDNFTHTEKTFGSYGLVSYRSERLNVQAGLHLDSTKLNTVGRQRQLDTASNRYVYVDNPTNADYDYLLPSAIMTYHLTDALDLRVGASRTLGRPPYDAYAARTSIGFVNTTDAGNPSAQGVTVTIGNPDIKPRVSNNLDLSLEWRLPGDFDAFASTAVFDKRIQDEIFTLSRTDSFTFDGTTYANALISTPANAAKARIRGVEFNGIVNTLAPIAPWLSGVGFSANFALLDGSLDVPYSVGSGSTVSQRERKLDNLVGQPDYTANATLFYNTGGLELRAAYNRQGKALRAIVSNIDWQDLYWSPRSQLDFTATYAVSKQLSLIGQVSNLTHSRISSVTGPGQNLLKDSYSVPSTYWVGLRFTPSL

SEQ ID NO: 18036 - protein, 789 aa, Xanthomonas campestris
MSLYSPVASSLSCLAARSVTRSSAGLQRTLLARACAALLLASVATGAAAQQAPASQGEASPTALDTVTVTAEHREQNLQDVPVSVGVVQGAAMREYTAGGDDTLLALSGRVPGFYAETTTGRIFPRFYIRGLGNIDFYLGASQPVSIIQDDVVLEHVVLKSNPVYDVDQVEVLRGPQGTLFGRNTTAGIVKFDTVKPGDTYTGHVNASYGSYNTISLDGGFGGPINDVLSFRVSALYQHRDDWVDNTFAGSSADGTRTPRKDAMGGYNDRNARLQLLLKPSEEFSVLASAHTRDYDGTSTLFLRNAVTRGSDKVDVPRDRVAYDEAHDNPQAYKTDGGSIKAVYDFGGVSLTSISAYETTSGYSRGDTDGGAAANYPVNGVPNGFGQSMGQIRDLDQYTQELRLASVGDDALQWQVGGFYFDGRDTTDFYQRAYFLQTAARNPNNWVRLRNTNTSWAGFGQLSYKATDALTLTAGIRQTKDTKETRLLKTADTAAGAVTYRGRRDVRLSDTQPSWDLSAMYEINPDLSVYARVARGFRGPTIQGRSAVFNSDFTTADSETILSWEAGIKSSLFDNRLRLNVSGFTYTVDDIQLNGNDADGNGVLFNADKAKAYGLEADLDWRPISNLSLTAGLSLLHSEIQDKRVYAQACALNGVVVCTVNDPTIRVGANTFAQIDGNPLPNAPKYNLNLAARYDIPVGNDGAFFVSTDWNKQGETSFVLYDSTEFRADGNFEGGLKLGYTGGYGAWEVAAFARNITNEKNVKGVIENYMAAVYNEPRIVGVSVNVNWQ

SEQ ID NO: 18037 - protein, 894 aa, Xanthomonas campestris
MPVHHSARPVSRHARPLPARAVLCTTIACVLATAFSAQAQDSAPPAQPPATGTTTAQAPVTLDNITVIGQRASLNQAVQAKQMSDHVMEVISADNMGQMPNVTVAEALVRLPGVNGTRDRGNESLATVRGLGPRMTMGTVNGREIASSEPNRAVRWEVFPTEIVSTVKVYKTQSADLVAGGLAATVDISTISPLDYTGAGFVGTAGPVFYDHAKDVDGYSPWGNRFGASLVHKFNDNLAVAFGATYQKQKNSNSSIGSWGYTDATTSRDVDGDGTVDPTPFGAADQLKLTEQTRTGAMGTVQWRSGNFEMKFDGLYSRIEIDEDQLQNWFNGLAFSTFSTGANPYTTPGSSYTIVDGDVVAGTLANSNLQVDHVVSHYNEVKTLTAGGLNAKWNGDVWTLASDLSFSQAKRDNTWQAVRFGSNPDTVSFDFRRSVTPTIRTSSDTPEYGIAGQTEPQALRDKIAALALDAGRQIDMAAFTSVEFGVRAARREKQNRRFISNQSGYDQPISAYQNLIYPVTMPDLNVPTLTGGNMDAIADVGFGGFDPATLDEQLLDHWNVKEDVREAFAKAVFSSQLFGTDVTGNIGVRLVNTKTTSDGFDSVGTTVQASSDSKEYTDVLPSATLNFLIDDQRILRFAVAKVIARPPLDELRTGRRLDDPTVTVGQLTGSGGNPQLDPFKATQVDVSYEWYFHKEALAALAVYRKEVDSSIGYRTDREVINGLDYLVSAPFNGGGGHINGVELTLQTPFYFIPHMENFGVYSNFSLVDSNLKEFSPADNPLPLSGLARKTGTFDLWYSNGTFEARVGYKYHSPYTVVYGWNAARLARLQSEGTVDLSLNWQYSKQLGFRFQAGNLTNEPLRAYTDNKPNRLANQDDGGYQVFGRRYALEATYKF

SEQ ID NO: 18038 - protein, 341 aa, Xanthomonas campestris
MGPASIPPGDYESGNHRFLIPHISYNRMVNDNSSIGIFMAANGGMNTDYGKPIFGNFSNPAMPETQVTSKTGMDLAQIFLGVTYSRKITEQHSFGITPIIAIQALEVIGLQPFIPFSASPQKVTNQGQDISFGGGIRVGWFSQITEKLTLGASYQSRLWMNEFDEYQGLLAEKGKFDVPATYDLGFSYQVTPEWMLAFDYQRINYSSVNALSNASDLAFIPGQTLLGTDDGLGFGWEDMNIFKLGLQWKYSPDMTLQFGYSYADNPFPNTQALFNTLAPAVVRQHYTFGFTTPLSEKIDFTMAFLYAPKEEIHGSNINTGPQTGFVEMEQFEIEMSWGIRF

SEQ ID NO: 18039 - protein, 1038 aa, Xanthomonas campestris
MTHHTRRLTPAPLSLALAAVLSAFAATATASSPDPQTTADQSAPDQAGDAPDAKRLDSVMVTGSRIGRVGFDSLEPATVVGAEYIQGYGFTNIADALFIQPSFGAGATSRGDQSGYGAGVNFIGRFGLGSNRQLTLVNGRRFVTSNPPTVFGPSGGGTQVDLNVIPTILIDQVETIGVGGAPTYGSDAISGVSNLILRKNFDGAEVRMGYGLTDRGDNERFNYSALLGSNFGGGRGNITIALDADNSQGVLGTARRFYRDAYSTRANPSASAIANFQPGRTPANDGRVNPGIGFNTGPNDGIPGRVLIRNRRISDMTWGGLLFPSDAGTVRDASGQLRGFGANEDQFVQFDRNGDLVNYNPGTNFGISDASGGDGVNLQETTQIISDLDRKTVFALGNYDFTDQVSGFFEASFYTSTARELVDQNVYNATGFGVGSVDGSGDQSGSLNFNINNPFLTEQNRQTLQNLGVEDFVLSRSSRDLVQNQSSTDTNLWRAVVGLQGSFDAAGRGFNWEASVNHGEGNFDYYNDNLIQQNFINAINVTRNSAGQIVCDSSAAGTTVDPNCAPLNLFGEGVASRAARNYVIAPTHAEAQMKQTVFNANITGAIIDLPGGELRFNAGYERRKEEGSFTPSTFERLGQGRSVPIAAASGEFTTNEYFGEILAPLVNPDAGIPGLHRLDLTGKIRRVENTVNGWFSAYTYGLQYEPFQGVQLRGNKTRSFRAPSIAELYTSQQPAYYFIPEPCSAAQIGSGPRPGVRARNCQAFFDFYTNADPASFEEAPSSQLGSVSGNTRLQNEQAESWTAGIVLQPEWVKGLRIAADWYDIQITNSVTTLSEEDITSGCFDSDTFNANDVPNANNFCSLITRNPQTGVANSIRTEYTNGPYTNFRGWTAEVNYRFDLADVDWGKGIVDLSFYGYFPKTLESAAAPGIPPDEAVGEIDNPKRQFQWNARYMTSHWNLGLSANYSSSVVYDLTDTVETRAPLGVPSYTSYDANVGYAFDTNTSVNLAALNVTDKLVAFPNVYDGLGRRYMFTLNHRF

SEQ ID NO: 18040 - protein, 712 aa, Xanthomonas campestris
MRPTLLVTALAAALALHTLSAFAQHTTTPAVTELDGVDVIGRAQTLYKSEDAAVATRTDTPLALVPQSVQVLPRELIDDQAARQITDLYRSISGISFFSYAGVTLRGFRQENVLYDGLRGDPYAGFSVPQLFNIERVEVLKGPAGALYGGGEPGGVINYVTRKPGHQAARRIELQLGNQSFGAASFEATGPAREDGRIRYRIGAYVDGEDGFRWNTDSQSKIGDASVAFDLGDTGELTLQYTDITQNLGGNRLRGVPVDNDGNFLTDRRWNHNEPTDFLDMRAKVALAQYRFAPSSAWEVDMALRWFKNREHQIYHEPMGLIDRDRDGTAEWMTRQLRNQYRDNDAISSNVNAIFRTSTGAIEHKLLMGADYYRLDADFRAQTANTADTGRVRGPVPGIDLFNPVYGRSGFYDYGLDALPWRATSTRSQRYGAYLQDELTLTPRWYAMAGLRWDGFKDDNLLGGSRVTGNDVSWRVGSTVVLRDGINAYASYASGFLPQDAANQDSSVGGPFAPERSTQWEMGLKTALNDGGLTLNTALYRIERSNIVQANGRVVEGVNQLSALGLVRSEGLEVDLLADLTERWVLNLTYAYNDARVLDAGTNGITNASGDRFANAPRNTFGLWTRYDLPMWRSAIAFGADYVGERVSLDGQRVKPYAIYDISWQTQWDAWKLQINVKNLFDKVYAASGFNTRAGHFPGEPRRIYAQLAYSF

SEQ ID NO: 18041 - protein, 416 aa, Xanthomonas campestris
MKLSPTLLGSALLVALAAPAAHAEIAIDVIGGSEMSLEGLVQADGNWFHNDVQDLNGPIGANGDNSEFSIRRAELVLKGKGPGNFEWVAGYDPSVLKEATVRGTTIRSTGRFLDNNIKYKFGGNANNYLQFGQFKQPNSLEELSSTKNNDFVSKAAVTNTYGISRRLGVAYGMGDNNWSLTASAFGRELTRNQAHGSGYGARGTWAPINETGNVLHFGLSYLAYDTDDDTLRLRARPDADLTTVRLIDSGAITNVDNVGVAGAEAMWITGPFKLQSEYFQENANRIGANANDYKSDGWYVSGVWNITGETWGYKAGVPTTPLPNEPASGMWQLAVRYDTLDLNDGHLVANGNTPFVDGVLGGKMDVWTIGANWYWRSNFKFALDYAKVESTRYNSATRGLVDDNPSIIEARAQFYW

SEQ ID NO: 18042 - protein, 227 aa, Xanthomonas campestris
MDSVMRKSLFLLLPLVVTNAHAVYVDVRHEYLDDSKANYDRAYISHRFANGVGFAIEAISKSGGDDTNKAFNDLETQGNEYTISYQFKTGDVAWQPGFVLETGNGYSTYKPYFRATWTLNESWWVGARYRFEYVRRSSDIRDDDTINRMDVWAGYKWNNFDWTIEGIYKKADKYDLYDGGKDNYEYNFRTAYIIDQWSPFVEVGNVSVNSNSDERQTRFRVGIGYTF

SEQ ID NO: 18043 - protein, 970 aa, Xanthomonas campestris
MYTFSSHASAGTGARARRLVRLRHSAMAISIGVLLAAPAYAQQAPLTNAGGSAVDLDTVEVRGVRASLIKSQVIKRDASQIVDSVSAEDIGALPDRSVTETLQRVSGVTIDRFMARSDPDHFSAEGSGVMIRGLTQVRGELNGRDIFSAASGRGLSFEDVPAELMAGVDVYKNPSAEIIEGGLGGTVNLRTRMPFDNPGRIVGGNVDYNYGDMSKKYKPSASFLFSDRWNTGIGEMGFMIDIAHSELATRSDGIQVEPYVRRTDDAVLAGSGRSEVYVPGGVNWRQLDFERTRDGIAAAFQWKPSDATEIYAQFLRSRYEMNWQERAAFFNDSNNSITPAPGTTFDYDERGAFLRGAPVSSSWRGALTGDGVRFNTNNRYSEQSTTTTDLSVGFSHFFNDNLQIKGDMQLVQSENEQLDFTVFSATYLPGLTYDVSGRYPSVQIANPAFTQDPSNYFWAAAMDHLGKNRGRQLSTRVDLEYTFDDSSWLRFARFGMRATDRNQINKNSGYNWGVISDNWAAIPGSSNGLANMSDFMTDQSSLFTFSNFFRGGVNVPTTLVVPNSSLVNNYGSASQMIQQIVALRGSGWAPDTYQPQDTNRQFERTQAAYAALYFGNDEAWGIPVDGNVGVRVVQTKTQAEGFGQFQDLAGLNVSPELQARYTGQYFENNAQGSYTNVLPSLNLRLRFSDTLQWRFAASKAMARPDYTQLQPYVLLNVETNDAGQATDFVGTAGNPNLKPMVANQFDTALEWYFDTSDMLYATLFYKKVKDYFSTQTRSEIYDNRAWLVTRPYNMDEGTIRGAELGYTQFFDQLPGWLSGFGVNANFTFVDSQGGTNTAIDPFTNVTVGGVELPLEGLSRRSYNLAGIYEKGPLSLRLAYNWRSRYLLTTSDAATRLPTWADDYGQLDGSFFYRFNDHLQLGLQANNLTNTVTKVLMGPTSYEGGEVDPRLYTRSSFVNDRRYSLVLRMNW

SEQ ID NO: 18044 - protein, 856 aa, Xanthomonas campestris
MGQIRHGSATTTHAVRAAIQRSQASLAALSEEFGINPKTVAKWRKRQSVEDQKTGPKEPRSTVLSETDEAMIVAFRRHTLLPLDDCLYALQASIPHLTRSALHRCLQRHGISRLPDIEGDKAKRQRFKRYPIGFFHLDIAEVQTAEGKLYLFVAIDRTSKFAVTQLVEKADRKTAWEFLEHLLSIIPYQIHTILTDNGIQFADQPRNRNTAWSRPMRFDMICEAHGIEHRLTKPNHPWTNGQVERMNRTIKEATVKRFHYDSHEQLRTHLNDFMAAYNFGRRLKTLSGLTPYEYVCKIWTSEPERFIINPTHQTPGLNTYGGVNATGGMFDLYRVDADVGGFATDDGMIRYRVYGTINGQHTQLSRTGSRRFSISPSFTFGGDGPTTLTLLGNYQYDPENGSYGGVPLIGSLKRASYGYLPRNFYDGDVSAEKFNRRQGAITYILNHRFNDDWSFSTRGRYDDIRTVYRSVYDNGYYDSDDGTSGQMLSRSAYGTQEHNYNLAFDSQFKGKVRTGPLRHALMFGFDYMQQKANDTEAYGDAPDLDVLHPDYHMAIADLTPYLRYVTKSHQIGAYGQDEIRWKRLILTGSIRNDWYRSNQTEYFEQSNDRQSASQITWRASGLYHFDFGFSPYISYSTSFQPQSGTVSNDGGTTLRQAHPSIGKQLEGGLKYQIPGTSVLFTAAGFHIEQSNVLVSVANTGYSLQSGLVHSDGFEFEAHAQPFHNLMVTAAVSFQKVRDDSTGKPLIQSGKGNASLFAFYTMPSGPLKGFGFGGGCGIPTRPMVAKRPMAVSGSRNMPCLTPQLLTTSTTCLIPCMAGRSLPVSGTCLTGTILQTASPMAQTGSTVTTESGGTLRPA

SEQ ID NO: 18045 - protein, 1052 aa, Xanthomonas campestris
MNCKVKQGCLTSESCCILLWLAFTLFPVSVVTAADNRKIDESQQKEVKAEMKGYVGDENGEPVIGATVLESGTQNGVITDVDGIFTIQLAKNASLTISYVGYQKKTVVVKDKKFISVNLTPDRSMMLDEVVVVGFGKQKKESLVGAVQAVKPEDLKMTSSNLSTSFAGNVPGIIAVQTQGEPGSDEAKFYIRGISTFGSNTSPLIILDGVEINATMMNNIPPESIASFSVLKDATATSLYGSRGANGVIIVTTKQGQLSEKMSVDIRFDNTFSMPTYVQKMADGPTYMDMYNEAVYNQAIANNQEYEPFYSRDKIDKTRANANPYLFPNNDWYSMLFKDFAVNQNLNISIKGGSKNVDYFLNAGIFYENGIIRQPKEDKLDVGMRNKKYLFQSNVTARVTSTTKVGLNMNTQLFYHHAPKTSTRNLFAYSMHGNPVRFPATLPAEPGDTYIRYGSNDPWDVGKSEPNPYAKLSEGYTERNYVYMTTAFNLEQDLKFVTPGLKLTGLASFYNYSFNWLDHWIVPFYYKVSDDYTMDDQGNYLYKTSTIGEPGEPYLKSNSGRDPTESVWSLQGALDYSRQFGGHDVGATLVYHMKETKKVKDGGAEKDLLPYREQGMAGRLTYSFGQRYLLEATFGYNGSENFRSGHRFGFFPAIALGWTISNEKFFQPLKKTVSTLKIRATYGLTGNDALATRFPYVTEVSMNNNLDWWTGSGTRVNGPLVNIYGNANATWEKSKKLNLGVDMTLLESMDITIDYFKEDRSGIFMQRSSVPSTMGVTGMLPYANIGSVKNKGVDMSVAYSKVIGKDWVLRLNGSLTYAHNEITEIDEPVNVEPYSSRIGHPINSIMGYVSDGLFTSQEEIDRSPKQSFGNYTVGDIKYKDLNGDNVVNGYDRTIIGNPEIPEIIYGFGGTLKYKKWDLSLFFQGVAKVSLMMSDIHPFSEAGHKGYNIAQYIVDDHWSESNNVAGAAYPRLSPEFITNNAQTSTYYLRNAAFLRLKNAELGYSFFPWLRVYAAGTNLLTFSPFSTWDPEMGSGNGLKYPLQRTAKIGIQFHY

SEQ ID NO: 18046 - protein, 311 aa, Xanthomonas campestris
MALRVALIGLGLLQVATGVVAGDLALDQRALLLEDSRLPREAALDRLQQVRFAFREAAPEAGERPLWSRTYGIQGSWDDAGLERRGEGLLMGMDRALGGQWIGGVLGGVARARLDHDQGHGRTDSHYLGVYAATRVYNQLGFRLGVLHGWHELERRDGARSWQLFGESSYALDYRDFTLEPFAGLAFVHLDADARRFDGLRLAAAHEQAGYLTLGWRLAAPWYWQQRKWVGRASLALRQNLGSNRLRDEAIDGQGALQQLHSREFERSSLRLDLSLDHELSRSLYLGLTYAGHYAEDARDNALAARLSLKF

SEQ ID NO: 18047 - protein, 3961 aa, Xanthomonas campestris
MRARRSLLVTQEKHMNRAFALVWNAAIGNWVVTHELVRRRRKSGATRRNLPSMVILALGAAAPTLAWGACTPALPAAGQTVTCTGLPITSNAFSSNANNLTVNVASGTQMTAGLLGGTAIALGGTNSTLNNSGTIDPSVLGLLSVLSTGVTMGNASSTQVTVNNLATGTIYGSGGLLGANLLNLDGMALGITAAPAGVVQINNAGTISSRPLLNLSVLGSDTPVIAVSGGATVNAVNSGTIEGRVGFQSSATGNTFINSGAINGSVSMGANSINSFTAVTGSSVNSAGGIGVALLGPGGLLSFAATGTVDGGAGGTNTLILQNSATGTGSGTAGTAALSTSQYINFGSLRVNSGTWTLGGATNFSNTALNGGVAQFANPALFGTNITANGGAIEATAANLTLSPTGGIALTGTGLTVQGANALTIGSALTGTGALTKTGIGAVTLTGANTYSGGTTLAAGSLTLGNNTALGTGTVTAAGGTLSGTTALNLANAFTLTDSLTIGGTNAVRLGGAVSGGGGFVKTGTNTLTLGGTNTYTGGTTLNAGTVVLENAAALGTGVVTAGGGALDTIAPLSLANSVLLNSTLGVGASGNALSLTGVLSGTGGITKTGTGTLALTNANTYTGATTLAGGTLQVGNAAALGGSTLNVTAASTLSSSIALALGNAVSLAGPLTVSGAQALTLGGAIGGTGSLLKSGTGDLTLTGTNSYTGGTTLSSGRLLVGTGSALGTGTLTASGGELAATAPTTLTNAVALTGALGVGGNGTALTLSGTVSGTGSVNKLGTGTLTLGGLNTYTGGTTLGSGTLQVGSATALGGGALNVTGNAALQSTAATTLGNAVNLSAGALTFDGTQALSLTGTVSGTGSLVKSGTGDLSLSGNNVFTGGTTLSAGRLTVGSNTALGSGTLTAAAGSTLDSAVVSTLANAIALTGVGAVNVGGANALTLSGDISGVSSLNKVGTASLSLTGNNTYTGGTRLSAGSLLVGSDTALGTGALTAAGGVLDNTAPVSLSNAVVLEQNLALSGNQDLALGGSVSGTGALIKNGNAALSLTGTNNFTGGVTLNAGTLLINSGAALGTGVLTAADATRLDTTAAASVGNNVALLGALTVGGSNALDLTGTVSGTGSLIKEGVGALTLTSNNVYSGGTQLTAGSLVVGADAALGTGALTTADGTALSASTAVTLQNGIALGGALSIDGQPLTLNGVVSGAGSLIKNGTNALTLNGNNTWAGGLQLQAGSVLVGSDTALGLGTLTAAAGTTLDATTAATLGNAVAVDGALTIGGTQDLTLNGVVSGAGSLDKQGTATLTLGTANTFTGGTTLGAGRLVLGNEAALGTGQLTIAGVAELDTAAATNLANAVQLNAQLTLAGSNDLSLNGAITGTGGLLKNGTGTLSLTTTNSYSGGTTLTGGTLAVGADGALGTGSLSVVGDAVLSNAIAVALGNDITLDAALTVDTVGDLLATGNISGTGGLTKTGAGILTLDGSNSYTGPLAVQAGALVANTAAALGNASTVDVGAGALLSLTGGGLINSLGGAGNVDVGAGSTLQVGAGSFAGSLIGNGNLDKIGTGTLSLLGDNGVAGSTSVSGGTLDVAGSLTSSTLNVALGGTLRGAGAVTGPVTIADGGRLAITSGSTLSVGGLSLASGAFIDASLAAPSATRLLAVNGNLTLDGTLNITDIGGFGTGVYRLMDYTGLLTNNALLLGTIPGSVDISQLALQTAIGQQINLVVTAPGSIVQFWDGAQTVANGSVDGGSGIWGAASNWTGQDGTANSTWQGDFAVFSGTAGTVGVQGAQAVGGLQFVADGYQLTDAGAGSLSITTPLTAVRVDPNATATLDVGISGAGGLEKVDTGTLVLDAANSYTGGTTLSGGNLVLGDAQALGTGALTTANGTTLDTNQALAVGNAVVLNGALNLAGSNDLALNGAITGAGSLVKNGTTTLTLDGANGYAGGTVLNAGTLALGSNTALGTGSLSVIGNSTLSNAIALALTNNLTLGAGLTVDTAADLSLSGVLTGAGGLTKTGLGALTLAGSNSFSGPLSVQTGVVATTAPGALTGVGAVDVAAGAGLQLGSDTALGALTGLGNVAILGGSTLQVGNTNVTGTFGGSLSDAGNLEKVGTGAFQLTGTSSIGGTTLVSAGTLDVDGTLASAGGLTVANGGALSGSGVVDAAVTVADGGRLVVSSGALLTTGTLGLAPNATIDAFLGIPSQTGVLAVNGDLTLDGTLNITDIGGFGNGVYRLIDYTGGLTDNGLAFGTIPGSVDPTQLALQTALAQQVNVVVSAPGSNVQFWDGAQTVGNAQIEGGTGTWTAGATNWTGIDGLTNTDWQNSFAVFAGTAGNVGVQGTQGITGMQFATDGYVLTDAGAGALSANAATTIVRVDPGVTGTIDVTIGGTGTLQKLDTGTLILGAANTYTGGTALGGGTLVLGDAQALGTGTLTAATGTTLDTDQALAIANAVDLTGALTVAGSNDLASSGAITGAGSLVKNGTTTLTLDGANTYAGGTVLNAGTLAVGNNTALGGGSLDVIGTSTLSNAVAVALGNAVTLNANLAVANAADLSLSGAISGAGGLTKSGTGTLTLSGANSFSGPLAVQAGVLATTAAGTLGTTSTADVAAGASLSLGGNAALATLTGAGTVAITGGNTLQLGANDASGSFGGTLNDAGNLQKVGTGTLQLTGTSALGGTTQISGGTLDVDGTFGSAGGLTVATGATLTGSGNVVGAVGVADGGRLGVTSGSTLSTGSLTLASGASLDALLGVPSDTRVLAVNGDLTLDGTLNITDIGGFGNGVYRLIDYTGGLTDNGLAFGTIPGSVDPTQLALQTALAQQVNVVVSAPGNNVQFWDGAQTVGNAQIEGGTGTWTASATNWTGIDGLTNTDWQNSFAVFAGTAGNVGVQGTQGITGMQFATDGYVLTDAGAGALSANAATTIVRVDPGVTGTIDVTIGGTGTLQKVDTGTLILGAANTYTGGTALGGGTLVLGDAQALGTGTLTAATGTTLDTDQALAIANAVDLTGALTVAGSNDLTLSGPVSGAGGLIKDGTATLTLDGANSYTGGTVLNAGTLGVGSNTALGTGSLSVLGNATLSNAVAVALGNAITLGATLDVANAADLTLAGDISGSGALVKSGTGTLTLDGTNSYTGGTTLNAGTTVGNSGSLQGAIVDNAALVFNQITDGVFTGSITGTGSVTKDGAGDLRLNGANAYTGGTTITAGTLIGDTTSLQGNILDNAALVFDQAGGGVYAGVISGTGSVEKTGAGALVLTGANSYTGGTLVSAGSLIGNTTSLQGNVVDNATLVFDQATDGTFAGAISGTGNVVKQGDGVLTLSGTNSYSGGTTIADGTLQGTTSSLQGNILDNAVLVFDQAGDGTFAGNIAGSGTLIKNGTGAVTLDGVNSYLGGTTINAGTLIGDTDSLQGNILNNAALVFLQDANGTYAGTLSGTGTLVKDGTGTLLVTANSGGFTGPTTVSGGTLSVGNPANPGAALGGPVTVGPGGTLTGSGTIGGLNLSGTLLSGGDSGSITVGGNATFNPGSTWQVTPGSTGTVTPVTVGGTAVVAPGSTLQLVRAPDLPLFVDIPLINAGGGLSGQFTNITSDYAFIDPNVSVSAGGLSVSFGRNTVSMVDIAVTPNEQASAAGVDGLPTTSPILQAVLRLPDDPQAVRTAFASLSGESHATTATAMLDSRFLMSGISSHLRGDSQDTRVGDTTVWIAGRSRPNRIDGDSTANSVRREDDGVMAGAERRIGERSLIGVAVGNQDLESWSRANDDRADIDATHVGVYAQADWSAFTLQGGVDYADYRVDSTRRVILPGVMEERLSSEYDATATTVSLEAAWNLQVGTAVYSPFVAAAYTHLKTDGFSERGGIAGLSVDSAKDEYTTSTVGVRGRWELGHQAGLYASVGWRHAYGDRQVQRSAGFIGAGTSFSVHSVTLAKNAVVGEVGVSLITSPSSRMALSLQGLNGDGQTAYGGQVTWGWSF

SEQ ID NO: 18048 - protein, 941 aa, Xanthomonas campestris
MKRSLLATTISSCLVLTACGGGGGGGNVRNDPPPTTTVVPAPITDPTPAPAPTPAPTPAPTPAPTPSPAPAPAPAPPPTADPLPKTAPVPVAPPRYQGLASNLLVPTNADLAQQAGARGQGVKIGVMDDNLVQTYAPVAGKVDAFTDYTAVPGAAESTSNRLRGHGSVVSALVLGSAQDGFAGGVAPDADLIYGRICAENSCGTQQARRAAVDMAAAGVRIANLSIGASYADAASSANAALAWRFALTPLVQADALIVASTGNDGAAEASYPAAAPVQEASLRNNWLAVGAVEIDSAGNPAGLSSYSNHCGSAAQWCLVAPGMYAAPALAGTELQGQIAGTSFSTAAVSGVAAQVLGVYPWMSASNLQQTLLTTATDLGDPGVDALYGWGMVNAAKAIKGPGQFASNWAANVTSGYDSTFSNDISGSGNLTKNGAGRLTLSGNNSYAGGTSISDGVLALSGSVRSDVLVLNSATFESRGGTINGNYSLVNSTGTTAIELGKGLTVTGQASLKGNLLLLPEAAGYTVAGSERIVRAGALQGTFDRVQYANNFFWTAALAYDPTSVTATLTRNAAAASAQAAGASQSVVAGARQADSLVKALDTRVASGDTANLGGVITATGALLLATDAQVASSLPTLVGQVHGIERTLGFQSALNDARVAADRLPLLASTTTLTTWMQGSYLDGDLSRAGYASADYTQRATTVGFDMPLGGAGTIAGAALTSGEDRGTISASASRLRADRYAMTAYLYQPVGMAYLSAIGSYGMGSVETERSVQAGSIGERLQDRRHDTNWSLRTELGLLPRAGLSPFVAAGVVSQTQDAFSEASVTGLGLSAASDTLRAGYGEVGVRGHLAHGKWGFDGLVAYRSLFGDNRADFTAWFTGLPEARFTVAGEPLSKEALRASVGVRYSVSDTFSLYGNVGAERGSSDASSVNANVGLRWQF

SEQ ID NO: 18049 - protein, 632 aa, Xanthomonas campestris
MRIKTWHQLCLATTCLAFSSPLHAQTDSDEDVVYVTAARIALPAEQVTSSITLLDADMLEARGASFAADALRAVPGLAVSRSGAPGALTQIRARGSEANHVLVLIDGVEASNPFTGEADFSHYVFDDLASIEVARGEQSALWGADAIGGVIRLNSVRPEAGVSAGARVEAGSFGTQRATLRAGVSSDDHWVSASVSNYRSDGIDVSGLGAEQDGYENTSLAVSGGLPITPELRLEASARRIESRNDYDSDTDYDGRLDNADLSADGDTVLARVALLGEHQWQALRLDHEAAVQLTDDTSQTFSAGNRTARSLGQRLQAHYEITGHWEMGAVQHRLTGLIEHDRDRLKSDAGPGAGANQSRELSTDALALDYGLSRGAFDLTLSVRREAHSLFDDSTTWRLGAGWDVEAVGGRLRGNVGEAVKNPGVYELFGFFPDFFVGNPALTPERSLGWEMAWDQNLLDGAALVSVSYFESELEDEIYTDFSVFPATALNATTQSTRRGVEVFGHWEIDPDWSLLGSLTVLESEENGAAEIRRPERLASLTLAWTPVDGPFSASATLDHTGDQTDTDFGTFQPVTLDAYTLLGGQVGWDVRPGIEVYARGDNLLDEEYQDVFGYHTPGRGLYFGLRLSHG

SEQ ID NO: 18050 - protein, 992 aa, Xanthomonas campestris
MSHHHPHSASPARKLLSCALASCLLLGAAPAFAQSTAATIRGQVTVDSAPAAQAQVTATNLATGLTRTVQVTNGGYSVGGLPPGSYRLDVTANGQTTSQNVTVQVGQAATLNLGVGGEPATAAGGNATTLDAVQVKAPPVLVETRTSENATYISNVQIQNLPRATRNFLELADTVPNVQFTRDANGTTKVRSGATSAEGTNVYIDGVSQKNYVLTGGVSGQDSSRGNPFPQSAIGEYKVITSNYKAEFDQVSGAAIVASSKSGTNDFHGSFFWDTSNDGWREESPLEKKAGVRDDFEETQYGATFSGPILKDKAHFFIAYEAKEYTTPNVVIPGSIYSDRIDQLPAQLQPLVATYSTPFKEDLYFGKIDWTIGDNNLFELTGKYRKEDELNDVGQTSTFEHGSVNGQEEKRANLRWQYSGANFLNEANLSYESAFWNQAPLNDGTGYVLSYTPNRGNETDVLAAGAGSSFQRKGQKGWTFQDDLTLNSLEWHGAHTVKMGVKFKSIDLDSTQFNPANPQYYYNILSDVETPYRVRFGAPLTEGGGSVVSKNKQYGIYLQDDWEVNEHWTLNLGVRYDYEESPAFLDFVTPSDVAGALQNWPNLQNANYNINNFVSTGNNRKAFKNAWQPRLGASYDLFGDQAHVIYGGAGRAYDRNIFDYLALEQLNNSFNSYSYYFTSANNPACLGDPCTAWNPAYSTQEGLNTLTANSAGGGGREVYLIDNNIKTPYSDQYSIGMRNMVPLWGQDWFTDVTLSRIESHDGFAFVRGNRLPDGSFFQPGTTSGSPNDGPDGYSAIVLGTNGVETRNNQLALQIEKPYDEESGWGLTVAYTFSDAKENRQFGEHYALDRERVEDYGWREAGGIAKNRLVVTGIYELPYEIKLSGKLSLASQTARYGQNCLAGNDQCYIVQFKPDGTLGYKEFSIAANKEWDTGGGVKFNVRADILNVFNWVNYANFNGETGTLGDLNTAYGTPTGVLASPMRTFRLAFGLNW

SEQ ID NO: 18051 - protein, 377 aa, Xanthomonas campestris
MIDGGRKNGDAYAGQLMVGTDVDLNSLFGWHGATVKAYVTNRHGTNLSNSSIGNRPRCRKSTAPGTRLANLTLVQKLFDDRLELEAGRSVANIHFLGSDLCQYFQGNSACGNPTFVFRTSNFTYWPVSSWAAHATAWVTPKVYVHVGAYEVNPVQAQDGQHGLKWSTDDTTGVVVPYAIGYKNKGGDGSMAAMYELGGWQDNSDYTDPLRDRNGNPAVLSGLGYENKQGRSGMFARFEQQVTNPDPSGARGLTVFGAILKSTGGQAIEDHFVQLGLVQKGTFASRPQDNIAFVITQQKYSDEAIENLRLARASAGGTGTPADNQIMMELSYGIQVTKRLRIAPNLHYVINPDQFNEPTRSNDLKNALIAGMRIDWNL

SEQ ID NO: 18052 - protein, 761 aa, Xanthomonas campestris
MASTVEYGETVDGVVLEKDIQLVYGTANNTKINPGGEQHIKEFGVSSNTEINGGYQYIEMNGTAEYSVLNDGYQIVQMGGAANQTTLNNGVLQVYGAANDPTIKGGRLIVEKDGITVLAAIEKGGLLEVKEGGLAIAVDQKAGGAIKASTRVMEVFGTNRLGQFEIKNGIANNMLLENGGSLRVEENDFAYNTTVDSGGLLEVMDGGTATGVDKKAGGKLIVSTNALEVSGTNSKGQFSIKDGVSKNYELDDGSGLIVMEDTQAIDTILDEHATMQSLGKDTGTKVQANAVYDLGRSDQNGSITYSSKAISENMVINNGRANVWAGTMVNVSVRGNDGILEVMKPQINYAPAMLVGKVVVSEGASFRTHGAVDTSKADVSLENSVWTIIADITTTNQNTLLNLANLAMSDANVIMMDEPVTRSSVTASAENFITLTTNTLSGNGNFYMRTDMANHQSDQLNVTGQATGDFKIFVTDTGASPAAGDSLTLVTTGGGDAAFTLGNAGGVVDIGTYEYTLLDNGNHSWSLAENRAQITPSTTDVLNMAAAQPLVFDAELDTVRERLGSVKGVNYDTAMWSSAINTRNNVTTDAGAGFEQTLTGLTLGIDSRFSREETSTIRGLFFGYSHSDIGFDRGGKGNVDSYTLGAYAGWEHQNGAYVDGVVKVDRFANTIHCKMSNGATAFGDYNSNGAGAHVESGFRWVDGLWSVRPYLAFTGFTTDGQDYTLSNGMRADVGNTRILRAEAGTAVSYHMDLQNGTTLEP

SEQ ID NO: 18053 - protein, 966 aa, Xanthomonas campestris
MNDFRGVPMSFSLPLRAVRSPSFLSLSVAAALGLTVGADLHAQQTPAAGDATQTLDSVVVTGSRLRRVDTETANPVVTVSQEQIAATGKATVGDLLQELPSIAGNATNPYTNNGGGTGASAVSLRGLGDKRTLVLVNGIRLAYNDVNAIPASMIERIEVLSDGASAVYGSDAIGGVVNFILRTRFDGVQFSSDFGTSKERDGNRRNFALTAGKTFERGSLIAGLSYHNIDPVSAAARDYSKDALALTDGVPVKQGSSATPTGTVNFNDGSEASNQLRQANGCARVTLNGGVSGRAGPGDFHCYDAAADSYNYQPFNLLQTPQKRTNAFVLGTYRFSDSVEGYVNTWFSKTESASIIAPIPIFSNGDNILVSSQSYYNPFGVNFGTDRSTATSYNDFNTRANVLGNRSYQYNTYNFQISPGLRGRFGDSSWQWDATFNYGKVKQKSINNGFLDYATFNQAIGPSFLDSDGVVKCGSAGAAIAGCTPLNFFNLNDSSNLATLQGMVVNPIVTSVYTVKQFEANANGTLFEMPAGAASLAAGLSYRKERSTTTSDPLWTGDEDGLCGVIEYCASTLSGSFDVKEAYAEALFPLLKDLPGINALNITLGTRFSDYSSVGSKTNSKVSLEYRPVENLLLRGTVSQVFRAPNINELYAGVAGDAATVNDPCNGYTGGSSVACANVPTDGSYQQSDGQVSGKVSGAAVAGYQLKPETGKSYDVGLVYDPQWIDGLSLSADWWRIDLEDTITTVSAQTVLNQCYANSASAFCPLIHRNGNGTINYIAEPTVNLGKLWAKGIDFNLTYRLPETAWGNVNVGLNGTYLTRYDVLPDTTDPSSVTIHNVGRYTQAYGNFPRWRGLGTVSWALGDWSATWRIRYVGNTAIGNSDPDQSLSADSSRPTVVRKIGAYVYNNLQLGYEVQPWHTRFEVGVDNIADKQPPLYYSNNVGNANTDVATYDLLGRFYWARATVKF

SEQ ID NO: 18054 - protein, 928 aa, Xanthomonas campestris
MKSQFSWLVLSSTLACFTSCSTVFAATAENIGPSDSFDGSTNTGTYTPKNTTTGIDYTLTGDITLQNLGDSAALTKGCFSDTTESLSFAGKGYSLSFLNIKSSAEGAALSVTTDKNLSLTGFSSLTFLAAPSSVITTPSGKGAVKCGGDLTFDNNGTILFKQDYCEENGGAISTKNLSLKNSTGSISFEGNKSSATGKKGGAICATGTVDITNNTAPTLFSNNIAEAAGGAINSTGNCTITGNTSLVFSENSVTATAGNGGALSGDADVTISGNQSVTFSGNQAVANGGAIYAKKLTLASGGGGGISFSNNIVQGTTAGNGGAISILAAGECSLSAEAGDITFNGNAIVATTPQTTKRNSIDIGSTAKITNLRAISGHSIFFYDPITANTAADSTDTLNLNKADAGNSTDYSGSIVFSGEKLSEDEAKVADNLTSTLKQPVTLTAGNLVLKRGVTLDTKGFTQTAGSSVIMDAGTTLKASTEEVTLTGLSIPVDSLGEGKKVVIAASAASKNVALSGPILLLDNQGNAYENHDLGKTQDFSFVQLSALGTATTTDVPAVPTVATPTHYGYQGTWGMTWVDDTASTPKTKTATLAWTNTGYLPNPERQGPLVPNSLWGSFSDIQAIQGVIERSALTLCSDRGFWAAGVANFLDKDKKGEKRKYRHKSGGYAIGGAAQTCSENLISFAFCQLFGSDKDFLVAKNHTDTYAGAFYIQHITECSGFIGCLLDKLPGSWSHKPLVLEGQLAYSHVSNDLKTKYTAYPEVKGSWGNNAFNMMLGASSHSYPEYLHCFDTYAPYIKLNLTYIRQDSFSEKGTEGRSFDDSNLFNLSLPIGVKFEKFSDCNDFSYDLTLSYVPDLIRNDPKCTTALVISGASWETYANNLARQALQVRAGSHYAFSPMFEVLGQFVFEVRGSSRIYNVDLGGKFQF

SEQ ID NO: 18055 - protein, 823 aa, Xanthomonas campestris
MQHFHFPRLKLSRIAFAVAIACTQTGVWAQTVDTSASTTVVQFNIPAGPLSTTLTRIGQQSGRTIVADPALISGRQAPAINGRLSSGEAIRQALAGSDLAAESTPGGGLSIRRKSADELSEAKAMDNLAVMPTVVVTDERMGGSLAQPARQITVIEGQELDDLRAISPNNIGTMLSKAVPGLSDSSRTLTDFGQTLRGRNALILVDGIPLNTNRDSSRNLINIDPARINRIEVLRGSSSIYGSGASGGIISVTTRPAGGEPVAETTISMNGALSKLGTQGLGAQVQHYFSGKGDVVDYEVDASYRRIGGSYDAHGDRIAPDASQGDLFDSDTYSLGGKLGFRIDSNQRLQLSASYLRAKQNTDYASDPKIATTPIGTATARAIKGLNLANQNEVENTLLSANYEHKDVLGSSLSMLLYGRDNFTRFTPFDARANVNRGNNIDQVMQNNKVFGGRLTMDTPLGSNAKLLWGADFIQERSNMPLDVFDPAAYDASGGLVFRKTGQRTYLPWLTTRSMGAFAQLQYKFNEQWSAEGGLRYEKASASFDDFQPLSQSKLATPATIKGGKVSYDAVVHNAGLVFKPVKGQEFYGSVSQGFDLPDIGVILRNANATFNINSSQLEPVKTDSYELGWRGRFSNTMASFAVFRSSSDLGGVQSFNNGLVLTRTSEKINGVEATVDYYSDDEKWVSGGTFTWMQGRELPQGAKQDQQMTGYRIPPVKVTAYVQYQPNERWSNRAQFTWFAAKDYRLADGKTQFARADVDGYYTVDLVSRYKLSKKDSITLGVENLFNKYYLPLYSQLIRSGNNNSRLPAPGATFTLSYTHRW

SEQ ID NO: 18056 - protein, 1081 aa, Xanthomonas campestris
MTHPRCLRMSKLTLGLVAALAAAPVFAQSTSAGVAGLVTSSGGQPVPNAEVTITHVESGTVSRATTDASGRYNARGLRVGGPYTITITKSGEGTKTEEGVFLNLNQVNSVDAALGGDVTTLGAVQAIGGDYGSALFSANKMGTGTNVTREQIESLPSINRNLQDYVRLDPRVAQTDKARNEISVGGQNPRFNLIRVDGISTNDAFGLESNGLPTPRQPFSMDVIDEISVDVANYDVTITGATGGVINAVTKSGTNEFHGSVYGTYRDNDWSGKNQNDIRPQLFDDETTYGLTLGGPVIKDKLFFFANYEKYKGKGVFTGASGYGPIGSGESNIVQIPQSDIDRIIDISRNVYGFDPGTLALPALDSESEEKGFKLDWNISDKHRASFRYGESEQSTANLNGFGNQALSLNSFHYVRDFSLKTYTAQLFSDWTDTFSTEAKVSYRDYSAVRTAASQLPAVAVRIGNNTVNLGTEQSTQANELRTETWNAFFAGTLFLNDHTVKFGFDYEDNDLFNLFGQRVFGSYTFNSIADYAANRPLNYRYSRSNTGNIDDVAADWGMRNVGVFLQDTWAVNNNLTLTFGVRYDEPMVKNSPAYNAAASTIFGFRNDQTIDGNGLFEPRFGFNYTFDSDRPTQLRGGVGLFQGAAATVWLSNPYSNTGLAYTDYNFSSQALVNSNGIRFTPDINNQPIGNGSVNGATQSVDFVDSKLGQPSVWKANLAFDTELPWYGIVASAEAVVTQVNEAIYYQQLNLGNTTRVGQDGRNLYWNTPGLNPACWMADGRNPTGTSAPAACVRGTGSLVDARGSRDPNYNDAIIARPTDKGGSESFTVGLNKPFNGGDWSWGLYYTYTDADEVSGLTSSTSGSQLGNNAVFQANENVASTAAYEIKNSILGTLNWKHAFFGDYETKLGLIYQGRNGRPYSYAFDNDANGDGRLNDLLYIPAGRGDVLFGSAGEEQAFWNYIEGNEYLAARRGQVAERNGARNSWINQFDLHIEQEIPGFFKGNKASVWLDVMNVGNLLNKKWGQVEEYGFPGMRGVVEYGGIDAASGKYVYRFNTPDQATVYDDRGISRWALQLGFRYQF

SEQ ID NO: 18057 - protein, 703 aa, Xanthomonas campestris
MSSRRIVSLAGLAIGVFGNTGYAEESPQTIELESVNVTSDYQYETATSPVQGYRATRSATATKTDTAIADIPQSISVVPASVLKDLGSNNVERALDFAGGVSKQNNFGGLTLYEYSIRGFTTSEFYKDGFSANRGYPATPDAANIERIEVLKGPAASLYGRGDPGGTVNIVSKKPQREAFTTLQTSAGSWDRYRTALDVNTPLDEEGNLLSRVNLAVEDNNSFRDHVESKRVFVAPSFSWQLNPDTRLLLETEFVRHTSTFDRGVVAPNNKWSGVSRSTFLGEPDDDIDNDNNMVQFALDHQLNDVWSLRLASHYKQGEMSGFASEARPLNADGHTVNRRYRERDNNWHDSITQLELRGRFDGLGVEHEVLIGTEYENYRKNERVTTIAGSPYAIDIYNPVYGQPKPAGARSGTDFYEHVESRALNLQDQIVFTDKLRGMIGARYEHFDQQVDDFTTNATSGQRQDAFTQRAGLLYQLTPQVGLFANASTSFKPNNGLDAAGKTFDPEEGVGYEVGIKSELFDHRLSTTLAAFHIEKENVLALDPGTDTNRAVGKARSQGFDVQFTGQVSEAVRVIGAFAYIDAEVTKGDQSIPTGSRILGVAKHSGSLLGVYEFQEGALRGSDVGAAYTYVGDRSGQSGADFELPAYQTVDLLAHYKASDNVTVGLNLNNIFDEKYYERSYSNYWVAPGEPRNVTVSLTLSL

SEQ ID NO: 18058 - protein, 1015 aa, Xanthomonas campestris
MSNQFRRQVLKRTALAVVLGACLANGAVYAQSTTGSIYGSAPSEAGSTIVVQSDTGLSRTITVDANGRYNLGSLPVGAYTVTLKRGDQVVDTRKNVQLRVGSGTEVSFADAGRSSTADATTLGAITVTAANAPKIDVSSTSSRSVITSQQLAILPLGRSAEAIALLAPGAVAGSGAFDNGSRSVVSFGGAGVTENAYYINGFNVSNPLSNLGGVSLPYGAIDQQETYTGGYSARYGRSTGGVINQVGKRGTNEWHFGAQAVWEPKSLASSPENVRFPNNTLPDRFEYTNPDQPGTLYRSRKDDGATRTVYSAYAGGPLIEDKLFVFVAGESDKTEGVSTNSSAASVLGRNNYAYSAPKFYGKIDWNIKDSNILEYTRIESTDRRAGYYTDFDYDTLSGGGRSGTFADTYKIKDRYDIFKYTGYLTDDLTLNATWGRSRQDNLQSNPYVSALPYLQNVTNQNPALTGGTPITNDQASNRTKANLPQNKTRSLRLELEYRIGDHDLTAGVDNMYFNASNEGVRTTGPGYQWLFARQSDPTVDIRPSLGVGPSGGDGYYAQRRIFTTTTSMAVEQKAYYLEDRWQVSDNWLVLLGIRNDKFTNFNSAGQPYVDSGDQWAPRLGVSWDVFGDSSLKLYANAGRYYLALPNSVAVRGASASTYTDEYFAYSGLDANGEPTGLTALGPGPVSSNGEYGQTPDPNSFAPSDLKSQYQDEFLVGFEKTLGQSWNSGAKVTYRKLQTAIDDVCDTGRMADKLEASGVSASSVAIPGCVMFNPGETNTYNLANVDGSGRTQVRMSQEDWGFTSGAKRNYVSVDLFLEHPFDEKWFARVDYTWSHLYGNTEGQVKSDLGQADVSKTQDWDSAELMYYAGGNLANDRRHQFKAFGAYQFTPEWMASATLRVLSGTPKSCLGYFGQGEQDPIGYESAYHYCAGTPSRPGDAGRTPWLTNLDLGVTYRPAFADHKLAIGLQVFNVINDRDATRAEAVYGDDRFTVSNTYGMGTYFNPPRFVRLSASYDF

SEQ ID NO: 18059 - protein, 376 aa, Xanthomonas campestris
MKTTLLVALMACLGAMSEAAAVEVTVGGRLHLDYARYNADVRQLDNGMLLRRARLDMDGKLTSDWSFELAYDFANVYALTNTGTVKDGDFKEGFTDIALHYDGWKQADLNVGQTKVPFGLEELNSSNAISFIERALSTDAFAPSRRLGAEVSRNRDHYSVSVMGFGSSFDGRERGRGLAARATVTPIYAGGGNTVLHLGIAAVVERPTGEVKFTARPESRALDVRFLNTGKLADVTHVGRLGLEAAAKSGPLSLQAEWMQTAIKREGIGTDATLEGWYVMGSWVLTCESRQYSSGRFKGVPVQRPGGAWEVTARYSHLDLDNANVRGGEEDNLTLGVNYYASKHLRIMLNYIDVHSERRGKADSPQILLMRAQLAF

SEQ ID NO: 18060 - protein, 831 aa, Xanthomonas campestris
MSPRVTLSTLTATLLGGTVLSMLWTPQALANCSNFNPADGETVICDTAPPNPTNAGIDGGNDVTVIVRDGAVVNRSVDTIFLQDNATIFVRPGGTISTTGAEAIDVNFGNVTVGGLVEDTAASSGSNAVEFDGSGDVSSSVLVQSGGIIRANGGQAVTVFSRGGGTVTVAPGGQITSASNHAIYFFEGGGEVINAGTISGNFTGGMSPDPVAIEFDNAFGPTPTPSRLELQPGSAINGEVIARSTDEDTLAFGGNSGVFNFDISSVDGNNTNDGEQYLLFENFEKVGAATTNLTGTNTEITDFAVNGGLLNVNGSMPNTAFAVNGGVLGGDGTVGSFVANSGGTIAPGNSIGTLNVAGNATFQSGSVYEVEIAADGTGDQVRADTATINGGTVDVVTLDPYTAYTDGQRYTIVSTANGRTGTFDSLQDDSAFLDYNLLYTSNDVILELIRALQFPDVARTFNQRQTANALMQLDQTPGSASNGLYNALLLLDAPTARDAFDQLSGEPHASMKTALIQDSRFVRDAAQDRINGAFGMNGGGDMVQPLGFGPGVPVIAGSGGADVEAWTRFYGAWSDVDGDGNAAAADTDTSGFFVGVDGMVSDTVKLGVLGGYSSTDLDVDARNANGSTDSWHLGLYAGTELYGLIVKGGAAYAWHEIDMVRSVSFPGFSDTLVSEYDAGTGQVFGEVSYDFALSTATISPFAGLAYVHHRTDRFTETGGAAALTASGIDLDTWFSEIGVRGSMLIGTDLSLRGEAGWRHAFEDTTTLEAFRFATSPAYLVKGVAIDEDVGFIEVGADYRLNEWATVGAAYEGQYGSDTTSNSARADLTFRF

SEQ ID NO: 18061 - protein, 404 aa, Xanthomonas campestris
MTSSGKEPSNTNVTNPNPTTTGTVTAPSENKSNWETGLGKGIRGTSNDGKHNIQLRFRSQLQGNQSFQIDPSQDTTNFLVRRTRLQLKAGLFNDTWLVNLQLGFAERDMESQRRNTLRDANIIYNQYRDVKVAFGQMKIPFSRQRWNSSSALQTVDRSSVTAEFNLDRDVGAYLFSEDLFGSKRMFAYYLGVFGGQGRNRVERQTPGVLTVARLTFSPFGGMSKSGSDNDWLSEVDFARYKDPKISFGVSGAYNKNSDRALSTHGTEYSFAKFNYSHAAGDIYFKWMGFSFQYEWLWRRANTAYVERTVSSALSREYSRSGQGHFVQLGYLFTNQYELVVRFGEFRPLGETDPNLKYSREVGGALSYYFAEHNLKWQTDYFYYTGTPTAAEGDHVVRTQIQVFY

SEQ ID NO: 18062 - protein, 772 aa, Xanthomonas campestris
MTPRISPLTSAVLLTLSAPAFAQPGDAPAPPGAVDLDAIRVQQERAQKPSSPKYTEALRDTPQTITVVTKQTMDQQNLLSLRDVLSTLPGITFGAGEGGGGYGDSINLRGFTASSDITTDGVRDSAQYSRSDTFNLEAVELINGANSAMSGAGSVGGNINLVTKTAGQGDFTNVLIGGGSDRYGRLTVDSNYDFENGTAVRLNAMGHTQDVPGRDEEFRHRWGFAPSVAFGLGSDTRFTLSYLHQHDNNLPQYGVPFALSPFNDGPLPGVDRETYYGYRNVSRQEIDVDMLTGVLEMDFDDNVKLRSLARVQRVDQTTTATAPEGTWCLPNNTNAYTGRACVGQPPSTWNPNSGPRGLVRETENFIAHSQTDLTATLHTGAIEHRVVAGVAFSKEDFELDSGSIFRNADGSTTGITYPLQTFDNPYNIWTGPQNYFRTGRSKGSLTNQAVYLFDTLQFNEQWMLNLGGRYEHNEGDSTTYTVNATGGVTGVTPGFPAGSEEDLFSYRAGLVFKPVDNASLYLSYANSKTPSKASVNGSCTPIATATVGANCNVEPESAVNIELGGKWDVLNERLALTAAVFRNERENYKVNSGDPLIPEQVLDGKARVDGIALGAAGYLTERWSVFANYTFLDSEVLQSVSNRTASLTGDPIAGRELVQTPRNAGNLWTTYQLNEWTFGYGVNYQGSFYPNNTSTAVYRKTDAYWVHRVMVGLRVNDWLSLQLNVNNLFDKEYYTSIRNNLTVNAAGTVTAGSGWALPGDGRSAVLNATFSF

SEQ ID NO: 18063 - protein, 700 aa, Xanthomonas campestris
MKSFKLLPVSAAVLSVLAANAVAQTASTDAVVLDTVTVTDNQGLKVQSNVVTTKKKDESTQTDLRGLLKDEPAISLGGGNGTSQYLYIRGMGQNSIDVKVDNTYSDSQILYHQGRHMLDPALVKIVSVQKGAGSASAGIGQTNGAVIAKTVDALDLLKNSDKNFGAKLGTGFSTNHAHNFNATLYGKGEIFDALVSGNLVRDRDYKGGKDYVNQFGTNRVPYSALDKTSFLAKLGATLGDHRFVLSHSSERNEGQRLVREEFDVAPNGTKVSPYNRLTVERQAPANRRITVQRTNLEWTGKNLGFAQEATANVYQLVQGRWSENETGNGYAGGVDYATKTKIVTHGANVNFDSALHENVLLKYGVNYRHQEAKPHTKFNPLVKNQEKTDTGVYVEAITAPVDKVTLTTGVRYDHFKFKAMDGKERSNGAFSPSVGLIYEPIEHLSLSASHNYATRSPRLYDALTAHGNRKIVSIGSNTKAEKARNTEIGFNYNNGTFSFDGSYFWQDIKDALGGGRDSHNPNNELIMNLGKIKNRGYELNAGYHNGGFTARIGVAHSKPRFYSPTIWEVNRQTGKREEKPLLSTNPEYASAIGRTWTASLSYRFEQPNLEVGVHHRIVEKVKPEDNFFVTGGTLQTNTGTGKDGYNVTDITLNWKPLKDDSVNVNFAVDNVANKKYNAHGQRGQLSARGREFRAGVNYTF

SEQ ID NO: 18064 - protein, 928 aa, Xanthomonas campestris
MERELMNCKSNKLRDAVVLALVVGVGGTGTAIAQEAGTTNLDKIEVTGSRIKSADIETSQPVLTLTRQDIDKQGVTSVADVLQRVAANGAALNRTFNNGGDGSSGIALRNLGSARTLVLVNGRRWTTGLDGSVDLNTIPTAMVERIDILKDGASTIYGSDAIAGVVNIITRKNFDGAEAGVNVGQYSDGDGQRQAYDFTLGTTTDRATLMVGASYVKEDSVMAGDREISAGGPPFFSGQSGTGFPGSYVRNGSRRILINGVETPYVANVHGYNTAPDNYLLTPQERTSLFTQGSFNFTDNVTFRTEAMYNERKSEQLLAAMPVTGLTLSADSLYNPFDQNLTSVNRRFIETGGRSFNQNVKNWHFYGGLEGFFEFADRSFDWDVGYRYDKSDENVLTYGLFNLANLNNAYGPSELRNGVPVCVSGPGGDVIPGCVPVNPLGPRGSITQDALDYTSFTAHDSSMVESKGYTANISGELFTLPAGPLGFAAGYEYRKESGQFDPDAFIAAGLSTGNGARPTAGSYSLDEFYLELSVPVLADLPGAQLLDFSLATRYSDYSNFGDTVNNKFGFRWKPIQDLMIRGNYSEGFRAPSINNLFAGNSDSFETYADPCSSQSGQLSNPVVAQNCAAAGVPANFVQPGAGNGAKQTLEPFTWTSNDQLQPETSTSRTLGMVFSPSFAQGLNISLDWWQIEIENAITRPESQFILDKCYGGSAGEQAEYCALVTRDPNYADGAYTVTNINMPLLNLASYKVEGWDLAVNYRLPETAIGQFTISWDSTYLSSWETKATADSELEQFQGRYLNQDPYWRIRSNLYVDWSLGDFGINWGLRYKSGMAEACPLSTALAQAYCSDPDRVTADGAEPRNHIGATTYHDIQVRYSTPWNATVSVGLNNAFDKGPPVAYSTSANRFDPQYDVPGRYMYMQYRQRF

SEQ ID NO: 18065 - protein, 878 aa, Xanthomonas campestris
MKYRTSLLSSAIGMSLVFAAQAQHTADPQATELDAVQVVGIRASLEKSLDTKRNNTGISEAITAEDIGKFPSTNVAEALSQIPGVTLDRRFGQGERVSIDGTDPSLNLSFLDGHPVAQAIWLYGEQPSRGFDYTLLAPQILGRAEIIKSSEARLTEGSLGGTVLMHTRQPLDLKANEVAASIGYSYSDQASQGKPNAALLYSWKNPAETFGVTVSAQHYEERVDRRGMEVFGYAPASTFANAAGGVPADADVPNSINAAWFQQDRERDSAVVNLQLKPSDALEFNLSGLYINENFDNYNQSMYSFLTWNAGTVGAVDQLGGVRNGVVTSGHSSANADPLGGTVIYDNNVRESEVTTKGLDLRGALRGEGWGLNGQVGQSKSENKDLSQYFIEPFYNGGFSWDTRRGIRFDDPAAARDPANWGSAGGWFGNNGIFSTESKDTYGQLDFNLQFDGVFNQLLLGVRHGKHDERFELNVYGGVTPGTLADVGTIGLTDLQGFYPDHGQHVQAGRDNVLNWIRNSPVDYSAPDPASYLNNSWALEQTNNAAYAQVNFSSGGLRGNLGVRYVDSKTEGSGFVYSGTPSLANADSLWQTRTRKEDFLLPSLTLSYDTSDDWMFRFAAAKVIAWAPYNQMVNNTFLNDTTLTGSGGNAELSPYESWNFNLSAEYYFAPQSVVAWSVFYKKIDNYIDTSVSVERQYNALRDTAPQSWAQLIGSNGCTADGYCDYSIQRPRNAGDGKVKGFNLSFQQPFGDSGFGLTANYTYANGENNTGDPLPYQSRNSVAFSPYYEKGPLNARLTYNWRDSYLAGGYVAGAAPASVDDYAELGASVGYAFSPNWSLQIDAQNLLDEEYLQYLGDKEHLAGRYKSGRRYMATLHLKF

SEQ ID NO: 18066 - protein, 670 aa, Xanthomonas campestris
MDSTRLAGVWLIGTLLLGQGSAFAQVDEADFFDELPVVLSASRLSQPVSDAPTAVSVIDQEMIRASGFRDIPELLRLVPGFSVAYTEDNTWTAGYHGLADAYSRRFQVLVDGRSIYSPHYGAVYWTDLPLSIDDIERIEVVRGPNAAIYGANAFVAVINIITKAAAQVPGAFVSMQAGEQDMRGITVRQGGGSGDLRYRLTASAQQRDRFERDVVGKLDPEGPLSDDNGRYFEASRTYFVNGRVDRQITRDSDLMLQFGLSRGDWKGGSRTAAPGSVLEPIDQDSRALYLQLAYHKVESERREWRLQAYHSQNRFDADAAGDVGVNVVVDQYLTQSRSNIELQVTEQWTPTLRAVWGGEVRQESVKSPQGYNSDRTLRGELARSFANLEWRATGRLLVQGGAMLEHHYFTGTDVSPRVAANFTLAPGHVLRLGISQAYRSPTFFEQEGNQVIVLDDGTVGDVVTVPSPRLAPERILSREIGYVGYWRPARLEFDLRVFRDKIGNFIGQQKSDFFSGDAIRVNEFRYENIGQAWSQGGEFQLRWKPVRRLDVHAHFARVFTTADTRRENYTVDIPLSTPRSSWGVLATYRFDNGWETSGGVWGTDAVKWLTEGDTTRRYTRVDARLAKRWKWQGREVEAALVGQNLGDDYEEFRDTNRFSRRVYGSLALAW

SEQ ID NO: 18067 - protein, 674 aa, Xanthomonas campestris
MNTPLRLAASAIALSSAFPAFAQAGQDDEDEGTQIVVTGEGLEPALSNIVYSTIELDREAITSTGSGRLDDVLANVAGFQQFRRSDSRSSNPTAQGVTLRALSGNATSRALVLLDGVPIADPFFGYIPLSAIAPETLGNIRVTRGGGSGPFGSGALAGTIELESAGLGTIDGVNASLLANDRGATEATGIVAGKLGSGFAVASGRWDRGKGFFTAPESQRVPASARAAFDSWNVGLRGVAPLSPDVELQARVSLFDDQRTLRFDGADSTHEGQDASIRIVGRGDWGFDALAYVQARNFSNVIISSTRFTRVLDQRNTPSTGIGGKFEIRPPIAEGHDLRVGADYRRADGELFEDAFSAFTGALRESRNAGGVNSNLGFFVEDDWSIGPVVLTGGLRADHTRIENGFFRAVDANGALVSEVVAPDRSDWALSWRAGASFYATRRLDLRAAAYTGLRLPTLNELYRPFVVFPVVTQANAALENERLEGFEIGLNWQPVNELVISLTAFDNEVENAIANVTLAPNLRQRQNLPAIEAQGIEGAVVLRLGEVSFDASLAYTDAEIAGDGTSAALDGNRPPQTPEFAASATLAWEPVEGWRLAGTVRHVSSQFEDDQETDLLPAATTLNLFAQIPIKGELSLVARAENLLDETIVTRNAGGAIDLGVPRTFWFGVRLGL

SEQ ID NO: 18068 - protein, 806 aa, Xanthomonas campestris
MHPFPTRSCHRMNCKTSPLAVAVVLALSFSASTASAQSQAPAQKTLDILIVTGTRVADRTVAESASPIDIISPQALESTGTTELATALSRAIPSLNFPRPAISDGSDAVRPAQLRGLSPDQVLVLVNGKRYHSTALINLNDTQGRGSSPADLNTIPIAAVERIEVLRDGASAQYGSDAIAGVINVVLKGSGEGGSINGRYGKYSAGDGEQYQLSGDAGFSFAGTGKVHLAAQAGHSDQTNRALPFQGRVEQRYGDPDIDQGALSFNGEYSPTDYLTFYSFGMVSRREVLSNGYFRFAGDNRNRPEIYPDGFLPQIYNVSKDVSWVGGLKTSTEGGLNIDLSYNYGQNNLTFDVRNSLNNSLGLASPTDFHAGTLEVTQNVLNADFTKTLDWGLAYPVTLAFGAEWRGEKFNESPGDAASSANGGIPSANGSLIPGAQVFPGFKPSDAGYYNRNSHSFYADLETDLTEKFSAGLAGRYEKYSDFGDTATGKLSLRYAFTDKVAVRATASTGFRAPSLQQQNFQSIATQFLNVAQPNGTVTAIPFEIGTFRTDNPAAIALGAEPLKAEESKNYGLGVVLQPVENLYITVDAYRIDIDDRIVLSENLTSTAVRNYLQANGFPGIGGGRYFTNAVDTKTQGVDAVGTYRWNLDGGSAELTSGYNYNKTEIKRIADNPAALMAIDPSAVRIGRAEIGRITEGTPRDKFFLGGTWSPGNWSFTGTATRWGEFSTFGTNAGSDQTYAAKWTLDLAASYKLGAWNFTIGGDNVLNEYPDRQQAGLGTRTYLPYSSASPFGFNGALVYANVNYKW

SEQ ID NO: 18069 - protein, 750 aa, Xanthomonas campestris
MAESESPIDIISEESLQATGATDVATALGKLLPSLNFPRPAIADGNDAARPATLRGLSPDNVLVLVDGKRYHTSSLVNYNPYVGRGSAPADLNSLPMSAIARIEVLRDGASAQYGSDAIAGVVNIVLKHGAAAGSNSISVNGGIMDKGDGAQNGIDGSVGLPFGATSGDSAPGWVRLSWNYQNSMDTNRSENTNRATTLAGAANPSGVPYQRHGDPDARFYQGLVAFGYNFTPSVELYGHLSVSRREVTSNGYYRAYDNSDRNVQAVYPNGFLPQIYNPINDRSAVLGVKGTTESDWHWDVSATYGKNDMTFNILNSINTNLYWSTGSSPTNFNSGGFETEQGTLNADFNKSFDWGLAYPVNLAFGVEHRQDRYEIVAGSPASYFFDPDTINPETGSPYPGGAQVFSGLEPSVAGKFGRHSNAAYAALEADLTDKLSGGIAGRYENYSDAGSTRSGKLSARYAFTDTFSMRATISNGFRAPSLAQQNYASVVTLPQDGQLIQVGTYRTSDPIAVQLGARPLSPEKSTNYGIGSVWQPTTNFTSTLDVYQIRIWDQILYSDQIQLAQPIGQVGAVQFFVNGATSRTRGVDWVNSYRADLGAGGSLDLSASANYNKTKILELSNPNFGRASQGLLTESTPRTKYMLAADWTLDGFSLNGNATRYGAIKRISDPADGSQDQTYSARWILNLAANYTWQALTFTVGADNVTNQYPTKAQLTTGYDDRASGLQYSSLSPFGFNGRYWYGRVTYRF

SEQ ID NO: 18070 - protein, 709 aa, Xanthomonas campestris
MPTFRFHALAIAIAATTLSAAPLARAGETDGTAVETDTSIRALDAVQVQGSLLGRSKPEDVQRYAGSRQVIDREQLRNGGNRSLDDALQRVPGIKIFDETGTGALPQLMLRGLYESRSGRVQVLEDGIPLALAPYGQTSLSLFPVGLNQIDRIDIVRGGAAVQYGPNNVGGVINLVSKEIPSDWTTTLAHKITAGGQGQFLQDSALSSGGYVTDNVGLQVDANRTYGEYWRAHSDTDISNLRVRAEWWIDDTKLLKASVQRYLVDMDLAGALSPEDYRRDPRQSTRPLDSFNGRTTRASLSYEQVVGDWGPLQDVRLSWTNFSARSSRNFIVGMRQAATETWRSDLPPQLRQTAPRDFRVVGSEPRLTWRMGDVGGVQQQWTAGVRAVHEDIDFLVGNLRLRDGLFTSVRDWQFEDRALAAYVSNAITLPDARLTITPGLRYERLDSRYFNRTTGVSTLNQTRDVLPGLTVGFQANDQWFVYADGQRSMRAPQVTQIIFGNNLDAELAWNYELGTRYQPNERTRIQVGAYLIDFDQQIQLDNTTRVFRNLGKTRHQGGELELQWSPEQLRALTLNAGYAYLDARQESGAFDGLRVPYTSRNQITLGGTYALGHTTVALSSYYFSKAYSDAANTVHENAIASVGELPSYWVWNTQVSHTLLERGGQKLSASLAINNLFDRQYWFRGVDTSPWGRQAAPGRTVTAGLEYTF

SEQ ID NO: 18071 - protein, 640 aa, Xanthomonas campestris
MMSKYLLASASGMGFLCLIAGLSPVQALPSLEIADENVAVNQNDGSYQKNDFNQSNLAKNISSKLLIANENQKKFSSVKQQQNNQDLGVDSAVTYKQPVIPQSINSSPSSDKLAQVTSVSQLSDVQPTDWAFQALQSLVERYGCIAGYPNQTYRGNRAMTRYEFAAGLNACLERINELIATATGDLVKKEDLAALQKLQEQFAAELSTLRGRVDAVEARTAELEVNQFSTTTKLNGEVIIAGVGATGGAPNDSDPNIILVNRVRLNLTTSFTGKDSLITGLQAYNFLGGADGQGSLQQSLGLASPLLSSSSARTSFEPQFPGLNVNTLSSVGANSVQLYKLLYIFPVANKLTLFAGTAAETSDAFPAITPFYGEGQESISRFAGLNPVLRVSGGTSGTGLASAAGFIYSISPNLDLRALYGSVNANLPQKSADEVLPGVSTTPLGGGLFSGSSVVAAQLTFKPSPDLDIGLNYANSYHEINILGTGLISGDVGALAGVEAGTPVKLNSFGGTVTWRLSPKIALSGYGAALFVDAASNSVNASTTFTSWMAGVHFRDLFKSGNTAGILFGQPLFRSDTGGSAQLTPTGENRATPYHLEAYYRLQVSDNISITPGAFVLFNPEGNSNNETTTVGVLRTTFTF

SEQ ID NO: 18072 - protein, 811 aa, Xanthomonas campestris
MTRPTLSVIGLAIAAVLSANAQAQQADAGATTLDTVIVTGTRASDRTVLESTVPVDVLTAEDIRKAGVVNGELGSALQALLPSFNLPRQSNSGGADHIRAAQLRGLSPDQVLVLVNGKRRHTSALVNTDSKIGKGTTPVDFNSIPINAIKRIEVLRDGAGAQYGSDAIAGVINVILDDNPERGELEASFGAYNTDVKPIDRRVTDGQTSYASAKVGTLLGDDGGFFKVGLELKNREATNRAGFDQIPSFEEQTPANLALRGQRNYVLGDGATKGLNAWLNTKVPFSASGEFYAFGTYNQRDTEGANYFRYPDGSANWREIYPNGYRPISEGENRDLQLVAGARGQWGNWDYDASVNYGRNDFTYRLRNSLNASLGPGSPTRFKTGDFAFVQTVGNLDLTRVFDAAGATHTFGTGAEFRREQYRTHAGDPASYAAGPFTDRPTGSQAGGGLTPQDEADLSRNVASAYANVSSQFGDKFSTDLAGRYEHYQDFGSQWTGKLAARYAFAPAFALRGAISNNVRAPSLSQIGYEATSTGYDAAGRLTQGRLLSVNNPIARGLGATDLKPEKSVNYSLGFTSKLGDHFDVSLDFFQIDIDDRIALSEDITGDALTSFVQQNYGVTGVQSASYFLNAADTRTRGAELVANWRQYAFGGDLLLTGTYSYAKTELENIIATPAQLLALNPEYVLFGVEESNTLTDAAPRTRASLAANWSNEHWNLQTRVNRYGSATRVFDFGGGFVPRQTYGAEWQLDLEAEYHLGTQWTLAIGGQNILDNYSDRSIDDIAYFGNLPYDVLSPIGSNGAYWYGRVRYSF

SEQ ID NO: 18073 - protein, 358 aa, Xanthomonas campestris
MAVAGIGIGAAVPPALAQSSVTLYGIVDSGITYTNNQKGHSAWKATSGNEQAARWGLVGREDLGGGTSAIFRLENGFDIENGTASQGGRLFGRRTYIGLANDRWGAFTMGRQYNAVQETLAPLHIATVLGRYAHHPFDADDLDSTFRTNNSVQYQTPDWGGVRAIATYGFSNSTSFARNRTWSVGASYARGPLQLAAAYVRVDYPAIDATGAIASDNYYGFVKGVARQQIWGAGGAYAWGGATFGLLYTSALFSLQTGGAERFNNFEGSVRYRVTPAVQVALGETYTQVLASHAAAHDAHYLQTSAGIQYFLSKRTDVYLNVSYQRASSNAVAWIKGLDGASSTRTQIVAVTGIRHKF

SEQ ID NO: 18074 - protein, 464 aa, Xanthomonas campestris
MNKLLSGLSVFLLLAHNECAAKKRGLTLEQRMALLEERLEVSEKRSEKAERMLKSFDIEQHSEIRQIRSEQDKKDVNRYAVAESTQEKISSPGVLLSGFNELKFYGDVEFNIDAASKSGQLVMINSGVNSDSVNERWDLNGRILLGFDGARKLDNGYFAGFSAQPLANIHGSVNIDDALLFFGKKDKWKVKVGRFEAYDMFPLNQDTFIEYSGNTANDIYADGRGYIYMMKEGRGRSNAGGNFLISKQLDNWYFELNTLLEDGTSLYNDGNYHGRDMERQKNVAYLRPVIAWSPTEEFTVSAAMEANVVNNAYGYTDSKGNFVDQSDRTGYGMSMTWNGLKTDPENGIVVNLNTAYLDANNEKDFTAGINALWKRFELGYIYAHNKIDEFSGVVCDNDCWIDDERSYTIHTIHASYRFANVMDMENFNIYLGTYYSILDSDKMYINDSSTESRYGVRVRFKYLF

SEQ ID NO: 18075 - protein, 359 aa, Xanthomonas campestris
MRWQLGVNMKKTIVAAVIGSVVASASVVVSTSAIAAEVYSGDELAVNVYGNLRARYETTDNNVMGADSTFTGEGTEIGLGMTYFLANDMYVNGDVLTEVNIIPESGDGDNFDDSAFLKFGSVALGGNFGEVRIGRMSAIQDTLAGQYDISWEYAGTANIKNDWSATDRLTNGIQYKYDMSDLGLVFMAQYHTGQEFDGIDLKNEVEIDQAFAGGVAWASDFGLGLSGTYTYSERTKTDVKYGGDDDTSWTLNATYDIEALSLAAMYSDYDFAGDKQTGIGAMARYDLPMGVGLYGIYDYVDYATDDNKLDQYTVGADYWLNDSVVSYAEYADMSYDKQSSNGNTFQDDSAFTIGMRVYF

SEQ ID NO: 18076 - protein, 363 aa, Xanthomonas campestris
MRKRSIALVVASLPIGSAFAQSNVTMYGLIDGGVSYVSNQGGHSVTKFDDGIYTPNLFGIMGTEDLGGGTKAIFKLENQFQLGTGAIEQQGLFGRNTYVGLESAHFGKVTLGNLYDFMYTSLTEAGNAPGVFSGGLYNFPAGPFQKLNLPQNPTGWFDWSRTTGTPTSNSIRYESPVFAGVSAGALYSPGGVAGSFGSNSGMSFGLNYAAGPFGLGAAYTQKKYPGSTSGSPQIPVWNWGVGAHYVFGPVYTVADFVTVHNSFSGAAAYAGQVAASWQITPAWSFGASYMYMKGNDVLDNNHANQVGATLNYSLSKRTMVYAEGVFQRANSGAQAAINGIMDAAGSSSTASQAIARVGLRTAF

SEQ ID NO: 18077 - protein, 363 aa, Xanthomonas campestris
MKHVALACALLATACGAAQAQTNVTIYGVLDAGVEHLSNVGGNGSLTRMPGLGVSVPSRLGFRGTEDLGGGLKAIFTLESGFGTDSGTLNQGGRFFGRQAFVGLSGDWGSLTLGRQYSMLFWSQIDADILGPNAYGAGSLDSYLPNARVDNSIAYRGTFNGLTVGATYSFGRDTVNANSPSGTNCAGESATDKSACRQWSAMVKYDAPTWGASAAVDEIRGGAGAFAGLNSSDKKDRRTTVAGWAKFAALKVGGGVIARSNDATPATRRSNLWYLGASYPITQALVLDGQVFKLDYKHSDNQALLYAVRGTYHLSKRTALFATAGHIANDGTLALSVSGAAAGGGTTAGGSQTGVAVGIRHSF

SEQ ID NO: 18078 - protein, 3961 aa, Xanthomonas campestris
MRARRSLLVTQEKHMNRAFALVWNAAIGNWVVTHELVRRRRKSGATRRNLPSMVILALGAAAPTLAWGACTPALPAAGQTVTCTGLPITSNAFSSNASNLTVNVAPGTQMTAGLLGGTAIALGGTNSTLNNSGTIDPSVLGLLSVLSTGVTMGNASSTQVTVNNLATGTIYGSGGLLGANLLNLDGMALGITAAPAGVVQINNAGTISSRPLLNLSVLGSDTPVIAVSGGATVNAVNSGTIEGRVGFQSSATGNTFINSGAINGSVSMGANSINSFTAVTGSSVNSAGGIGVALLGPGGLLSFAATGTVDGGAGGTNTLILQNSATGTGSGTAGTAALSTSQYINFGSLRVNSGTWTLGGATNFSNTALNGGVAQFANPALFGTNITANGGAIEATAANLTLSPTGGIALTGTGLTVQGANALTIGSALTGTGALTKTGIGAVTLTGANTYSGGTTLAAGSLTLGNNTALGTGTVTAAGGTLSGTTALNLANAFTLTDSLTIGGTNAVRLGGAVSGGGGFVKTGTNTLTLGGTNTYTGGTTLNAGTVVLENAAALGTGVVTAGGGALDTIAPLSLANSVLLNSTLGVGATGNALSLTGVLSGTGGITKTGTGTLALTNANTYTGATTLAGGTLQVGNAAALGGSTLNVTAASTLSSSIALALGNAVSLAGPLTVSGAQALTLGGAIGGTGSLLKSGTGDLTLTGTNSYTGGTTLSSGRLLVGTGSALGTGTLTASGGELAATAPTTLTNAVALTGALGVGGNGTALTLSGTVSGTGSVNKLGTGTLTLGGLNTYTGGTTLGSGTLQVGSATALGGGALNVTGNAALQSTAATTLGNAVNLSAGALTFDGTQALSLTGTVSGTGSLVKSGTGDLSLSGNNVFTGGTTLSAGRLTVGSNTALGSGTLTAAAGSTLDSAVVSTLANAIALTGVGAVNVGGANALTLSGDISGVSSLNKVGTASLSLTGNNTYTGGTRLSAGSLLVGSDTALGTGALTAAGGVLDNTAPVSLSNAVVLEQNLALSGNQDLALGGSVSGTGALIKNGNAALSLTGTNNFTGGVTLNAGTLLINSGAALGTGVLTAADATRLDTTAAASVGNNVALLGALTVGGSNALDLTGTVSGTGSLIKEGVGALTLTSNNVYSGGTQLTAGSLVVGADAALGTGALTTADGTALSASTAVTLQNGIALGGALSIDGQPLTLNGVVSGAGSLIKNGTNALTLNGNNTWAGGLQLQAGSVLVGSDTALGLGTLTAAAGTTLDATTAATLGNAVAVDGALTIGGTQDLTLNGVVSGAGSLDKQGTATLTLGTANTFTGGTTLGAGRLVLGNEAALGTGQLTIAGVAELDTAAATNLANAVQLNAQLTLAGSNDLSLNGAITGTGGLLKNGTGTLSLTTTNSYSGGTTLTGGTLAVGADGALGTGSLSVVGDAVLSNAIAVALGNDITLDAALTVDTVGDLLATGNISGTGGLTKTGAGILTLDGSNSYTGPLAVQAGALVANTAAALGNASTVDVGAGALLSLTGGGLINSLGGAGNVDVGAGSTLQVGAGSFAGSLIGNGNLDKIGTGTLSLLGDNGVAGSTSVSGGTLDVAGSLTSSTLNVALGGTLRGAGAVTGPVTIADGGRLAITSGSTLSVGGLSLASGAFIDASLAAPSATRLLAVNGNLTLDGTLNITDIGGFGTGVYRLMDYTGLLTNNALLLGTIPGSVDISQLALQTAIGQQINLVVTAPGSIVQFWDGAQTVANGSVDGGSGIWGAASNWTGQDGTANSTWQGDFAVFSGTAGTVGVQGAQAVGGLQFVADGYQLTDAGAGSLSITTPLTAVRVDPNATATLDVGISGAGGLEKVDTGTLVLDAANSYTGGTTLSGGTLVLGDAQALGSGALTTANGTTLDTNQALAVGNAVVLNGALNLAGSNDLALNGAITGAGSLVKNGTTTLTLDGANSYAGGTVLNAGTLALGSNTALGTGSLSVIGNSTLSNAIALALTNNLTLGAGLTVDTAADLSLSGVLTGAGGLTKTGLGALTLAGSNSLSGPLSVQTGVVATTAPGALTGVGAVDVAAGAGLQLGSNTALGALTGLGNVAILGGSTLQVGNTNVTGTFGGSLSDAGNLEKVGTGVFQLTGTSSIGGTTLVSAGTLDVDGTLASAGGLTVANGGALSGSGVVDAAVTVADGGRVVVSSGALLTTGTLSLAPNATIDAFLGIPSQTGVLAVNGDLTLDGTLNITDIGGFGNGVYRLIDYTGGLSDNGLAFGTIPGSVDPTQLALQTALAQQVNVVVSAPGSNVQFWDGAQTVGNAQIEGGTGTWTAGATNWTGIDGLTNTDWQNSFAVFAGTAGNVGVQGTQGITGMQFATDGYVLTDAGAGALSANAATTIVRVDPGVTGTIDVTIGGTGTLQKLDTGTLILGAANTYTGGTALGGGTLVLGDAQALGTGTLTAAGGTTLDADQALAIANAVDLTGALTVGGSNDLASSGAITGAGSLIKNGTTTLTLDGANTYAGGTVLNAGTLAVGNNTALGGGSLDVIGTSTLSNAVSVALGNAVTLNANLAVANAADLSLSGAISGAGGLTKSGTGTLTLSGANSFSGPLAVQAGVLATTAAGTLGTTSTADVAAGASLSLGGNAALATLTGAGTVAITGGNTLQLGANAASGSFGGTLNDAGNLQKVGTGTLQLTGTSALGGTMQISGGTLDVDGTFGSAGGLTVATGATLTGSGNVVGAVGVADGGRLGVTSGSTLSTGSLTLASGASLDALLGVPSDTRVLAVNGDLTLDGTLNITDIGGFGNGVYRLIDYTGGLTDNGLAFGTIPGSVDPTQLALQTALAQQVNVVVSAPGSNVQFWDGAQTVGNAQIEGGTGTWTAGATNWTGIDGLTNTDWQNSFAVFAGTAGNVGVQGTQGITGMQFATDGYVLTDAGAGALSANAATTIVRVDPGVTGTIDVTIGGTGTLQKVDTGTLILGAANTYTGGTALGGGTLVLGDAQALGTGTLTAATGTTLDTDQALAIANAVDLTGALTVAGSNDLTLSGPVSGAGGLIKDGTATLTLDGANSYTGGTVLNAGTLGVGSNTALGTGSLSVLGNATLSNAVAVALGNALTLGATLDVANAADLTLAGDISGNGALVKSGTGTLTLDGTNSYTGGTTLNAGTTVGDSASLQGAIVDNAALVFNQTADGVFTGSITGTGSVTKDGAGDLRLNGANAYTGGTTITAGTLIGDTTSLQGNILDNAALVFDQAGGGVYAGVISGTGSVEKTGAGALVLTGANSYTGGTLVSAGSLIGNTTSLQGNVVDNATLVFDQATDGTFAGAISGTGNVVKQGDGVLTLSGTNSYSGGTTIADGTLQGTTSSLQGNILDNAVLVFDQAGDGTFAGNIAGSGTLIKNGTGAVTLDGVNSYLGGTTINAGTLIGDTDSLQGNILNNAALVFLQDANGTYAGTLSGTGTLVKDGTGTLLVTANSGGFTGPTTVSGGTLSVGNPANPGAALGGPVTVGPGGTLTGSGTIGGLNLSGTLLSGGDSGSITVGGNATFNPGSTWQVTPGSTGTVTPVTVGGTAVVAPGSTLQLVRAPDLPLFVDIPLINAGGGLSGQFTNITSDYAFIDPNVSVSAGGLSVSFGRNTVSMVDIAVTPNEQASAAAVDGLPTTSPILQAVLRLPDAPEAVRTAFASLSGESHATTATAMLDSRFLMSGISSHLRGDSQDTRVGDTTVWIAGRSRPNRIDGDSTANSVRREDDGVMAGAERRIGERSLIGVAVGNQDLESWSRANDDRADIDATHVGVYAQADWSAFTLQGGVDYADYRVDSTRRVILPGVMEERLSSEYDATATTVSLEAAWNLHAGTAVYSPFVAAAYTHLKTDGFSERGGIAGLSVDSAKDEYTTSTVGVRGRWELGHQAGLYASVGWRHAYGDRQVQRSAGFIGAGTSFSVHSVTLAKNAVVGEVGVSLITSPSSRMALSLQGLNGDGQTAYGGQVTWGWSF

SEQ ID NO: 18079 - protein, 802 aa, Xanthomonas campestris
MWARSWTLPALLLAWASPAAAQSEPPQDAAAVAPEPSQVQDAAAVPEAPQAQDTVVVPEAPQAQDTAAEEAQQAEPAQAPVGDAPLAIEPPAGEPLVLEPSPEAVEKRFESVVVGTSEARTSGSIHVLKPAQLERFERDDPAAILQTVPGVYSRGEDGFGLRPNVGLRGVNPDRSKKVTLLEDGVLFGPAPYSAPAAYYFPLATRMQSIRVLKGPSAIQQGPQTVGGSVEFITRDIPASESAWLDVAGGEYLYGKAHGVFGASTERAGFLLEGVHLRSDGFKELDTVGGNTGFTRNEWMAKGSYLLVPEGPVRQTLQLKLGYSDEDSNETYLGLSSADFAAAPLRRYVASALDHMKWHRTQVVLSHELEAGGLAVTTSVYRHDLSRVWRKVNRFRGASIASVLADPASARNSIYYGVLTGELDTSSSQDALLIGPNDRTYVSQGLQSIARWTATTGPLSHNLELGARFHYDSIRRLHTEDAFLMQGGQLVWTSEPTYTTADNKDSTHALALHATDAIGWGPLVLTPGVRMEIIRSASRNHMTGTESSGALEVLMPGMGIYGALTRELGLFAGAYRGFSPPAPGQPDAVLPEKSINYEAGARWTRRGERLEAVGFFNDYSNLTDICTFSSGCLNDALDRQTDAGKAYIYGLEVFGEKTFRPGGGVTFPVSLSYTFTRTRLREDFQSADPQFGNVRAGDELPYVPQHQLYATAGVETSWGGLALSAFYVDAMREQAGQGEVSPELLTDALLTFDVNASWNFSRWGQLYLSARNILDEQAVVSRRPYGARPNAPRAVIVGVKLGI

SEQ ID NO: 18080 - protein, 973 aa, Xanthomonas campestris
MDPLFSEPPAGKTTLGSTQDHLERELMNCKSNKLRDAVVLALVVGVGGTGTAIAQEAGTTNLDKIEVTGSRIKRADVESSQPVFSMSREDIQAQGLTSIGDVLQNLTANGSALNSTYNNGGNGETRVSLRNLGSNRTLVLVNGRRWVAGTGLGGATDLNTIPTAAIERVEVLKDGASSIYGSDAIAGVVNIILRKDFDGAEANAYFGQYSQGDGSRESYDITIGSSGERFRTLFGAAYVKEEPVSAGDREISAVPIYKTGTAFGSTTSPNGRFALCNGTFSPGACSGTQTRPNGTTGQFGYDAGSTPANWRNWGTGADDVYNFAPDNYLVTPQERKSIFGQASFDITDKVRFTTQATYNNRQSEQLLAAMPIVLGTGPGAGVQAQTVSISANSVYNPFGRDVSRVQRRAQETGGRSFKQNVDTFGFVGALEGSFEVGDRYFSWDAGMSYGRNDQNDTTTGLFNVLALRNALGPSFIDAGGVARCGTAASVITGCVPLNLLGGEGSITPEMLSYSSFVAHDEYQYKMKQYFANFSGDIVDLPGGMLAFAAGVEHRTESGYDSPDALIASGNTTGNARTPTSGSYSLDEAYLEISIPLLKDLPGARTLEFDIASRYSDYNTFGDTTNSKFGFKWKPIEDLLVRGNWAQGFRAPSINELYAGVADSFEQISDPCSTTFGGGYAGLNATQRARCTAQGVPAGGYDQGNAQIRISTGGNPNLQPETSTSKTLGLVWSPSFFEGFDVSLDWWQIKLENTVTSFSGQRILDDCVRDGVAQACGLFTRAADGSIADLLSAGLNIGSTVVEGYDMTLNYRLPAQAWGSLSFNWDTTYFAKYEDNNDGNNLVGEYFDRNNNWRIRSNLMTRWELGDFGATWLVRYFSKQDEPCPFSDNDYGFGQLCSNFNADDSDRSYNRIGATVYNDVSFYWSAPWNARITLGLNNAFDRNPPVSYTTFANSFDPQYEVPGRFLYMQYRQKF

SEQ ID NO: 18081 - protein, 989 aa, Xanthomonas campestris
MMNLRTSAVRLGLLPAGIAIALTPAFAANAQEQSAPSTTTLDRIAITGSRIRSVDVETAQPVFTVTQQDIQKSGLVSVGDILQNLSIAGTQTYSKAAVLSSAPEQGGQYVNLYNLNENRTLLLVNGKRWTSSLAGLSDMSTIPSSLIERIEVLKDGASAIYGSDAVAGVVNIILRKNYDGAEASAYFGQNGRGDGSKAQYSFTAGTTTDRASLVFGVNYTNEDPVWAKARPLTRYSSGPNHIEDSLSATGPWGRFNDPRAVGTPGAGNYRDTDGKVVDAADGTWRPNQWVLNHTGSFDGKGTGADSRSLSNYHIGAGVDDYYNSVDQMMLQQSSKNKSVFTTGSYNLTDSLTFKSTAMYSERDSNRQIAGYPLQAVSQPQFPVAISGSSYYNPMGQDINRWFRRTVELPRTTENNVKTLHFDAALEGVFDVGSHGWNWDVGFNYNKYDVTQVLRGNINLLALQKALGPSFLNAQGQVQCGTAASPLPLGTSNALGQCTPFNILGGPSASTPNALQYINALGQATQQSLSKQWTANLTGGLFDLPAGELGFAAGVEHRQVSGYDYPDQLSSAGYTTDLAAQATEGRYQTNEAYLELLIPVLKDLPGVKELSFDVAARYSNYSRFGDTTNSKFSFTWKPIDDLLVRGTYGTGFRAPTLSDTFGGGSQTFDNFTDPCDATFGSLGNAGVAARCATQVPADFRQTDSAGKPVARRDVQGNAPFNSGVGNAELQPEYSITRTVGMVYSPHWVQGLDFSLDWYRISISNIITPLSANDVLNNCYLNNLENYCANFARDSVTGQVTTLSRGNVNLGRLETEGYNFGVRYRMPETAYGKFAVKLDTNYLATYKSQTQADADWANYAGYWNFPRVRATSGLDWSLGSLSANWDLRYYGGFRDYCLDASAGIACNDPSYRTPNPGWGGGTGSNKKGSISYQDVSVTWQAPWDGSVTVGARNIWNKQPPITYSITNSSTAAIDPMLDYDRFLFVQYNQRF

SEQ ID NO: 18082 - protein, 143 aa, Xanthomonas campestris
MINDIKWVQAQRKATDWRQAVEIATRPLVAYGAAQPCYVNGIIENTLNWGPYYLIAPGIALPHARPEQGANYNQVSITTLRTPVAFGNEECDPVWLLLCVSATDANAHILTIQRISQFIDSPQRLTAVGNASTDDALFALVSG

SEQ ID NO: 18083 - protein, 999 aa, Xanthomonas campestris
MREPRTLPRTRRLTSALLFALSAPLAAQTAPAPQSASTVPGSSQADPATLDTVQVSGIRGSLTSSMNVKRDAQGIVDGIVAEDIGKFPDTNLAESLQRISGVSIDRSLGEGSRVTVRGVGPDFNLVLLNGRQMPGASIEESNASNSRAFDFANLASESISGIEVFKTSRASTPTGGIGATINIKTARPLDNPGMHANVGLKGVHDASNENLPGRLQGDALTPEISGIFSTTSADGRFGVSLSGSYQERDFGYSQVGVPNGWRSFRGDSTAYGTIPQPGAPGSENITNRPGPNDIYSVPQNLNYRVVGVERQRTNGQLVLQYKPLDNITTTLDYTYSENKIQQQRNEMSVWFNYGPSASAWTNGPVAGPVTYSEIVNPATSDLATAGSNAATRNQNKSLGFNVDWAVNDQFKLNFDIHRSTAEAGADSPYGSSNSLGVSGFYRGTSVVDFSKDFPVLQQQLGFGLNGLDPSRTLVTGSAFRNSYMKSEIDQAQVNGDFTFENYSQLKFGIGSTEVKNRSAFSNVQRDTWGGNGTAADYPDDLWIPSSFAQYFDAIDGSGNPPQFNQLFLFDFERARQAAAQVAGDDALYRISPVFTTDRRVTEKSKNAYLQWNNSWDDLRVPISLAAGVRYEETKVDAQALVPVAVGIDWVANNELPIRVSNSAFASGSGKYEYWLPSLDLSFKLTDDLVLRASYGETIGRPGWGDIQGGQTLSEIARVEGGTGQEGNPGLKPLLSHNIDFSLEWYYSDASYASVGFFRKNIDNYIGVTTRNDTSLGLNTPIGGAYWNEALGNGCASADLTCIRNYIFRNRGGAPGVVRGADATGVISGQPGDPVANFAITAPANQRSASLDGWEFNLQHMFGDSGFGVSANYTMVDSGLTYDNYVIGEQFALEGLSDSANVVGFYDRDKWQVRAAYNWRDEFLAARFDGSGQPNPVYTEAYGQLDLSIGYQWTENLSLSLEAINLTDEVQRQHGRQSNQIVYATQTGPRYMLGVRYKFW

SEQ ID NO: 18084 - protein, 1115 aa, Xanthomonas campestris
MKRLSCRLPQPYTYALAMLAIHVVICSTAPYAWSQTVSGDLVGRVLDAAGSAVPNATITATNTGTNVNTKGTTNTSGEYRIGNLPPGNYDISAAANGFAKATLKNVAVQLNQIATANLTLQVGTVTTSVEVTEAPAVIDTTTAQVQNTFSSKASEDLPTTSNGFGVLNLSMLNAGVTSAGGIGVGIGTGPSVGGQRPRSNNFTVEGIDNNEKSTTGPEASIPNDAVAEFSVLQNQFTAEYGHSAGGQFNTVVKSGTNSVHGTVYEYMQNRDLNALDQHLAQQGILSNPRFDQNRLGATIGGPIIKDKWFYFGDFEYNPVGQAATAAGQLLTPTTQGYSILNGIPGLNATNLSILQKYVPASPAASSTISIGSTNVPVGVLPIAAPNFQNNYNGVASMDFNASDKDQIRGRFVFNHISFIDTTANLPVFYTTVPEKAYLATFTEYHTFSPRLTNEFRLGFNRLFQDFPSGNFSFPGLDQFPNLTFDELSLQLGPDPNAPQSQSQNTYQLTDNITWIKGNHTFKVGQDFRRYIAPQSFTQRLRGDYEYSTLELYLRDIAPDVFGERTLGQPRYYGNQTASYTYAQDTWRIRPNLSLNLGVRYEFTGEPWSASTQTLNSAASVPNVLEFNKPKTQTNAFAPRIGIAYSPGTSGNTSIRAGFGMSYDVLFDNIAILSLPPQLTTTADITNSQFSNLVGVPGFLANGGFGPNLSVSGQLTPQQARENTSGYITNQVLPYAIQWNFGIQHVFAKDYTFEARYLGTRGVHLPMQQQINRSSPVTGTNQIPTYMSAPGTAALAGLPLTVGDLRNMGNVLPQFGAAGFTSAITAYTSQGWSTYNGLALQANRRFTRGLQVQAAYTWSHLIDNSTTEFGATYLTPRRAQDFQNLTADKATSLLDRRQRFSFSAIYDAPWYRTNRSWFLKNLVGNWEIAPIYIYETPEYYTVQSGIDSNFNGDAAGDRVMVNPNGTAHTGSDIYGLDRSGNRIAVTAPAAQVNQVVAWVAVNPNARYIRAGYGTVPNAGRNTEAMQPINNIDLTLLKRFNITERLHLELSGQALNLFNHPQYIAGTPDAAQLPNNYSIYTPGVRSFVTVNSPTFNNSVATFSSNPRTMVLVGKITW

SEQ ID NO: 18085 - protein, 794 aa, Xanthomonas campestris
MSGAKAPRSLRAEASLRTYNDQLDSYYGRKVSAVAGMIAVASIGGAEAQQSSLPAVTVDAPVARPRPVAAQPTPDQIRARTALRRAARRAQPAQVAPVPFPNAGVLSADRNPYADADAPYKVDRLSGSKFTEPVLNTPRTVTVLSKEILQDKNATSLRDVARSTAGVTLGTGEGGNAFGDRFFIRGFDARNDVFIDGIRDPAVSIRENFFTEQVEILRGPASTLAGRGTAGGAINIVTKQASTEGNFTKAETTFGTDATRRVTVDVNQVISPTLAVRFDGLYQQANVAGRNYVFDDRWGTLGAIKWTPTDAIKITANYVHTDLNGLPDFGVPYNTALRRPSTSVNVPRNTYYGFVNRDFQKAQQDFGTLTGEFNITPDITLSNRTRAARSVLDYIGTLPSNPTATTVSLASQSRYQVTDVLANQTDLTYKFDTGPIKHALITGAEVSQEKVMRDNYAGLSSELAGFQTGGRITVPLLAPPNLFEFSSAPQRAGNPTNITVDTKSVYAIETANYNDFIIVNGGIRYDDYDIRGVSSTASSGVQSGMFNYNAGVVVKPLPYASLYSAYATSSNPVGAELDASGSAYGGLVVSNAVFQALTPEQNKAVEVGTKWELFNRHLLLTGSLFQTDKTNARETSGSTIIGGAAYRVRGIDLEVAGKITDRWSVFGGLVLMESQVLQSIDAAQVGAQLANIAHQSFNLLTKYKFDDHWEVGGQATYASKIYGGTFGAINGNVLPEHWRFDSFVEFKVDRHLTAKLSVNNILNTTYYDAFYRSASPFVFIAPGRSVLLTLRGAL

SEQ ID NO: 18086 - protein, 884 aa, Xanthomonas campestris
MRTFAVARLSRTGLSLSISALLASGAAMAQSTTTDAAGGTSSSSAAAIAPKQLDQVVVRGEYIPEPMLQTSEVASFVTREDMERTGDSSAAVALTRVTGLSLSRGKYVYVRGLGERYSSALFNGSPLPSPEPMQRVVPLDLFPSDVLQSVTVQKTYSADYPGEFGGGVIDLQSMAVPEKPFFSLTVGGGANSVSTGEKGLTYYGSGDDEWGFDDGARKQPGALRDAIATGRRVDLGSFSREDIRRIGRSMNNANLYVLQEKDSIDPDVNVGASAGYSMDIGEAKLGILAVASYDNEWRTRTGKQQDGIFTGDTVEFNSNYDFATTRNNVRSNGMLGLGWEYGRHTIGWTTLYVHDTLKVARSRAGRDELAGFDVRDDNTEWYARQLINNQLRGTHAFGEYDDLKIEWRAALANASRDVPYETGIRYELLDGYWAHDASRVQNYTRFSKVDDKVASGGVDVTWRLPIEHDLTVKGGLAYLDNDRTAWNREFRFLALDGPLPFYNQYQRVDYLISDYNLSNDFLRLRETTGSFGAAAYDATLKVKAAYLQMEGEIVPTLRATVGVRYEDATQAVHPYDIFSGARQDSVAPLENSYALPSATVTWNFAENQQLRFGASKTIARPQFREMAPQQYLDPDIDRQFFGNPFLVDSELVNLDARYEWFFEPGEYVTAGLFYKQIDKPIEAIVNDAPGGGIVQSFINAPEATLYGIELEAKKYLDLPIAANWWGDNRMFVSGNYTRTKSEVSASDGDTVQPFGFAAPVQATLFVRDGSTLQGQSDDIANLQIGVESESTNSQATLIANYVGERISARGRPGQPDYIDKPGTQLDLVIKKGLVWSGNKLSLNFAARNLLKTKYQEYQSRGGNRVDLYEYQPGITYDISVTARF

SEQ ID NO: 18087 - protein, 545 aa, Xanthomonas campestris
MAAGHPDNPYNGPARVRYAAFDVGPRVKENTNDFMRVVLGIKGSVASWDYDVSALHSQSQMDRKFTGYLRYSSVRCVLGNLACPAGVWNIGNGSETNPRSLYDFISPVLSAQAKTKLDVFDARVSRALADLSGGAMGLAMGVEYRRDQASLTPVTYTDIGDIIGVGYSAYGGEEKVSAAYAELAAPFTKAFEATVAGRVDHYSSGNTAITPKLGMKWKPFEWFALRGTYAQGFRAPNVAESGKVGKVGGLAAFANVSDPVRCAATGGSGAECAPRFVSVITSPNPDLKPEKSNSYTLGMVFQPTSSTSMTVDGWQIKRTKEIAQIGTVDAINAGDVIRDDNLLKGVAGTGQLLGVKAKYVNLNATTARGVDTDVQQRIAMGGLGDLILDLQWSRMLKFQREDANGNISEYAGTHGNCDVSNCIGTPKDRINFGATWKLNNISVSALGHYRSPMENRLFKGGACVSHFADGSDAPIDCRLNAFTSVDLSANWQATEALAVFGSVQNLFDRIAPLDPLTGGALNYNPLDSAGAVGRFFTVGARYAFK

SEQ ID NO: 18088 - protein, 754 aa, Xanthomonas campestris
MRVPSPSLPSVSMPVALLRSVRAHSRLLLALQCAGALCATAAHAQDNAPAPTANTLDQVLVTGRTEGYQVRGTNTATKLPLTLRETPQSLTVFTRQRIEDFNLITIAEVLQQTPGVTVQSYDSNRTLFAARGFAINNFMFDGVPTNYTTGAGGNSILSDTSIYERIEVVRGASGLVTGSGNPSATVNMVRKRPTTAFQASTSLNVGSWDYRRAELDVAGPLTSGGRVRGRVVGAYTEKDSWVRFQQDRSPSVYGVLEADLTDSTRLRAGIDHLATHSDGGAWSAAPLFFSDGTPARLPRSYSAAARWNRWERESSNVFATLEQQFAGGWSGRLAYNHRATDTDSLLFAGSNSASFADARTGLGLRVSDTYGVSETRENALDLYASGPFQWLGRAHELVVGANHYDRDLSTLRTAITARPYSLTAFPSIFDWNGDVGRPTTTNAGIPSSITNTQETGYYAAVRLNPTDGLKLIGGGRYSSWNTATGNYSPANQFAGRSADYDANALTPYLGAIYDLSRHLSAFVSYSDVFQAQNLRDRTNQQLDPVVGANLEYGFKGEFFGGALYAALNGFHMQQDNVAEIDPEVAPNSLPDGSSAYRAVSGVETWGGEFEVSGAITPDWSMTGGYTYAYSTDQRGARVFTTSPMHLARFNTTYRFGDWTLGGGISWQSAVYQNQTIPTGRFTAAGAPITRSGRVTQGGYLLVDLMGRYRINEQLSVGVTVTNLFDKVYYRNVGFFNSGYWGEPRRLLFNLRANF

SEQ ID NO: 18089 - protein, 836 aa, Xanthomonas campestris
MPQTVHGFVLLPAMHTTRSKSSFGPRPVGLLGTVLLALLLGGLSSSPVLAQDEPAGVLTGRVVDAASDAPLQDATVALWENTGGDSTLVRGTVTGPEGRFTIEDVALGAYTLRISFVGYTTERRPNTQPAPSPDEADLGTIRLGRTTTQQQEVEVTADRPAARIETDRNVYNTSERALSAGGSARTVLEDLPSIRIDMDGSISFRGNESVSLQINGEPASLQGQSLVSYLESLSADAVDRVEVIPNPSAKYEPEGMSGIINIVLSRDLEAKWNGGLTLGGERDANDRYGGNGSANVGFQAGGWRVVGTYSHRRDGEEDTDTRIVERLNGGGPSTWVDQNGREEEQDRSHSFRTDVDYSVAEGTSLGLETSVSLRRGDENGRSAYREYTGGAPTAENVTDRYVRRLDNSSSEESVDGRLDFNHDFAQDHSLSAQVRYDRDLEGEDGTYNIYGFENGARLSTPRDQEIDVVNEDEQDGSLKVDYARPLGSFSLETGYKGTLRRLDSDQTYEDRTTVFTFDELIHAAYGTVSRGIGDFQLEAGLRAEAVTTTFDLSSEDEVTNSSYVSLYPSAFLTYKPSPRRQARLSYSKRVDRPGLWDINPIEDNENPTFQERGNPGLAPEYIHSFELSLTQRWGIGSVSVTPYLRHTVNEIEEVRFEEDINGRTVIVRQAQNLSTSTSYGTELVTTFNAGDRLEGTLSGNLYRSVTDGSNVTTDLSQDAILFSGRGSVRAKLRDGLQLELSQFYRPARDIPPQGRIDRFASTELALQQELLGGDGTLTLRVDDLLNDTNMTMWYRDQDLYQESNMQWGAREVSLSFQYSFGSGSNDDRGRRDRDYR

SEQ ID NO: 18090 - protein, 880 aa, Xanthomonas campestris
MHRSLHTDPPLGAALLLALQLAPSSAAAAEGQAPVDPPTVQLQRIEVTGSAIRRVDAETAVPISVLRAEELRQQGVTSTEELIGRLSGNQGVYNSSRSVGSATGGASFADLRGIGANKTLVLLNGRRLANNAIDGSAVDLNTIPFAAIDRVEVLRDGASALYGTDAIGGVINFITRKSLNEGRVDSGYASPTQDGGGNQRNVSASWGFGELEEDRFNVFAVANYDKQERLGAKDRGYTYNYQPGRGLDYSSGTAFPGNWSQGANASNPLAAGGCKGADLIPRNGICRQSLWRYLDLVPETEKTSVFSRATGKLADEHNVSLEYFWSRNDNATQVGPGTLTGLQIDPGTAFYPGNGITPGPGGFVLDPSRPVEVNWRQSVLGPRLQSSQNTGQRLLLGFDGQFAGWDYDIGASYNQNKVVDHIHSGYVDDRAAALGIANGTLNPFGPQTDAGLAYLGSHALSGDFRTSVGRVKGLDARASREIGDWFGAGPAALALGGEFRKEAFHQDIQDFAGNVQSLGVDPAATVSGERNLKAQYAELNVPVLDSLELSAAIRHDKYSDFGSTTNPKYSFRFQPFRQLVLRGAYSEGFRAPSLYELYNPTFTTYTSANYDDPRLCAGGQPSQGGIANRDCAQQFYNATGGNTDLRPETARNVTLGLVYQPLRDLSVGLDFWWIRIANQIAEFPEAAIFADPQAYAGRIVRKADGSIDHVVTGLANLGKVKTSGVDLSLDYRFPASRYGQFGLDLQGTYVSRYDFQQQIGGQYLDNVGDFQGVGVIARWKHVANATWSRDAWQATLSNRYTSGYNDYDRASHGRVGSWNLWDLAGSYRLSHALGLTLGVKNLFDREPPFSNQTYTFQSGYDPRYTDPYGRILFGRLSYSF

SEQ ID NO: 18091 - protein, 873 aa, Xanthomonas campestris
MCMLRSRTLAVTGMLSTSLAVALPAFAEDREANSSTLVDKEFEVITVGSRFGGRSMLQSPTPVDLITREEMERNGRVDLLQMLKVEVPSFNIPRPIASGAGDYLMPPSLRGLGPGEVLVLINGKRRHTSADLNSSNGVGRGDISIDFNAIPSLALSRVEVLRDGAAAQYGSDAISGVINLTLDRSLETVAHATYLATSKGDGQTHEVAAATGFPIGREGVVRLTAAVQDIAASNRARPDTRQQYFGANAAGAPVMPSGNYGSGTGLTAPNGRLDPLEAGFDRDVFFQGTQPSTNRQLFYNLVTPLSDAVEFYSFGGHSRLDGDITYFFRRAGQDETVRAIYPDGYSPMLDTRIDNTSVALGLRGHALAGFGWDLSTVYGRNTQDLFYANSVNVSLGAGSPTRFYRSGADFDQWTTNLDLNRELALGSFSPLRLALGAEHRYEQYRLLSGAEAGYINGGVPILDGPNAGRPAIPGSQPGPSNGPDDNALLDRNSQAIYVEVEQSPSDRLLLSAAARHERYSDFGNTTNVKIASRFQLSEQWALRGSYNTGFRAPALAQSGYNASNTLILNGAQAIVRVAAVGTEAAQLAGATDLKPETSNNISLGTVFQEGNWSASLDAYQIKVRDRIAISSTFQDPHLTNYLAANGQSGFAAISFLTNAVDTVTRGMDLVINYRRQFELGGALTGTFAGNYNTTDFDRIAGTPAPIAALGITTPLFDLTQQLRYSDSQPRDKLMLNLNYTHGRFSANLTNTRYGQVSSVALTGKNAAQVAVLTPGYDTRLVPASATTYDIIQTFSPKIITDLELSAQVTPALRVSIGAQNLLDVYPDENIASTAASVAVGTNGSDNAGTHPYNATSPFGFTGRALFMRAGLTF

SEQ ID NO: 18092 - protein, 479 aa, Xanthomonas campestris
MKKRNLATVLCALSATASGSTLAADLELYVDRKTKQIFAEPAPGRDKLGKFVQVDESGKLPASALPEAPAAPVPATAPSTGVAQAAPPAPASTPVPTAASDAPKKWYDKLSLRGYTQIRYNQGIGGDAQDLRAPGDRFIGNDQSLGIRRARLVLSGDLNEHVSLYFQPDFASTPTGSTTSNFAQLRDAYADIFFDKKREYRVRVGQSKMPYGWENLQSSQNRLTLDRADALNSGLRDERDIGAVFYYSPTVAKGRFQDLVKSGLKGSGDYGVLGAGVYNGQGANRAERNDGMHAVVHATYPFKFANGQYLEVGADAYAGKFVPTAAAVNIGGRSFTPTITEPNGYTDQRVAAHIIYYPQPFGLQAEWTVGRGPELDVAQRRIRTRSLSGGYVQAMFKHDFNYGTLLPYLKWQTYRGGSKFDTNAPRMRLDEVEAGVEWQPMDALELVFAYSKMKRTDVTTAPYPVVEGDLLRLQLQVNY

SEQ ID NO: 18093 - protein, 1152 aa, Xanthomonas campestris
MPALYASSSRLVLSLFLVGMAAPALAASFTVPPAAGQQSVSGSDTGTIDEGATLAGGGSSAIQWSAAATANPGVVIINNGTITSNTRTIDTASNVTGAFTLTNNGSIISKDDAFRINGALANGTVTITNSGTISSQTGQGFDFDKATATTAKVSVDNSGTISSAGSDAIRLGGGTIDITNSGTIETTSSGKRAIKFDTAANFDTLQSFTLTNKLGGVVAGTDDGIKISSTVGSTAAPVIKIDNAGTIKSTIDGQGIDLGGIYSTAATITITNRSTGLITAADNDGIQGTNGLTIDNYGTISSYYAAGTADTQNNSAIKVDGDDIAKAITITVNNYEGGLISGAYHGIKGSGASDTLIVTNSGTIEGRNGSGVNSNGTGTLTNYGTITGTYDPAASFGDGDGVDFDHAGTVYNYGTIKGLGSKGIKPGEEKPSTSEGIAIGGGTIVNGDATHTSALISGANNGILADDSNSGDAYAAMSVTNYGTIQGLDGYGIRYVNSGVDSSKSLTIVNYGTISGTTYAVEMGGGNDLFVYHTGSKVTGIVDAEGGTDTLQLGALGDNVTFDASLIGDAATYRHFERVTAEAQTQTTLTGTSTFAGDLVFDQSALALDNASLAKASLILSGNETNAGVLTGNGTLGSLAASGTVFLSPGTSAAPYGTLAVTGNATLAGTYLVDVAQNGKTDLITVGGTATIAEGAQVAMYGALAWSRIYTIVSSDTQVSGTFAGLTVANPINYLFVTPELSYDDTRVTLALERTGVAFASYALTRNQLSVAGALERIGGSDKARSSTLYGDFATQVAGDNPSLALAQLSGDIHATLPGQIATENMLVNDLILGRLRQADYAGAKGSTAALGAGGPARAYAEPSSPGASAFKAIKAPTDAPVWTGWAQGYGQWLSTDSNGNAAAADTNLGGVLLGGDVSLANTVFGLAAGYSSASTSTDFASADTETWRIAAYGGARFDAIKLRAGASYGWSSIDTSRFVALTGEAPRASYDGTAGNLFAEAGYTVALGGVAFEPFAGIGWTSVNLGSFAETNAPVAGLASEGTSFDTAYTTLGLRLATTFAVGSGIAVTPHASAGWRHAFGDVVPEAAVAFVNTGTVFGVEGLPIAQDSLVGSLGIDLAFATGVTLTLAYDGMAGDGASYNAGKAALAVKF

SEQ ID NO: 18094 - protein, 247 aa, Xanthomonas campestris
MARTPEAATCRSRYWQFHTMPPYLCPVAATSILSSSVVHAAKGDQTLSIGYAQMNSDPSKAAYSANKTEYESRLKTTGNVFAQHADSDKQPQGMFIRYRYKLDDTWGVMGAITYAVGDMDNHFLSGEKAKNKKDANKIEKRFSNRVKTDYVSLLAGPTLRANEWVSAFGLLGVALHSVENSLYETDKTSIPPKQVSRNEKSSNTSLAYALGLQFNVYKGLVIDAAWAGSGSGDWKSSGFNLGVGYQF

SEQ ID NO: 18095 - protein, 433 aa, Xanthomonas campestris
MRPPFPLLNPCPLLGLGAAVLCAGFAPLANAAGFFEDSSAKLESRTIYFNRDFRDGHTSTDQGASKREESAQGFILNLQSGYTEGTVGFGLDALGMLGIKLDSSPDRSNSGLLPSSGHDPRGSADQYAKLGLTAKVRVSQTVFKYGAQLPDLPLLKYNDGRLLPTMFNGAVLTSREVKDLTLTAARLNRYTARDSSDAQDIRVHCKNKRYACNTTADHFDTYGVDYKFNDRLTGQYHYAELEDIYRQHFVGLLANQPLGPGVLKGDLRLLKSADTGAERAGGIDNRALSSMLGYSVAGHVFSAGWQRMYGDNSMPYLDGSNPYLVNYVQVNDFAAIQERSWQLRYDYDFKAIGLNGLSFLTRYVSGDHIKVPGSLREGREWERDSELKYVVQSGTFKDVSLRLRNATYRSNYQKIARDMDETRLIVSYNFSLL

SEQ ID NO: 18096 - protein, 765 aa, Xanthomonas campestris
MQARKVIAPSRASGSFATGNVRIFRSALQDRHKVWAILCTLSATCPGAGFAHPQPQPPAEALPESESPSEIRVQPATPAESTAKAKSRARSKTDDDDENDPQVIEEPVSLETVEVVGRETDLIGLTQSASQGVVGQNQFKYRPLLRVGELVEVVPGMLATQHSGTGKANQYFLRGFNLDHGTDFATWVDGVPMNLPTNAHGQGYMDLNSIIPELVDRVEYGKGPYYAEMGDFSAAGYAYMHTKHRLPQGFVNFTGGEFNYYRTVAANSNELGPGDLLYAASVNFYDGPWQRPMDLNQFNGMVRYTIDKEDWGLSVIAKGYNSRWYATNQIPEALVLENQLDLYGTMNRSDGGNTNRYSLSTNLWNRGESSKSEVNLYLAYYDLDLYSDFTYFLEHPQQGDQILQGEHRWYYGGTASQTWFNNLFGTNMENSVGLQIRHDQIGGLELANTQWRKVFNIVSRDNVSETSIGMYFKNETFWMEKFKTIAGLRNDIFVFNVDSQLTPLNSGNRNSSMVSPKLSMVFGPWADTEFFINLGYGFHSNDARGAVESVNPNNGDPVHAVTPMVRSKGAEIGARTQYIPGLNSTLAFWFLHTASELVFTGDAGTTEPTGPGNRYGVEWANYYQATDWLTLDADLAFTKSYYTDLPSGDNSIPNSVGNVITSGATVQMPYGFWSTLRLRHFSNVPLNEAGTVFLGDTTLVNFGLGWQEENVKLQLDLFNIFDSRANDIAYYYQYRLQNQPPEGVEGKTIHPVEPRMLRGSITISF

SEQ ID NO: 18097 - protein, 371 aa, Xanthomonas campestris
MQFQKTLSSLSLFLSLSLFLSFSIAEENGAYASVGFEYSISHAVEHNNPFLNQERIQTISNAQNKIYKLNQVKNEITNMPNTFNYINNALKNNAKLTPTEKQAETYYLQSTLQNIEKIVMLSGGVASNPKLAQALEKMQEPITNPLELVENLKNLELQFSQSQNSMLSSLSSQIAQISNSLNALDPSSYSKNVSSMYGVGLSVGYKHFFTKKKNQGFRYYLFYDYGYTNFGFVGNGFDGLGKMNNHLYGLGIDYLFNFIDNAQKHSSVGFYVGFALAGSSWVGSGLGMWVSQMDFINNYLTDYRAKMHTSFFQIPLNFGVRVNVDRHNGFEMGLKIPLAVNSFYETHGKGLNASLFFKRLVMFNVSYVYSF

SEQ ID NO: 18098 - protein, 727 aa, Xanthomonas campestris
MLRSVRNDAATVRMRDTSAMPRLTLLAAACGLFVASASSLALAADAAPPIAALPAVQVDAARVHGVDDFDLPASFTVVVADDDNRRGAQVSELLDGIPGLVARDRQNYAQDTQLSIRGFGARSTFGVRGVRLLVDGIPASMPDGQGQLSHFNVLGAQRVEVLRGPFSALYGNSSGGVLQLWSADGKPGDPWRLRATYGSNATVNTGAQLLGQQGAVHYNLAANHFETDGFRDHSRAKRESVNAKLGFDLAPGSRLDLVLNYLDAPDAQDPLGLTRAQVNADPRQATAVATQFNTRKSVRQSQAGAIFTQQFDTQTLRLMAYGGQRSVEQFLAIPVAVQRNPLHSGGVIDLDSNYEGADVRWAWQGQALGRPLQLTVGANVDRQRQHRTGYENFVGTTLGVKGALRRNQRDQVENVDQFAQAWWQWSDRWSALLGVRHSAVRFRSDDNYIVGRNPDDSGQRDYSATTPVAGIVFRASDDLRVYASVGRGFETPTFNELGYRSDGGAGLALDLGAAKSRNVEVGTKWRSQSGAALELALFRADTDDELAVASNTNGRSTFRNIGATRRQGAELSWQQPIGQTQQVQLAYTFVDATVRDGYLTCASSGCATPTAPVASGARLPGVPRQQLFARWQWQPLQWQFAAESVVSDATVVNDLATERAAGYALVNLEASRRWTTTHGALRTFARIDNALDRAYVGSVIVNDGNGRYYEPGPDRTYTVGLQWDFGS

SEQ ID NO: 18099 - protein, 562 aa, Xanthomonas campestris
MRLFASTTAMLILAATTAAAADLPRLPLSPAAPVQWSWTGLYWGAHLGGSFGQTSFSDPAGPGLYGGQVRSPAALAGIQLGYNYQPNRNWLIGVEADVSAMNGNGTQSCLVSSGLFISANCRVRQDALATLTGRAGFVTGPGGRTLLYAKAGAAFLSERLDITIGNPIGSSTESTDGRWGWTAGAGIERALAPAWSVKFEYDYANFGSRDMATPSSYRLVPGVDYFATPQGVSKVSQDLHAVKVGLNLKFGGDVDARFDDYHLRGTQAADDRVERGAVEVGGRVWYSSGRFQKDLGATVNQGQQNILISRLTYQSTAASGEMFGRVDGPYDTFLKGFAGGGTLVSGNMHDEDWIANDGIPYSNTLHDPVKGSIAYATLDVGYNLLRGSDYKFGGFVGYNYYRENKSAYGCVQTAGATASQICGSPISNAVLAMTENDTWHSLRVGFNGELGLGRGSKLSADAAYLPYVKMFGTDNHVMRTDVTDTVSPEQGTGQGVQLEAILSYQVTNAFSVGAGARYWAMWATTNAYTNIFGSECPCQTLPTRTERYGTFLQAAYKFDAPR

SEQ ID NO: 18100 - protein, 446 aa, Xanthomonas campestris
MSTASTLSRATLLAVGIAGVLAVGQAHGAAFQLKENSAKGLGRAFAGSGSAPDDASIIANNPAGMRQLDGRLFQADVSAISFSAKFQPDTAAYANGAPVSGGNGGDAGMIAPVPAMYFHVPFGENDNMHLGTSLTVPFGFKTEYDRDWVGRYHGTKTELQAIDFNVAFSYDVNPYVSFGASVFAERLDIDLANAVDFGSVLAARRVPGFAPGSADGYSRIKGDSTEVGFTLGGLFSIDENTHIGFSYRSQVEHKITDGTADFTVPGSAAAVLGVAAPGTFVDTKGRATVKLPASATASFTHNVNEQWSIMADVTRTAWSKFDQVTVDFASNQPDSVLDFSYRDTTFASIGADYRMSDTVTLRGGLAYDQTPTTAEHRDVRVPDASRKWVSLGMSWRPSAQTEYNFGYTHLFTSDPTSDTRSATGDRLAGSYDVKGDVLAASINYKF

SEQ ID NO: 18101 - protein, 862 aa, Burkholderia mallei
MRSDYQHLCSSKMLKRSKIAQAVLFAISIAPITLQAEEAEPPSADTDSSSLEVITVTAQKRVQNIMKVPVTVGTVSESTIKESSSILLSDLDKFIPGFDFSDANMTQGGVTMRGISSPNISVGGDPSSAVFFDDVYMPRAAQNVIFSDMERIEVLKGPQGTLFGRNAAMGVVNMVPKKPISDLEGFVKGSYGTDNLQRYEGMINVPLSETFFIRANFLANAQDGIVENVADPSWNQNSKIWDLGERDHKAARLSMLWKIADSTNLQLSYDWDDLEQGPPMAIGISEYAYNGGKTPFADKAENDVKNGVEARDMYALTAKLNHDFNNEWSMKYILSYRDWETVNREDEDGTADITRYFDTSNNEDSSIIYSELQLNYIGGRVNAVAGFSYSKEDVNQRTELNLTADTAARMITSELNEQIGGIMSGQLEAMLGGNTDAHAEAAFGPGTTFAGVVDSIYSSSGFPMDHLWNANEWANVLNVLEFPGSPYSPEMVEATGDMTYDAVSMAMGIPEIFGPSFAGQWWQENIYNSGDFTNWGVFADVDYALTDKWNIIGGLRYSKDQKEFSWYIPKTTFAQVREGVSNILFDEVDMSSSDSWDEITGRLVTSYQLTDRHMVFASYSTGYKSGGYDSLQPSTESFAPENTTNYEAGYKGIISDSLIANISAYYLEVDGLQTTVSSQRPDSTTAVPLIINLDKEITGVELDLRWMATDNLTLGVVSEVRATDTYNPEFYNSVGELVPAETRSEDPALNYTLTLDWMPDFGVGTTNLHLDYQFVENTNADEVGLEDYKKAIPEYFKDMKNLSARLSWTDDSESLEIGLWGRNLLDERYMESLGGLAVDYLGTPHGRVNRGLETGIDLQYTF

SEQ ID NO: 18102 - protein, 606 aa, Burkholderia mallei
MSLSVWPLFAYAEPAQPDHSAALRVSMLDPVVVTPTLTSRTTEASLSSVTVIDEKQLRERQPQDMTEMLRGQPGVDITGNGAFGKATSVYLRGTGSSSTLLMVDGVRLRSATAGSPSWQFLPTTLIDRIEIVRGPRGSLYGADAVGGVVQVFTPGARNLSNEQSGWMELGGGSFNSRRVAAGAQGEQDGTRYNVAVDRFDTDGTEIREGSEDRGYDNTSAVARLTHRFDNDAEIGVFGFRAAGSTEFEGSTPEQEKVTDYAMQIAGVKGQLWVTENWLSKLILSDARDDNENFTDGDRDSIFNTRSRAANWQNVFALGDHQLVVGADYLQDLVDSTTLYLEDERENTAGFAQLLLNFGDVDVQASGRYDDNEAYGSETTGGLALGYKLDSHHRLRASYGTAFRAPTFNDLYFPGFGNDQLDPESSKSTEVGARGQYQHWFWDIAAYQTEVDDLIAYALQGGRYAPFNVNRARIRGAEVAVGMEINQWRAGAAFTAQDPEDRDTGLVLQRQSQRSFRFDLDRALGEFSLGGSVVLQGHRYNDADNDVRLSGFGLLDLRAGWNFAPNWSTRLAVKNVLDKEYTTAQNFGGWNYMNAGRSVMLSLRYDR

SEQ ID NO: 18103 - protein, 157 aa, Wolbachia endosymbiont
TGLKKNTADTTDTTDLYTASFIAGGGAFGYKMDDIRADVEGIYSQLNQGTTVTGTSVPAGGIAKNLTAISGLVNVYYDIAIEDMPITPYVGVGVGAAYVSNPLAKKADDDKASGFGVAYQAKAGVSYDVTPEIKLYAGARYFGSYGANFGKAAKNDA

SEQ ID NO: 18104 - protein, 146 aa, Wolbachia endosymbiont
AGKDAAMARLEARWDLKQDLWATSSQSVRLRLGLEVSGGVWNPHGSGGNALGDLGLTPILRLQGAGRSGVFVEAGVGVHVLSRTRLSDDKVFSTAFQFGDRVAVGYRFGDTLDSELALRLQHYSNAGIKEPNPGINFVLLQYSARF

SEQ ID NO: 18105 - protein, 7079 aa, Wolbachia endosymbiont
TGGGTAANASSSMSSVGAAGAGAGSHGVLLQSIGGGGGTGGRVIGSNSATTTSNTSFSLGGGYTSGGDAGGGGSAGSVSLGRASQIADLQIQTQGHNAHAVFLQSLGGGGGAGGSVNNASAEGGNLNASFAIGGTGGGGGNASGVNFYADGTFITKGDTSYGVLLQSIGGGGGQGGSVTSNVAAGTGNKTANSSFTLGAVVGEGAIGGGGGSSGDINGSISGNVATSGAGSIGFFAQSVGGGGGAGGSVTNSASAQGEAKFAASATFGMGGKGGDGGNSGSINFLVPDTLTIVTGGGTAANASSSMGSVGAAGAGAGSHGLLLQSIGGGGGTGGSVIGSNSATTTSNTSFSLGGGYTSGGDAGGGGSAGSVSLGRASQIADLQIQTQGDNAHAVFLQSIGGGGGAGGSVNNASAGGNLNASFAIGGTGGGGGNASGVNFYADGTFITKGDTSYGVLLQSIGGGGGQGGSVTSNVAAGTGNKTANSSFTLGAVVGKGAIGGGGGRSGDINGSISGNVATSGAGSIGFFAQSVGGGGGAGGSVTNSASAQGEAKFAASATFGMGGKGGKGGSSGSINFLVPDTLTIVTGGGTAANASSSMGSVGAAGAGAGSHGLLLQSIGGGGGTGGSVIGSNSATTTSNTSFSLGGGYTSGGDAGGGGSAGSVSLGRASQIADLQIQTQGHNAHAVFLQSLGGGGGAGGSVNNASAEGGNLNASFAIGGTGGGGGNASGVNFYADGTFITKGDTSYGVLLQSIGGGGGQGGSVTSNVAAGTGNKTANSSFTLGAVVGKGAIGGGGGRSGDINGSISGNVATSGAGSIGFFAQSVGGGGGAGGSVTNSASAQGEAKFAASATFGMGGKGGKGGSSGSINFLVPDTLTIVTGGGTAANASSSMGSVGAAGAGAGSHGLLLQSIGGGGGTGGSVIGSNSATTTSNTSFSLGGGYTSGGDGGGGGSAGSVSLGRASQIADLQIQTQGHNAHAVFLQSLGGGGGAGGSVNNASAEGGNLNASFAIGGTGGGGGNASGVNFYADGTFITKGDTSYGVLLQSIGGGGGQGGSVTSNVAAGTGNKTANSSFTLGAVVGEGAIGGGGGRSGDINGSISGNVATSGAGSIGFFAQSVGGGGGAGGSVTNSASAQGEAKFAASATFGMGGKGGDGGNSGSINFLVPKTLTIVTGGGTAANASSSMGSVGAAGAGAGSHGLLLQSIGGGGGTGGSVIGSNSATTTSNTSFSLGGDGSSGGSGGGGGSAGSVSLGRASQIADLQIQTSGDNSNAVFLQSIGGGGGAGGSVNNASAGGNLSASFAIGGQGGDGGAAGVVSAYLDGTFITKGASSYGVLLQSIGGGGGQGGAVTSNASASATSANSKFSLGASVPIGGAGGSGSWGQTVQGSISGAIQTAGDSSIGFFAQSVGGGGGAGASVTNSATASGSSRLQASASVTMGGAGGSGGSGGQVAFNVPEDLTVITGNASTGTGAGAHGLLLQSIGGGGGASGSVLSSNVATGTSNTSFTLGASGALTRSGGNGGSASSVSLGRASQIADLTVQTSGDAAHALFLQSIGGGGGAAGSINSGSASGNISAAMAMGGSGGNGGQAGSVSLFADATLLTQGAGSYGVLLQSIGGGGGQGGSITGNASASAESANAKFAFGADASKAGDGGVGGQAADVNARLSGNISTTGTQAIGVFAQSVGGGGGAGGSITSSATNSGNATYSASATFGFGGKGGNGASAGDVSLITNAGKTLTVSTTGQSAKGILLQSIGGGGGQGGAIHSNATSSTTNATLGGLGVGESGAGGAGGNSGTVSLNAADLIIRTTGNNAVALLAQSIGGGGGSAGTNVNNVQGGNIGINVGIGASGGAGGNSGAVNLNIQDGTILTSGNNATALYVQSVGGGGGSSSSFVGGSSASNIAINGTIGGSGGAGGNSGSVTIVNAADIQTLGDNAVAIYAQSVGGGGGETSIAAPSSSADNTISGSLQVGGSAGGGGSASNVSVTNRGLVITKGSQSHGVFSQSVGGGGGRVSIATQTASEGTEASISFGGSGGDGGDAGNVSVTNSGLIDVSGPAAYGIYAQSVGGGGGSLSSTAAMSASLGGSGGGGGNSGNITITNAAGADIVTRGDNAVGVFALAIGGGGGDIGASQDSLSLGASGGKGGNAGNITITNNGNITTLGDGSYGVVAKSIAGGGGRATANINEGTLSLGGSGGSGGTAGTVTLRNTGNIATYGTSSIPVYLSSVGAGGGDVQSGFGDATLGSNGATGQSGKSTLINTGTLLSNNAFSPAILHQAVGGGGGSADSANGTVVIGSANATSIQSAQAMTLRNEGSLITLAQYSPAIFAQAIGGGGGRIAQTSGGNVTIGSTDAAASADLSGGSINISSTGKELITKGDYSQALSAQSIGGGGGWVGTVQGNLIVGAQNSAAPMDSGSITVTNRSLISTSGNISPGISLQSIGGGGAYTGQIGGAAQLGSISSSGSQNAGKVSLTNTGSVQTTGNFSPLINVQSIGGGGGRTGDIGTTLNLGAVNLIGASANGADVTVNNTGELLISKGLSSPALLAQSIGGGGGAAAEVTGNVTMGASGTGIANAGSVRVTNSSKIQTSGNNSIGLLAQSIGGGGGVAGLSAGDAVILGGSLIGNASGSRVSVTNTGDITTTGINAAAFLAQSIGGGGGAAAKSLGSLSRLGASAGDIADADSVSVTNRGKLQTSGNGSPALMVQSIAGGGGYIAETNAQAKYNVTLAGSNLTSANAGDVSVTNNAASVITVGAYSPALVAQSIGGGGGWSLLRSTPNAQLGSEAGSSLRGGNVTLTSTTETLGSTAAFSTAAVIQSVGGGGGVTGSALGNVTLGASQTTGNLSSGSVTASLTSDAITEGQNSAAMVVQTIAGGGGLGAEVTGNATLGMTSAASSTANAGSISFQGKGNLIATKGIDSPGIVLQSIAGGGGWLGNIGGNAALGASHIGEANAGAIQATINYDSIQTAGENSTGLLAQSIGGGGGFVGSTSGSSLTLGSTVAASSSSDTGEITLLNRADITTIGINSAALIAQSIGGGGGAAATNDGDSIRMGSISTAVDASALPLIKTGNVTVTNTSNLRTSAIGSAALLAQSIAGGGGYIAETSGSDEYTITFGANGNINATAGDVTVNNSGELLFTAGNYSPAIVAQSIGGGGGFALISAKSGGSTRIGSINNGLGKANSGNVSVTNNALLYTQGNFSTALTAQTIGGGGGVINSAASSLELGTKNHKGAAAAGNIDVTNTNLVQTDGNYSSGIIVQTIGSGGGFIAGSSGGSAVLGAVNGLSDTLGNSGDLTLNSKGKSIKTSGSAATAILAQSIGGGGGFVGATKDGATLGGTRLANISAGNVTVRNSSTIYTSGRTSAGLFAQSIGGGGGFIGTTSNENVDLGGEKLRDAVAGNITVANSGDITTTGVNSTLLAVQSIGGGGGKTTLTENTPTASAGSVITLGDQNSVRSRGGSITVTNSGNLRSSGRSSTAIAVQSVGGGGGILKRLNVNPLGSDFQLGSTQNKDGSGGNIELRNTGQSVITQGDFSRAILVQSIGAGGGWLAGSHLYTGTAILGAVQPSGKAHGGELKVVNKADITTAGLSSGGITIQSIGGGGGLIGRQAGSITMGLNKGSGITDGGSVDINNSGFISTKGEDAPGLLVQSIGGGGGRANRYESNAQLGLTGNGGQLQAKSGNINLRNSGDFITTEGYNSPAIAIQTIAGGGGYIGSQLTKDPSNLTGSVGAGKYLRDSEGKPIADVRDDVMIAGNIDASNSADLKTTGEISPGLVAQSIGGGGGYAGGMNADIITLGTNGPVTTKAGNLTVNNTGTISTTGRGSGALLTQSIGGGGGFLSSQTMNEMFMGSLYTNESTSGNVQLTNSGSLYTEGVGSIGLLAQSIGGGGGVNAYSEIEDLEAGASNDRIFLSGSDAKNSGSGNITVTNTSTVISTKGKGAPAMLIQSVGGGGGWAALANADASNLRLGSDYGSNGNGGDINFTNTADIATLGFYSQAIRIQSVGGGGGAIAASGNEIRFGSKAMAGKSSGGAIKFTNSGSISTEGNGSTGVNIMSLGGGGGTIFGIATDTTTFGTNSPDLTINANGGDLEIKNTGTFITTKGESASAILAISGGGGGGFLSEVQGNLLGGANTQGDTKGGSITLTNSATLSTTGAGSIGLAAMSHGGGSAVTGPVSGGNELIAIGSIGSSDSSSGDLSITNNASISTADDAAPALLLQSIAGGGVYAPIASDPDFIWLGNSSKDGAINNGGSITLTTKGNILTQGVGSQALIAQSIGGGGGFFGDIAPNATGESAALLGSQGYNDKKSVELATIWQNEWLKFTSKITKTDPNWLKNLDNLDATDKILRGEIIGLGGGGDAASIDINISGDQYRTEGDNSSVVLLQSIGGGGGWLLLDQGNNYTFLGSLDSKGGVGGAINATTELDLISLGANSPAFVAQSIGGGGGATGDSNLMARIGSTSAHGNNSAGDITIDHNGTISTKGIFSSGLLAQSIGGGGGLSGSISGAVSMGYKQNDADYQAKGGSITLTTAGGISTAGNHSPALVAQSIGGGGGWVAQAGGQVDLGSFSITNNSDVSAGAISITSSSDLVTQGDNSTGLLAQSIAGGGGFLGINTTIYRTNLGGKRAGTANAADVTINNSGSITTSGNNSAALLAQSIGGGGGSAALTGSPDLSITKDNKLSLSATGTASSLGGNLNVSNTSNLITSGNGSPALLLQSIGGGGGVVQALNSAAVHSIRFGYLNAGQTPKGAASSAGAIEFTSTGGSTIATAGNRSAAAILQSIGGGGGWALIDSLTTSTLGAKGTEQATGAPITANVNGTLQTTGNTSPGFVVQTIGGGGGFAGNVSGNATLGGLNLSGANGIAGSSDALMPIACRFGSCEVQTVDQAVLVDIQGDLITTGVTSPVMLVQAIGGGGGRLGTVTGNATLGMSLSSGDNDGGAIRVVSNAGASLSSRGNDSAALVIQSIGGGGGTVNSIGGNATLGGTGAGTLRAGAITLNGPFAAATQGINSPGVVLQSIGGGGGLAADVDGDLISFGTSSTADTSASDVTAISANWQISTQGLNSPGLILQSIGGGGGVAYTSSASVNLGGAVIGNTSSGDLSLTSKFNSRIQTTGVSSPALIAQTIGGGGGYVGGDGTGRGDTVTLGGTGQQIGSSGSIDLFFSGGSTLITTGLQSQGVIAQSIAGGGGFTSQNGKTMRLGVSGGTGNAGSVLITHQGTISTSGNYSEGLIAQSISGGGGNAGSSSLALSMGGIDAFGDASDVTVNNTGGTIVTAGDYSAGVVAQSVGAGGGRIGSASGQLTLGGDNASGDAGNVTINNTAGTIATAGDYSPSYLMQSVGGGGGMVGLGDSTASGTVILGGGTNGTAGSGGTLTLVEGGGILQATGLFSPGVIHQSIGGGGGWIGSVPAGTVQLGGLTTGKSTGADLELTLPFAVATFGANSPGALLQSIGGGGGIVADVGGDVVIGGTQQLGVDASAGDLNYTQLSRTISTAGNDSPGVVLQSIGGGGGLLGAVDGSVITGSTSAEGSDVRGGAITATSAAPISTSGVSSPGFTIQSIGGSGALIGSAPTSVTAGGSGLGDSRSGAINFTNSGAISTAGINSSGVILQSIAGGGLYTTSAGGNAIRLGGSVIGTNDSAAISFSTTAPIATAGSNSAAVVAQSIAGGGGAVFGLADASATTLTLGGSNATDNQASTIDLAITGDLSTFGDFSPALIAQSIGGGGGYAPLPSASATLGSISSINLDAGAITVDLNADLRTTGFGSDGLLLQSIGAGGGVAGATTTSLTMGASALANGDAADITINTTGTITTTGDQSIGISAQSIGAGGGRAGTAAGSVTLGGNGATGNAGNVTLNLAANGGNGSILTTGTQSPAFVLQSVGGGGGLVFPSTNTSSGDLLLGGGDLGTSGSGGTVAFTAGGSSSILTTGAGSSGLTYQSIGGGGGYTGSTTANAQLGGLYRATSTGAALTLASQIDSATNGIDASALLIQSIGGGGGRAGDIGGTAVLGGTSTNALLTAPEAQAGALSITLNSNLSSAGDRSAAAMLQTIGGGGGTAGAIGGDATLGGLGTGNRSAGNLTITADNRISSAGSFSPALLAQTIGGGGGSVDTVGGNLTLGRTTALTEPNTGNTSAGDLSLTVNSAAQILSTGNTSPALIAQTIGGGGGYAASTTGTVQLGAGGAGTTAANAAAGAISWSNAAGGTTEEVTELGIVPITTAGIATSGNLSPAVVLQSIGGGGGYTTGGTSVSFSAAGHAGTSTSSGDIEATNTGIISTTGDNSFGVLLQTIGGGGGVGGSSTGAVSLSNTNANSSSGNITFTNSGTIATSGTGSHAVVAQTIAGSGGFVFGGARKENAISLLGNPTGSSGDITVNNSGTISASGDGATALLFQNAAGGAYLYQNAGGFVSNITQGATDGLAPAGQVVVINTGTIVATGQGGVGITKSTSDLSGNLRVDNAEGAVIQGGDGGSAINLPTGDVERINNYGTIIGGSDGSSDAITGPGGPDEINNYGTISGDIIIPGLTRNIYNAPGARLESNLVLANGNVTLTQRGTVNPGGEYRIGNLKVYANYETTDTSLYEADLVLRSGETDNLTTHYRADLNGTVELLANQVGQAMPGTFISQGIINAQEGITIGDLKLIAPKSAVASFGFDLIENRTDLAFKYTVDYAPKGLDPNSTAVGKAVNTIQAAGSTSAFNSTAALIFAQETTKELNSLYRQLSGATSAAFPQVALATGQAFQAEVQETLDSAVLSQLQRCILNVQSLKPGDTYTGDPADCGKWRTWVNAGGSDATTPGSGTSDQSGYSTNAFNTSVGADTLVGDNTLIGIAGRFDNLWTTTTEPTTFGKTEGWSGMLYAKQRLTPATWLSGSFSAGGFSTDITRQVNIPGYPSTEQGSSSSTAIGGSLRLSHLIDTGNQGSLTPSLGLSWLQLNQAQYSETTTSNNTAYVQPGNPLIKTPNPGKASYALTYDAATYNSIPLEIGLSYKQPFKAGSTTLIPRISLGYAWDLGNTNRSLTARFNSAPKGSFTVDGTPAPSSWFNVGLGLDLAINDRFSVYINGLGQLSPSSTQSINYGGGFRWSF

SEQ ID NO: 18106 - protein, 157 aa, Wolbachia endosymbiont
TGLKKNTADTTDTTDLYTASFIAGGGAFGYKMDDIRVDVEGIYSQLNQDTTVTGTSVPAGGIAKNLTAISGLVNVYYDIAIEDMPITPYVGVGVGAAYVSNPLAKKADDDKASGFGVAYQAKAGVSYDVTPEIKLYAGARYFGSYGANFGKAAKNDA

SEQ ID NO: 18107 - protein, 157 aa, Wolbachia endosymbiont
QYQDSNDKAFDPFKASFMAGSAAFGYKMDDIRIDIEGLYSQLNKNKISGTEKTGNTEIADNLSVMSGLVNVYYDVAIEDMPITPYVSVGIGAAYLSNPATKEVVADQKHGFGFVYQAKAGVSYDVTQEIKLFAGARYFGSYGAKFDKSEEVNKADSE

SEQ ID NO: 18108 - protein, 170 aa, Wolbachia endosymbiont
  misc_feature (167)..(167): Xaa can be any naturally occurring amino acid
QYNGEVLPFKTKIDGVTYKSGKHNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARCFGSYGANFGKTAKDDGGXKSS

SEQ ID NO: 18109 - protein, 157 aa, Wolbachia endosymbiont
QYQDNNDKAFDPFKASFMAGSAAFGYKMDDIRIDIEGLYSQLNKNKISGTEKTGNTEIADNLSVMSGLVNVYYDVAIEDMPITPYVSVGIGAAYLSNPATKEVVADQKHGFGFVYQAKAGVSYDVTQEIKLFAGARYFGSYGAKFDKSEEVNKADSE

SEQ ID NO: 18110 - protein, 1781 aa, Wolbachia endosymbiont
SICLLTSSFLSTSARAANFKDLVSKTPTWEKYNSTQQQNIWKNLTPNEKIKKWQEADLVPSFTQAQDDLGIKYKETDLSSFVDNTRNKARHARAKILLYIERVKQQDFDTKKQEYINQGVVPTDIEAATNLGISYDPSKIDNNVENDQKVRRAAKDKKAVIELYISSINRDIKYKHYVDNDIIPEMKEVRTALNMNKDDAESFVASIRTEIMENAKGQYIADSHIPTEKELKNRFGISRDDNRDGYIKSIRLKVMDKEKPQYIADNSIPTEKELEKKFGADKDEATNYIASIATQMMLGKKSYYIDNNIIPNADELMNEFKIGKIKANSYIDQIRAGIDANQLLNNNDTTTKQSAGHSQKKSGSKHNWYMSNQGTHNTETSSGVSRTSSGISTGRKEKQPYFFDPISTFKTHFNHKKNKGNLTQSQHNINRIIQQEENIEAFNNLIKTNPIAALNLEVDSSYTQEAVTTILSDFNDDTIQRVLFSNDTGQLDFNTNIDVKNRPILKKLLENSSSEEKTKFAERIQDYATRNISNSQFEEKARLDLIKLAASKDKSSVENFLTLQLELKNRMQPYIVKSVYILTPEIVKAINIELKNKGLIIDSLTKDDMIKLVKALNKQTLNSAIKVILSDSNILSNETNKILGLAVGNNANNLEQTQSGIPNPPPLPLNGGIPNPPPLPLNGSMPPPPPPLNSQDFSSNSNNFDLNKLQAEYPHIHSLYIQFTRNTTVQPKVPLQPTTASATSTDRSTPETAYAKLYAAYRTETGGKKADDLQDQLIKRQADLTNVIRQILTESYANQGADAKTLINLFSISTPEIAEKAKEAFNTLVQDPYIQDITVNGKKTTTSEEIIKNLFNEDTDDAVKRILLSSCKISEELKRPIKLEFNKSELIRELQSKQNPFEQLEFAYTNAQYFDQDIFGNRVEELINNPHILTIAQQATFLITEDTHLRKTINSDQAQAKLDDLRTAILSTIKFEELIKANLPQHEFIAIVKEKEPELLQEFLNATTIKLTGNNNLDQLRLALPSFTGMSNEQVRILTSKLNMPIILKALHECSQEKAKKHIHTGNMPPPPPPLPPDSQDLELAYLTRLGITKSNANTSTFKTTPKIYNFSSDIAVRYKEFALSGQKAAGHKAKYSDANLFKKAIAESVAFEHSKKLPKAHQNNKYFAKIQEAVDTMHSSFIGPRTEIGQEVHNIYTSKLLELAKDKEFIKYVKDDIILSKKLTEVFTSADSDFIDPRTEIEQKIHNIYTQQLTKYPEEAVKEAFTSADSDFIGPRTEIGQEVRNIYTSQLLELAKDKELFLFVTQLLAESTALEQKYGSDIQSENSNNEKKIGRLDLKTLRLFQQKNEATNDESSTKDDTQPEDNNKKSEQSDSKTVLSPRLLCSNDSKNDKSSDDKKSLLALRSSDENDKGYETDEEELEESNSTTDEELKKDIVLESEDEALDVSFKTEAITEQDEATQRQQVSDDTSRKVAILVKATSTLHKPVHYNILSDRLKVAAIGAGDEEASINRGVWISGLYGINTQETWKNIPKYQSRTTGITIGTDAEFINSHDVIGIAYSRLESLIKYNKKLGKTTVNGHLLSIYGLKELIKGFSLQAITSYGHNYIKNRSKSINNIIGKYQNNNLSFQTLLNYKYRTKYDLYFIPNIGFKYDYSRASNYKEYNVDIENLMIQKKSNQSFESSLGGKIVFKPIVTTNNIVLTPSLYGNIEHHFNNKNTKVNAKATFKGQTLQEKIIIPKQPKLGYNIGSNILMSRKNINVLLEYNYYTHKKYQSHQGL

SEQ ID NO: 18111 - protein, 150 aa, Wolbachia endosymbiont
ANVTGKEKDSPLTRSFIAGGGAFGYKMDDIRVDVEGLYSQLAKDTAVVNASETNVADSLTAFSGLVNVYYDIAIEDMPITPYVGVGVGAAYISNPSKADAVKDQKGFGFAYQAKAGVSYDVTPEIKLFAGARYFRSYGASFHKETVSTTK

SEQ ID NO: 18112 - protein, 150 aa, Wolbachia endosymbiont
ANVTGKEKDSPLTRSFIAGGGAFGYKMDDIRVDVEGLYSQLAKDTAVVNASETNVADSLTAFSGLVNVYYDIAIEDMPITPYVGVGVGAAYISNPSKADAVKDQKGFGFAYQAKAGVSYDVTPEIKLFAGARYFGSYGASFNKETVSTTK

SEQ ID NO: 18113 - protein, 269 aa, Wolbachia endosymbiont
ANSVQLGRRLRLFGSLSKTYPLPWGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVPKKVAAVVGKPGSDVYYAGLNYKNGGFAGNYAFKYAKHANVGRDAFELFLLGSGSDQAKGTDPLKNHQAHRQTGGYDEGGVHRVWAAQLDVSEHDHNTKTVLPLLPRLRPPAALMGSTHPRCGCFLFDLTRKNGPIPPPPTLPL

SEQ ID NO: 18114 - protein, 878 aa, Chlamydia trachomatis
MRPDHMNFCCLCAAILSSTAVLFGQDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTIHAPNLSIQKIFLSNSGDENFYENVELLSKEQNNIPLLTLSKEQSHLHLPDGNLSSHFGYQGDWTFSWKDSDEGHSLIANWTPKNYVPHPERQSTLVANTLWNTYSDMQAVQSMINTIAHGGAYLFGTWGSAVSNLFYAHDSSGKPIDNWHHRSLGYLFGISTHSLDDHSFCLAAGQLLGKSSDSFITSTETTSYIATVQAQLATPLMKISAQACYNESIHELKTKYRSFSKEGFGSWHSVAVSGEVCASIPIVSNGSGLFSSFSIFSKLQGFSGTQDGFEESSGEIRSFSASSFRNISLPMGITFEKKSQKTRNYYYFLGAYIQDLKRDVESGPVVLLKNAVSWDAPMANLDSRAYMFRLTNQRALHRLQTLLNVSYVLRGQSHSYSLDLGTTYRF

SEQ ID NO: 18115 - protein, 855 aa, Chlamydia trachomatis
MRPDGYLKTAWIMTILFSIILPLHSQTPRQFSIELKDKPLPAALKLIEKEGGKNIIFSYNETESYRVTASIRQKTELEAIGTVLNGTPFICKEREEYFVIQKKGKNVPTTEIRGQVTNEKNEPLPYSNVLLLTPGDSTFVNGCVTREDGSFLMIAEEGRPYLIRVSYIGYKTEVQPYHPTPTFHLLPDTQLMQEVTISARRPMIEVGPNGLKANVAGTSLARMGSAAEMLPHLPFVTGRNGEYNVMGCGSPVIYINNKKVRDITELERIRANEILSAEVITTPGAEYASDVAAVIRLHTIRRRGQGLSGHFNTTYSQGHSANANEYMALNYRTGGLDLFVKGYLAQQNSYGKTTNMNRIKGSAIWQTNKNDVQTHKSQRFSGELGFNYEPDEHHSFGLRYMPETGIGNADRNSSGRTVTRRNDEETDRINFTTAEQTHTGWDHAANAYYAGELGKWNIDFNADYLFKRSHSDQNAINNDDATVQADSRMRSSLYAAKLVVSAPLWNGRFSFGTEETFTNRHDIFTQNGFSADADDHIKQSVYAAFADYSKSIRHWKLNMGIRYEHQQTDYYEKGIKIDAQSPTYNDIIPVLAASWSHNGKSFSLSYRLRKNNPDYSLLTNSIRYRSKYEYSQGNPLLKTQKTHRFSASTSWNWLYFSAYFSRILNMYTNIIMPYKEDTHPGVLLFATQTIPTTHNYGISLNASPKLGYWEPQLNVNMAFLDMNANKIGITERRNQPRFYISLDNNFNLPKGWFFNIEGYLSTASRQGFFVTRTEGQISARLSKSFLNETLNIALTANDILHTGYYHFNLYGINAYMENRIYRDFQRFGLQVSYKFNATKSKYKGTGAGQSEKNRL

SEQ ID NO: 18116 - protein, 878 aa, Chlamydia trachomatis
MRPDHMNFCCLCAAILSSTAVLFGQDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLFLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTIHAPNLSIQKIFLSNSGDENFYENVELLSKEQNNIPLLTLSKEQSHLHLPDGNLSSHFGYQGDWTFSWKDSDEGHSLIANWTPKNYVPHPERQSTLVANTLWNTYSDMQAVQSMINTTAHGGAYLFGTWGSAVSNLFYAHDSSGKPIDNWHHRSLGYLFGISTHSLDDHSFCLAAGQLLGKSSDSFITSTETTSYIATVQAQLATSLMKISAQACYNESIHELKTKYRSFSKEGFGSWHSVAVSGEVCASIPIVSNGSGLFSSFSIFSKLQGFSGTQDGFEESSGEIRSFSASSFRNISLPIGITFEKKSQKTRNYYYFLGAYIQDLKRDVKSGPVTLLKNAVSWDALMANLDSRAYMFRLTNQRALHRLQTLLNVSYVLRGQSHSYSLDLGTTYRF

SEQ ID NO: 18117 - protein, 878 aa, Chlamydia trachomatis
MRPDHMNFCCLCAAILSSTAVLFGQDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTIHAPNLSIQKIFLSNSGDENFYENVELLSKEQNNIPLLTLSKEQSHLHLPDGNLSSHFGYQGDWTFSWKDSDEGHSLIANWTPKNYVPHPERQSTLVANTLWNTYSDMQAVQSMINTTAHGGAYLFGTWGSAVSNLFYAHDSFGKPIDNWHHRSLGYLFGISTHSLDDHSFCLAAGQLLGKSSDSFITSTETTSYIATVQAQLATSLMKISAQACYNESIHELKTKYRSFSKEGFGSWHSVAVSGEVCALIPIVSNGSGLFSSFSIFSKLQGFSGTQDGFEESSGEIRSFSASSFRNISLPIGITFEKKSQKTRNYYYFLGAYIQDLKRDVESGPVVLLKNAVSWDAPMANLASRAYMFRLTNQRALHRLQTLLNVSYVLRGQSHSYSLDLGATHRF

SEQ ID NO: 18118 - protein, 878 aa, Chlamydia trachomatis
MRPDHMNFCCLCAAILSSTAVLFGQDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGAICCISDLNTSEKDSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTIHAPNLSIQKIFLSNSGDENFYENVELLSKEQNNIPLLTLSKEQSHLHLPDGNLSSHFGYQGDWTFSWKDSDEGHSLIANWTPKNYVPHPERQSTLVANTLWNTYSDMQAVQSMINTTAHGGAYLFGTWGSAVSNLFYAHDSFGKPIDNWHHRSLGYLFGISTHSLDDHSFCLAAGQLLGKSSDSFITSTETTSYIATVQAQLATSLMKISAQACYNESIHELKTKYRSFSKEGFGSWHSVAVSGEVCALIPIVSNGSGLFSSFSIFSKLQGFSGTQDGFEESSGEIRSFSASSFRNISLPIGITFEKKSQKTRNYYYFLGAYIQDLKRDVESGPVVLLKNAVSWDAPMANLASRAYMFRLTNQRALHRLQTLLNVSYVLRGQSHSYSLDLGATHRF

SEQ ID NO: 18119 - protein, 878 aa, Chlamydia trachomatis
MRPDHMNFCCLCAAILSSTAVLFGQDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTIHAPNLSIQKIFLSNSGDENFYENVELLSKEQNNIPLLTLSKEQSHLHLPDGNLSSHFGYQGDWTFSWKDSDEGHSLIANWTPKNYVPHPERQSTLVANTLWNTYSDMQAVQSMINTIAHGGAYLFGTWGSAVSNLFYAHDSSGKPIDNWHHRSLGYLFGISTHSLDDHSFCLAAGQLLGKSSDSFITSTETTSYIATVQAQLATPLMKISAQACYNESIHELKTKYRSFSKEGFGSWHSVAVSGEVCASIPIVSNGSGLFSSFSIFSKLQGFSGTQDGFEESSGEIRSFSASSFRNISLPMGITFEKKSQKTRNYYYFLGAYIQDLKRDVESGPVVLLKNAVSWGAPMANLDSRAYMFRLTNQRALHRLQTLLNVSYVLRGQSHSYSLDLGTTYRF

SEQ ID NO: 18120 - protein, 315 aa, Ehrlichia ruminantium
MTNKLTFTGTVLALLLCIPNTSFSEIKYNNNTNIQYSIYVSGQYKPSVSNFRNFSVKETNTYTKNLIGVKKDITSLEVHTNNNKHIVSRRNPNPGPTIKATGISNPSNFNIPYNPEFQDNIINFSGTIGYQFSKSKRIEIEGSYKIFDVKDPGGYMLYDAYRYFALAREMNDTKFEPKPYQLDNFFNNFYHTVMKNTGLSIISVMINGCHDFHVNELKISPYICAGVGINTIEFFDTSHIKFAYQGKIGISYPLSNNIKVFSNGYYHKVVGNKFKNLEVIHVANLHNAPWYTSAIATLNIGYFGAEVGIRLGLKL

SEQ ID NO: 18121 - protein, 283 aa, Ehrlichia ruminantium
MGKFMNYKNTLLGIMLALSLLPTKSFSESISNNDNSQNFKLYISGQYKPGVPRFNNFSAKETNVKTQKLLGLLSGTSRKIDKYKDFSNTYIPDFQDSSTGFGAAVGYISYKGIRFEIESSYEEFQVNIHDNCEGTIEPCRYFALARSVGRRGWPDQNNYTVMKNTGLSMTSVMFNGCYNIMSNKLEISPYICIGIGGDFIDFFDATHIKLAYQGKLGISYSLLPDVTLFVDGYYHRIANNQFNNLNVLQPVELKYEPKITSATATMNVTYFGGEVGIRFIFNS

SEQ ID NO: 18122 - protein, 430 aa, Ehrlichia ruminantium
MNKNKNKITLSLAAALILGMSANTMAAGFQLAEYSATGLGRAFAGEAAMADNAGAQFRNPAMLTYLEGTQVSMGAIYVDPNIDVEGSVNGTQTKASDIANSAVIPNFYLSHQLNDKVFLGLAFGTNYGMETELAGDYLATQFGNQAKVMSIEINPNIAYKINEQFSVGGGIRYVMGEGHFGAAASSDMPLAPGVTVPKGADLKYMEGDDTAWGWQAGAAWQINENNRIGFNYRSEVELNLTGSASGAIYDLEALKKGKKPSASYAGSMALTLPATAEIASFHQLTNKIAVHASFNWTDWSSFDKLEAKIPSLYGNDPDLIKEENWEDNYRLAVGTTYQYTNKLVLRSGIAYDTSAVSDEHRTQTIPETDRLWLSMGAGYNWSQNLTLDAGFTYIFAKDAPMNEVDPSLGQFKGETTGSIWLVGVQASYRF

SEQ ID NO: 18123 - protein, 257 aa, Ehrlichia ruminantium
MNNKNSITKVYIVTILSFILLPIQSFSALIGNITKNEEYSNVYITSQLKPTVLYFKDFSLKEINASHKSNDDIITQHDTKFHNNTSSFSGSVGYSSLGLRLELEGSHEKFHMQNSDIISKISKYQYSTKAYAATTDNYTNTNNNNITLTSLMVNTCYDITIGNSSAVPYLCTGIGGDIINIFNATHLRFAYQGKIGISYQLNNNFFLFADTYYHKIMGNKFKDLYIHNSSNITPMLAKIDIGYFGSEVGLRIIFNKL

SEQ ID NO: 18124 - protein, 316 aa, Neisseria meningitidis
EVSRVKNQGVKTKTATQIADFGSKIGFKGQEDLGNGMKAIWQLEQKASIAGTNSGWGNRQSFIGLKGGFGTVRVGNLNTVLKDSGDNVNAWESGSNTENVLGLGTIGRVESREISVRYDSPVFAGFSGSVQYVPRDNANDKDKYTHKQSSRESYHAGLKYENAGFFGQYAGSFAKYANLNKDAERVAAGTSGAYAVKDYQVHRVVAGYDANDLYVSVAGQYEAAKNNEGAAKQGKKHEQTQVAATAAYRFGNVTPRVSYAHGFKAKVNGEKVARYQYDQVIVGADYDFSKRTSALVSVGWLKEGKGVNKTEKTASM

SEQ ID NO: 18125 - protein, 322 aa, Neisseria meningitidis
EVSRVKNQGVKNQGVKTKTATQIADFGSKIGFKGQEDLGNGMKAIWQLEQKASIAGTNSGWGNRQSFIGLKGGFGTVRAGNLNTVLKDSGDNVNAWESGSNTENILGLGTIGRVESREISVRYDSPVFAGFSGSVQYVPRDNANDKDKYTHMKSSRESYHAGLKYENAGFFGQYAGSFAKYADLNTDAERVAVNTANAHPVKDYQVHRVVAGYDANDLYVSVAGQYEAAKNNEVGSTAIGKKHEQTQVAATAAYRFGNVTPRVSYAHGFKAKVNGVKKASYQYDQVIVGADYDFSKRTSALVSAGWLKEGKGVNKTEKTASM

SEQ ID NO: 18126 - protein, 323 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRVGNLNTVLKDSGDNVNAWESGSNTEDVLGLGTIGRVESREISVRYDSPVFAGFSGSVQYVPRDNANDVDKYKHMKPSRESYHAGLKYENAGFFGQYAGSFAKYADLKDNAERVAVNTANAHPVKDYQVHRVVAGYDANDLYVSVAGQYEAAKNNTGTVGKQGKKHEQTQVAATAAYRFGNVTPRVSYAHGFKAKVNGVKDANYQYDQVIVGADYDFSKRTSALVSAGWLKQGKGAGKVEQTASM

SEQ ID NO: 18127 - protein, 320 aa, Neisseria meningitidis
EVSRVKNQGVKTKTATKTATQIADFGSKIGFKGQEDLGNGLKAIWQLEQKASIAGTNSGWGNRQSFIGLKGDFGTVRAGNLNTVLKDSGDNVNAWESGSNTEDVLGLGTIGRVESREISVRYDSPVFAGFSGSVQYVPRDNANDKDKYTHKQSSRESYHAGLKYENAGFFGQYAGSFAKYADLNNDAERVAAGTSGAHAVKDYQVHRVVAGYDANDLYVSVAGQHEAAKNNEGAAEQGKKHEQTQVAATAAYRFGNVTPRVSYAHGFKAKVNGKKAARYQYDQVIVGADYDFSKRTSALVSVGWLKEGKGVNKTEKTASM

SEQ ID NO: 18128 - protein, 314 aa, Neisseria meningitidis
EVSRVKNQGVKTKTATQIADFGSKIGFKGQEDLGNGMKAIWQLEQKASIAGTNSGWGNRQSFIGLKGGFGTVRVGNLNTVLKDSGDNVNAWESGSNTGDVLGLGTIGRVESREISVRYDSPVFAGFSGSVQYVPRDNANDKDKYTHKHSSRESYHAGLKYENAGFFGQYAGSFAKYADFDDEAKRVAVGASGSNAVKDYQVHRVVAGYDANDLYVSVAGQYEAAKNNDSDIGKKDEQTQVAATAAYRFGNVTPRVSYAHGFKAKVNGVKEARFQYDQVIVGADYDFSKRTSALVSAGWLKQGKGVNKTEKTASM

SEQ ID NO: 18129 - protein, 344 aa, Aeromonas hydrophila
MMKMAPSLIAIAMAAMGATAAHAADDIYFGAGAGAAHFNGLNKIGGGGYAGTEDAAAANAFVGYNFTENFGTEFGYQYAGRGNTDGLRYENQGATLSGIARLPLGGDFSAFAEGGAYWAHTDGLGTSDTKVSPLAGLGVTYKVNDALDLQARYRYMWDVADLHAGDAPDDVRYKSNQSVATLEAVYHPFRTSYVAPAPAPVVEEAPAPAPQVVEKNFALNSDVLFAFGKDSLKPEGVAALNALYQQIVEFQPKDGNAVVVGYTDRIGSDAYNQKLSEARARTVANFLVSKGMAASKVAIEGRGEANPVTGTKCDGVKAKAQLISCLAPDRRVEVRVSGVQEVQK

SEQ ID NO: 18130 - protein, 340 aa, Vibrio parahaemolyticus
MKKTLIALSVSAAAMATGVNAAELYNQDGTSLEMGGRAEARLSMKDGDAQDKSRIRLNFLGKQEINDNLYGVGFWEGEFETAQNGTVDGDDKSDLETRLAYAGLGGAYGEFAYGKTEGALGVITDFTDIMAYHGNSAADKLAVSDRTDNMMAYKGQFENLSVKASYRFADRMENKNTGEYYDNKQDGYSLSAIYALADTGLELGAGYADQDKANEYMLAASYTMSDLYFAGVFTDGEKMEDSNNSNTVDYTGYELAGAYTLGQTVFTTSYNNAETNNETSTNNFAVDASYYFKPNFRGYISYNFNLIDAGDKFGSTDTSKTVATKIDAEDELALGLRYDF

SEQ ID NO: 18131 - protein, 269 aa, Yersinia enterocolitica
GSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKGENTSYDQFAT

SEQ ID NO: 18132 - protein, 1000 aa, Pseudomonas syringae
MLNTMSQQKSFKKAPLAAGVALAVASQLSFSQDVSNEVDSGASDSAMEEVIVTGIRQSLQKSADIKRDNAGVVDAITAEDIGAFPDTNLAEALQRVTGVAIDRTRGEGQYVTVRGFGPAFNLVTLNGRQMPTTGGDSRSFDFSNLAVEGVSRVEVYKSGKADVPTGGIGSTINIVTTRPLDAPGFNATVAASAMHDTSTETGDDFTPEVSLLISNTFLDDTVGISLSAVRQERNNGAATASVAGWRSFAGDVDNCWCSARPSEWGGIPYDLATQQNRPTGADEQYSVPQNTGYEFAEWDRVRTNGQLTMQWAPTERLTATVDYTYSEVELERTFTNYSAWYNFGGQETAWDGNNSNASPTTYAEFNGGSGDFAMAGGSDATVAENTSIGINLAWDVTDRLSLMFDYHDSDAEQRPDSPFGSSSQLAISAFSRDKTTTYFDRGDLPVLALDLSNPLSTDDMIVTGSVFANNYAKMEIEQARFGGSFDFNPDGVVKSIDFGVEFTEVNNRSAGSVVQRDAWGGVSQVGAIADLLTEVSSAGRFDEISGGSDPELVTNYYAFDMPALIERTEQLMASGDAATFSVPDMGDCGTGLCASSTYSSDRRTTEEQLAAYFQVNMGFDIGAVPVDVRLGVRYEETDIDSQALAPSYSRVDWVGGNEFSAVPGEADFTELSGSYDNVLPNLDVRVGLTENIVARFSYSKTMTRPNYADIQGGQTIDQLLRIDGGTGSRGNPNLKPFESDNIDLSFEWYYGDASYFSVGYFTKDVENFIGFSEFNETLFDLPHPGNGSYADEARAALGNAATSGELYDWILANKEGSPGVNTANGSITGQSGDSLANFRVTAPVNQDDDTVDGWEINLQHTFGQTGFGFIANATLVESDTEYDNTDRTQQFVVSGIGDSANLIGFYENDRFSIRVAYNWRDDFLAGTGQANVGAIPPTYVGEYDQWDIGAQFHVSDNLSIFADAINITDETTYVYGRSESQPLFVAQQGARYNVGVRYTF

SEQ ID NO: 18133 - protein, 448 aa, Pseudomonas syringae
MKKSTLALAVTVAALAQQAGAAGFLEDSKASVSSRTLYFNNDLREGRRAPDQRETATGLKFDYTSGFTQGTVGFGLDAQAVMGLHLGGGIQHHTVNTANTVVPTDTDGSSVSDWSRVGANAKMRFSKTELKVGNALAPNLPILVANDGRLLPQAFEGGILTSKDLDNVTFTAGQLNKSIGRASSNWTDLSVAGATQTADQFRFAGADWKVTKDLTLQYYYANLEDFYKQHFLGLVHVYPISDNQSFKTDLRYFNSSSDGKNSEAAAGYRFNNNGGYASHAGEVDNQTWSAMFTYALGGHSFMVGHQQVGDSGGMVFLGQGNVVDGRGRPEGNGGSSFYLFTDSMINGFNRAGENTTFGQYSYDFAKVGVPGLKAAIAYLSGDDIRDVNRNLGTHSEWERDMRVDYVIQSGVLKGFGTTVRHGTFRGDVATTADTDQTRILFNYTYNFM

SEQ ID NO: 18134 - protein, 799 aa, Pseudomonas syringae
MHTSTSLSIAVSIALAASAFAGTAQAQQPPPQKTLDTLIVTGTRVADRTVAESESPIDIITEQSLQATGATDIATALGKLLPSLNFPRPAISDGNDAARPATLRGLSPDAVLVLVDGKRYHTSALINYNPYVGRGSAPADLNSLPMSAVARIEVLRDGASAQYGSDAIAGVVNIVLKHGAKTGDNSVSVNGGFMDKGDGEQNGIDGSVGMGFGGTGGDTAPGWVRLSWNYQNTMSTNRGENTNRATTVPGTPNPGGVPYQRHGDPKSTFYQGLAAFGYEFSPNLELYGHFSASRREVTSNGYYRAADNPARNVPSIYPNGFLPQIYNPVNDRSAVLGIKGSTESEWNWDLSASYGKNDMSFNILNSINTNLFYTTGASPTNFNSGGFETQQGTVNLDISRAFDWGLAYPVNVAFGAEHRQDRYRITAGSPDSYFFDPTTINPADGAPYPGGAQVFSGLEPSVAGKFGRHSNAVYANLEANLTEKLSGGIAGRYENYSDAGATRSGKLSARYAFTDTFSLRGTISNGFRAPSLAQQNYASVVTLIQNGELVQVGTYRTSDPVALALGARPLSPEKSSNYGLGGVWQPTANFTSSLDVYQIRIWDQILYSDQLQLAQPIGQVAAVQFFVNGATSRTRGVDWVNSYIADLGDLGQLTLGASANYNKTTILELSNPNFGRASQGLLTDATPRTKYMASADWAIGGFTLNGNATRYGSIKRISDPVDGSQDQTYDARWILNLSASQTWNAFTFTVGADNLTNQYPTKAQLTTAYDDRAGGLQYSSLSPFGFNGRYWYGRVTYRF

SEQ ID NO: 18135 - protein, 441 aa, Pseudomonas syringae
MTQLKTLSLALCSTLAGVAPAAVFADEQKEGFIEGSTLTVLNRNFYMNRDHRNGESSPTGNGYSEAWAHGIIGRFQSGFTQGTFGVGVDAFAMIGIKLDTGDGRNGGRSPFDVMPVDGDGSARDEYTKVGGSLKARAFDTVVNVGDVFPSTPVVAFGDSRLLPESFRGVTAINNSFEGLTLQGGRLHSMSQPVSSNMRDGFVTFYGGAVDSPWVAYFGGDYQATDRLSLGLYTSRLKDAWDQKYASASYVLPLSDELSLTSSLNYYNATDEGKKLLGEFDNDIWSAKVALQYGAHTLSLSHQRNQGDDDFDYLRQSDSIYLANSIQYSDFNSPKERSWMVTYNLDMSTYGVPGLSFMTRYGKGTDADYSNANSTYMRRDAQGNPLTDQKRWERNIEAKYIVQTGSLKDLSLRVRQANTRATAFESDLDEVRVIMEYPLSVL

SEQ ID NO: 18136 - protein, 640 aa, Pseudomonas syringae
MTKTSRCWPFAACLLSLACGTATAGPYSTMVVFGDSLADAGQFPDTAGPRGSTLRFTNRVGPTYQDGSGEVFNLNSSTLIGRMLNVSAGDLAASTSPVNAALGQADGNNWAVGGYRTDQILDSINSQSTVVDPNSGTLLRSRTGYLPANSFRADPNALYYLTGGGNDFLQGRVLSASSAGQAANRLADSALALQQAGARYIMVWLLPDIGQTPALSGTPLASATSALSAVFNQQLVSRLAQIDAQVIPLNVPLLISETLAAPARFGFDPNENLVATCFSGDSCRESAANGRSSATPDPSRVFFNDRVHPTEAGQRLLADYAYSLLSAPWEISLLPEMANGTLRMHQDELRAQWLSDWGNWQGVGQWQSIIAAGGQKMDFDAQDSSANADGRGYNLTIGGSYRFAEHWRTGVVAGAYRQNLEAGARDSDYKLNSYIATAFVQYQANHWWGDLAVSGGKLDYENAERKFALGVSEGQEKGDTDGELWAVSGRVGFDIAGAASRWHLSPFVSADYAHIDVDGYSEKGNRSTALTFSDQTRKSRRAGVGLQGKFEVTPTTQLWAEVAREREFETDQQNVTMALNSVQSVDFTLEGYTPQRDLNRATFGVSQKLTQDLTLRGNYNWRKNDDVTQQGVNVALSMSF

SEQ ID NO: 18137 - protein, 1027 aa, Pseudomonas syringae
MFRKSKLSVAILAAAGTLVAGQVIAEGSSIDEVVVTGIRGSLERAMDTKRDASGVVDAISAEDMGKFPDTNLAESLQRISGVSINRVNGEGSEVTVRGFGGGFNLVTLNGRQMPSANVGTITGNPLDQGASGSSRSFDFSNLASEGVRGLQVYKTGRASVATGGVGATINVETIRPLESGGTQASVGVKAVKDTSGDDVTPEVSGLYSWSNDDSTFGVSVFGSFQERDSGSRHASVEEFGLRTWDSTDPSNLSNLGIVEGATIINTPNDGQLVYRPTNLGLGFNEDKRERTNGLLTVQFAPNDSMTFTADAAYAENIQDSTSLVDGVWFNGTVDYVEYDGDPVVAAPVIFAEDVSGGKDFFFQNLDMGTKDTLESIGLNLDWNVSDKLNLRFDAASSEAKSGGNGPQGNNVLRMNVAGGNAGWQAVDFGQEIPQGIVSVDDSVKGNNNGIFDLADVGSQVTQFAKSDQVAELEQFNFDGSFVASDNIEVDFGVGFMSSEMRQTRQSGSNALGGWGVDAPGDIPEGLIEQVSSLGEFDYQGSGVAGVSQPAGETAPIALGSVSWTGDPLTLLNAMAPIYGLDPNNMPINSTADNRVEEDTISIYSQIKMDGEVGGMPINVVSGLRWEETDVTSTSQQAVPSAFIWESNNDFTFTLGDSVDSLSEDYSYSVLLPSLDISIDVTDNLKARASFSKTLARPGYSDMYTATSVEAPSRITHLGDQPSASQGNARLDPLESNNFDFSVEYYYGEANYFSVGFFQKNVSNFVGVQQADESLFGLRDATASNSTFLAQAISELSSIGVAESEDALFSMTAILQNMSDFTETSGAAAYQAAEGAASSTQAFHEAIFSEYDVTPVGTDPLIAFAVKSPTNSKTAEIYGFELASQHFFGETGFGYQFNYTTVEGDIGYENGSDPSEDQFALPGLSDTLNLVGIYEKDGLSARLAYNWRDSFLSQVNRSVGSTRNPEYTDSVEQLDLNVSYEFDSGVTVALDAINLTGEGQRKYGRNKNATFFVQELDPRYVFSARYTF

SEQ ID NO: 18138 - protein, 70 aa, Pseudomonas syringae
MNNRSAVRILRLPAVIQKTGMARATIYDWLNPKSPRYDATFPKKRMLGVKSVGWIEAEIDEWLSQRCKLI

SEQ ID NO: 18139 - protein, 932 aa, Pseudomonas syringae
MHKHEQQWTPLLLKTGRQICLGTLLIAAAGVPVQAVPAGQVAGLPPQTVARSAPPMTVQSARELLEGTGGAADLKTQPPLWNWTQPVVSQAAPTPAAPAAGEPATAQGETPADDENFLDEVSVTATRRAVRQRDVTATVYSVKKEDFKAVGSTTVTDSLVLVPGFQAAPSLGGVRGIGETYLRGFNDQRFQALRDGLSLTRSSNGRSDIFGYQGEDLERIEVLTGGATLRYGSGSVGGVINLITETPKGPPKLTLQYETGSYGFNRYVAKYGGGDDVFSFNLTYAGVTSQNDYPFRYTVPNTAQFYGTTNNPNAALPTTSIPADPSIGRPEPIDFNLFSANSYPNAGANGPNSFNLNGAGTNDPANSGPIDLYGFLKPEVGPPVQISGRLTANEAGAASDSYSAKLVFKPDPVNRITARLNQQNRKYISSGPGLFSDAVCAGNASAALNPVFAGQRIQPLDSQGNPLPCDPQRYIILTPSSWIASGQRVFPYSSSLSGIPFTPGNAYGIERAASVSAGGLTQTNTAQTEVAVLWDHEVNPTTSINSYAYYYRLTGNSWVPRPYYYDSNLQIALGPRRIPGAPGAFTAGATSQPYFQSDKIEVQTSLNTKLSPGQDLSFGLNFTEDRSYQQQVGVIPFFDQAIARYSAFLIDDISFSDQLKVNAGLRYTSNSAFGELLTPAAGVRFTPDRTISLRANWSYVFNAPNLSAINVAGAGSIGNPNLRPETGVTYDVGLDFTPANNLGVRFTYFSTYLDGVFGTLQVLNDGSFGQDPQRFPILSQTVNLDGQLATGIEMTGDWGLSDQVRLRVSWTNTDARPFGSVDSINSTQFPYFYQYQVPDIPFNNVIFNLLYRNQGMLASLVGRYDGGKRRINSLDFVPAWFTLDLNTEFPITPQIILTGSVFNIFDTQYEYQDGAPAPGTTFRVGARFEIGG

SEQ ID NO: 18140 - protein, 459 aa, Pseudomonas syringae
MKTTSTALLALSLSSFGALVQAEPASQTFIPTELSSKNAQADANGFIEDQHLTGTTRNWYANELKRRGEVFRYNDNGTAEQTSRRINWQQGTIVNYTSGYTQGVVGFSTELALYNAIALDRDTDDFAGSSNRTLAHRDGDAVGQWSKMGLGNVKARVSNTVLTMGRQSVNTPVIAFIGNRALPSSFQGVAVQSDELNNLSFQAGSFDRVSPRMEQSLDKFRSEYGDRSQTADRLDMFGGDYKPTDSLTASFYASNLEDFWHQYYFGFTHELGDSKVFALSTNLNYYKTKDAGQSKLGAIDNDTYSLSFTGTHNAHSVSLAYQEVNGNEYFDYAHDTNAIFLANSLLSDFNGPNEKSLQIAYVLNMAEYGVPGLKFNIYQARGWDIDGTHYKGTGYTDVLAMDGETHYEYGIGSSYSVQSGPLKATAIRATYTTHRASENQADGNINEFRLVTTVPFNIL

SEQ ID NO: 18141 - protein, 808 aa, Pseudomonas syringae
MSRSLDTLLRPSLLAVAIALCTPLASSQLIAAEQASSVRAYNLPAAPLSTTLNQIASQGGLTLSLNPSLAAGKTSAPVNGQYDAAGALRAALRGTGLQLEQSGAGTYTLVAVPEGVMALPETSVIGVENYESAWGPVEGYTATRTAAGTKTDTALVEAPRSISVATRQQMEDRGVHSLDDAVRYMPGITASSYGSDTRADWLRVRGFEPTQFLDGLPLPKGVYANPKQETWNLDRLALLRGPASSVYGQTPPGGLLDMVSRRPSDVQSNEIQLQYGSDNHRQINFASTGKIDDAGQFLYGLSGVVRDSGTQIDHVDNKRYNIAPSLTWNIDDDTRFTLLTQFTRDDTGITSQFLPVQGTKIDMPFGKVSHHKNLGDPDWEYYDRTYYALGYAFEHRLNDVWQFKQNLRYTKSDLSFQGITVGSYPFTQVDNDGNVGRTTTIVDEDISQFAVDNNFQADFATGDIRHTLLLGLDHQRSNTNYTSIFGSAPEINVNNPIHGQPIVRPARSTAFYDYNQKTYQTGLYVQDQMALDQWRLTLGGREDWVHTSTQFINKGDATNTQRDKAFSGNAAISYVFDSGFVPYLSYAESFQPTTGADASSTESLKPTEGKQWELGIKYQPPGSKTLLTAAVYDLTQKNVSVSSFVNGVSITSQTGEVKVKGLELEAVSDVTDNLKVIAAYTLAKSEVQNGADKGNRLQLMPNQQASLWADYSWHSGVLDGFGIGAGARYTGNTYGDKANTWLGKADAYTVFDAAVHYDLGRLDNSLKGASLALNATNLLDKDYISTCDSFYCYYGDQRSVVASATYKW

SEQ ID NO: 18142 - protein, 191 aa, Pseudomonas syringae
MPQLRIIFLFLTVLMTFSLRAEPGVYGEQRISRWWNEWTTDVSQTWNEPQHYDLYVPFLSWHARFMYDKEKTDNYNEMPSGGGFGISRYDEEGDWSSLYAMMFKDSHNEWQPIIGYGWENGWYLDNARDFRLGLGVTAGITARKDFANYVPLPIILPLFSAGYKNLNVQFTYIPGTYNNGNVLFAWLRYGF

SEQ ID NO: 18143 - protein, 544 aa, Pseudomonas syringae
MRTPMLRKLSLVWGLGALMAIAGGGGEALAEPGGKIEPLQFGQSVEEMDSNPMGQITSVSELRDVQPTAWAYEALKSLVERYGCIVGYPDRTFRGDGALSRWEFAAGLNACMNVMERLIQENVAVLREDVDKLKRLAQEFQGELAALGARVDNLEVRTAYLEDHQFSTTTKLSGQVVTALSGIVSGDKNNGTESITRNTTLGYRTRLELNTSFRGDDDLFIRLSSGNLEDYGPIAGTFQPVLGATEPEDGNLSNSVLYYTFPATENIRLWAMGAGGAFDDFTNTVNVLDGDGAFGALTTFGTRSPIYFLGEGTGAALQGTWDKLQLSLGYLAPAGNDPSQGEGLFNGSFGTIAQVNYDFSDNLTVALTYSYGYNTLDTSTGSQRSNFRYFTETTFGEAAKTSHNAYGAAFSWQLSDHFVLGGWGGLTKARTLKSIDLADASIGRGSLDIWNWAVTLAFPDIIKEGNMAGIIVGMQPWVSSSSIVFPDDIATTDIDSSLHLEGFFQWAVSDNLSITPGIVVVPNADYNNANGTLVMGVIRTTFSF

SEQ ID NO: 18144 - protein, 781 aa, Pseudomonas syringae
MQKSISSGYMLSCAAFAILATPMAAAAQTMPEATAAGATQEDKVIVTGRRVSGVFDAIGADQASVTVGVTREELLSAPAGISGLKMLETLPGFNVQTDGALGLYEFGNSVSVRAFRLPQIGFVLDGVPMGRSDAFGGSPIFRYVDNENLGSVIASPGAGDVSLPSYSSLGPIVSYNTTDPAEEFGGVLQYTIGDFDLERSFIKLETGRIGGFTGYISRSKTDSNLWRGPGSIDREHIEAKAKYEFDDDTYLRAIYVANDFFDYDSPSGTEATFDANYGYAYLATVPNDCIEPDPGVFDYNGDGTIDGDDFTPVFTQGSCTQYFEDRINVRQDALYGVTFATDITPSVDLVLTSYFEDKDGFGVSPDSYSNSRGIYVDQAAAGLPVTHPRGVQYGLSEVGGERLGILGGVSVEAGNHLIELGGWYEDEFYNRTQLRLNNSGGSADGEVLFDEVAYFRRNYQSVRQTTQFYVKDTISLLQDQLTLEVGVKSLNIEYTLDGYRDYADYEIDGMPGYGPQYVEAEYEDNFLPMVGAVYRLTPTEQLFASYAQNYALPQGADSVFSTAVSFDAPPPAAEESENFEIGIRTNRPQFYGTAALYYTTFDNRLVQGNVLNPATNEPEAFYINAGETEAYGFELAGVYQPALFEDLLYFNANLTLNRATTKDGFSGNEAGSLLADSPQILFTGGMTYEPTDWAVANLSLKYTGERYADYNEQFEIDPFTVVSGYLDLGGPNSFGVPENVSLRFNVDNLLDEEALSFVFAGSPFYRPLNPRTFQATLRVEY

SEQ ID NO: 18145 - protein, 1213 aa, Pseudomonas syringae
MKCVQNLAGTPFPGQTSMNSALRHKLCSQASWLALRSAIGIATAAGVSLLAPAQAWADCVVGGTTVQCDTTSTTDTTFPANAPNDRNYQGLLPVPIGVTIDVGTTVSGYGFAVTNTGTGGVTITNNGAISVDAGNTPTAGGTAALSVSAAGGAITYTGGSITNNGAGNAFDVSQTGGAGSVNINVTGNVSAATGEGIVVRDVTTSTGISVTTGAVTALTAGKDAIDVQSQSLTGNITEVANGNLQAGNAGMVAAILNAAGIGNIDVTANGSLDARFGIDAENFGSGSTKVTTVGPVTVTTGNGIFALSTGGDVTVNAGDVTSTGNTAIIAQQTKVAGSGIIDVTAGKVSGTTGIDAHNFGTGATSVTANGTVTGSFAEGIKVVGNAAVTVSVADTVTGATRGLSLVGGTGGSGDISVTGTGGFAGGSGDAANILNNGSGTVTIDISGASSSTGGEGIVVRDVTTSTGISVTTGAVTALTAGKDAIDVQSQSLTGNITEVANGNLQAGNAGMVAAILNAAGIGNIDVTANGSLDARFGIDAENFGSGSTKVTTVGPVTVTTGNGIFALSTGGDVTVNAGDVTSTGNTAIIARQTGAGAGAIAITTSGTVEGAIAAIDAQSNAGHAIGITLSGATHNSSQTAAALAINTAGGATTLINNGALLGRVTLGDFVDKVTNNATWTTGGTSQFGAGFDSLINAASATLVTASNGASLETTTFSGLESLSNSGLLTMQDGGAGDRTLVSGNVTLTAGSTYAIDIGGAQSDLLHASGTADITGSTLAVNIQGGLQFGSHYTVLTADLGLAGHFASVTGITNTAFLSVTDTYDANNAYLDVLKTKNFADAGLTPNQIATGQGLDSIPASGSLFNAVAGLATDAEAQAAFDQLSGEIHASAKGMLLEDSSFIRDAASNRIASAFGDSSTAALPVMAYGEGGPEMVAADTDRFAVWGQAFGSWGNVDSDGNAAAFDRSTGGLLAGADTLLGDWRVGLLGGYSHSSFNADDRNSSGKSDNYHLGLYGGTNWGAIAFRTGAAYSWSSLSTHRSVAFNGFTDGLSADYDAGTAQMFGELAYKAETSGSFKFEPFANLAYVSVHTDGFSETGGAAALTSAGTSTNATFTTLGLRGSTDFALGGVNATARGMLGWRHAFGDVTPSSSFAFAGGDAFTIAGVPIARDAAVIEAGIDMKMSPNATLGLSYSGQFGGGAVDNGAKANLSVKF

SEQ ID NO: 18146 - protein, 424 aa, Pseudomonas syringae
MKIMTKALNRTTLGLALGLASSQLLAAGFALNEQSISGMGTGFAGRSSSADDASTVFGNPAGMSRIKREQISVGAAAVIAKTDIDNGRGTFGGSNDGDMVPVVGVPMGYYVKPIDDHWAFGLGVYVPFGLVTDYEKGFAGRYWGDKSHVQIVTFQPTVSYAFNDKVSIGFGPTINRIDGELTSAVPNRASLGTNDGKVKIKGDDTAIGFNAGILVQATDTTRLGLTYHSKVDYKLEGKTKVEGSGFGPFGGQKYDASLDISTPESVDFSITQQLDENWTVYAGSTWTRWSRLKDITVENSGVPTALASSIGTITEEQDWHDTWAHAIGASYKVNKEWTLRTGFSVDQSPTNNVNRSPRIPTGDRKIISFGAGWSPTDDLTIDVAYSYLREDETKIRDSSATKGSYSADYRNTAHGLGTSVTYRF

SEQ ID NO: 18147 - protein, 697 aa, Pseudomonas syringae
MADSMKKSIFNYTTFFISMSYSLFANASPAIKSTENRNNEVLEVYSTPLHTPQEKMAIPVSVLTQEDLRANRSASIAETLTSLPGFHASFFGGGSVHPVIRGMSGNRVKVLHSGSDLMDVSSIGADHTITSEPFLSQRIEVLKGPSTLLYGGGTIGGAINVIDSKIPMSVPEKGYEGELHYQYDSVSKGNTGSVGLTLGENNLALRLEGTKRYQSDYKQPEPLHQGETSRLAGSYQDNQSANIGVSWLFDDGYIGIGYGEQHRRYGLPGHTHFHDHEDDHHHHAPIRPPLIGHHHHNHNHEYPDEQHQHGIPYIVMDSKRWDLRGEKNNPFTGIESIRFSAVRTDYHHDEKEGNEVSTSFKNKGDELRLTFTHQPIWGWHGVIGGQFNQRDFSAQGEEAYVPSTKTKNHSLFLLEEYQLGDFRYELGFRQEWQSLLNRETQKNNKQSASSISAGLAWNFTQDYFLNLSLSHTKRLPVAEELYANGVHAASRTIEKGDPNLTAEAANNIDIGITKVTGDIQFNMSAYYNRINNYIYGQFTGTELNNGYRSLQYVQNDAQFKGIEGNIDYYYNQDSLIGISGDYVRANLLHNKGNIPRIPAYRLSTYIKHSFTENVIGQIRIDHFGKQNKTADYETSTEAYNTVSLGSEYIGYLDNTDYTLYAKINNIFDVKGKDSTSYIKDEMYLPGRNIILGATLTF

SEQ ID NO: 18148 - protein, 181 aa, Pseudomonas syringae
MSTSFKKRTLFSGVLIASSLATMAYAETPKQGLTVTPSIGYYNTDSDRQAGNDTSYSIGVGYQTNSPLALEAVYLHSNASKHGRNNDLDQYRVDGLYSLPEFTTVNLTPYVAAGVGVTDVDGDSNNLLVNAGGGVKYAINSDVDLRADFRLVKDIEDSHLDNVTSVGVQYNFGMPNQQASN

SEQ ID NO: 18149 - protein, 716 aa, Pseudomonas syringae
MNSPRLSLLYSAMLLALGTAGLSHADDSATNNKTTDNIEKIEVKGSYIAGYNASTASGASRLDLAISDIPQSVSVITNAQMSDFQLTNINTALDSATGVNVERIETDRTYYTARGFDITNFQVDGIGLPLSSGSNHADEDTAIYDRIEVIRGANGLMTGVGNPSATINFIRKRPTADTQLNINGSYGSFNNTRLELDGSTKLSENIAARAVAVKQTQDSYLDRYEQDKTVLYAFIEANLSDSTSFSISHSYINNDANGGLWGALPLYFTDGSATNYDRSTSTSANWSAWVVEKNNTVVELSHYFNDDWHLRATYSHKSADEDTELFYVFGTPDKTTGLGLTGYGSAYDAKETTDLADIYVKGDFSLFGRDHQLVFGANYSTADKQEHSLYDDTTGNGFPKMPDLNTWDGNTPYPTFVDRPSGSDTESTQKAVYFTGRFNLFEDMHLIAGGRFNRWDTKGESYGKSRDAEAEEFIPYIGAVYRFMPELVAYASYTETFLAQTEVDINEQPLDPVTGESKEIGLKSELFEGKLIASLAYFQIDQVNLAKLDPATINLPPNQQKYIAADGISSDGYEIDIAGEIYDGLQVSVGFTDFNIKGDELVANYTPSKLFKLAATYDVAQLEGLSLGVNMRWQDDISREQGTVGAGFANAGDTIITRQDAYAIVDLMARYAFSENISLTFNANNVTDEKYINSLYWAQGFYGAPANYSATLSWKL

SEQ ID NO: 18150 - protein, 217 aa, Pseudomonas syringae
MSMRKQTLTAALIAVATAGATLTTPVLAAGTSLEAGNILVRGGFHQVSPKSDNGSLTANDIDVDVGDSTRLSGTLTYMVTPNIGVELLAALPFEHNIRLDGLGKVGSTKQLPPTLSVQYHFSDLGLPFRPYAGVGLNYTNFFDTKTSGPLDGNRLSLDDSWGLGVQIGVDVPVAEDWFVNAEVRYIEIETDAKLNGDDIGTVEVDPTAIGISLGRRF

SEQ ID NO: 18151 - protein, 808 aa, Pseudomonas syringae
MKQALFIGVSAGVMALAAPLAPATAQEGVSNTGVDTITVTAQRRTQSIQDVPLAIEVVTADNIDAIAATSLSDLDQFVPGLDVSGGSPTQPRFSIRGVSTSDFGVGTDPAVGVYVDGIYAARSGASLLAFNDVSRVEVIKGPQGTLFGRNSAAGAISVTSNDPNVEEVEAELGLRLGENNLRRFEGLLNIPFAETFALRLNMVVNQRDGLLTDAATGEDYDRQDNWAVRGAIGWEPTALTDVVFRYTREKLDEDARPAIGITPLPAAPARPGVPVDPSTLLNPFDTPITNDVTSNLEARDLDEASLHITHDFGAFTLQSISAFRYFETSNRQDEDGTNRIELYFDTNNIEQNQSWYQEFRLSGANDRFDWVAGISYYDENATQTSETDAFTDSIETVLFNLGAGTPFTDLQYGLLIPYNLPQRLLGLSWDESMYNRGDFSAFAAFADVEWRITDRFSLIGGARYTRDEKTFSWLNGPRVAPELDQALAELDALGVLALAGVSPADFGFDVVFDLSSAAGLACDNGVTVAEGVVCERSDSWNDISPRLVANFRAMDNLLLFASYTQGYKAGGYNSVEVGSRFENEDVDNFEAGLKWTAPDNSMRVAASIFHYLYKDKQAVRLVNNVGGSGVPQYVVETSDETGTGVDFQVDWAPLAGFEAYLNLQYIDVTFDERITRSGVDLSGQPTGTPEWSISTGASQTWAMPNGSEVELLGAYAYTSERRCNTESRQQLGCAVIGGVQNGEATQRLDLRAYWRDANDRLQLGAYVNNVFDEQYIDGVGTLTADTFGTVHAQITPPRMWGVDLRVRY

SEQ ID NO: 18152 - protein, 347 aa, Pseudomonas syringae
MSKKYIALLPLALVVSTVVSAATVNPFYVGARLGGAHYSNFQQNYQDITGINLNKDDVAAGVFAGYNFTPWFAVETGYTWLGEAKFENNKIKQNAIDLAAKMTWNLNDQWGVFGKLGGSYMLADFHGYGIKDLDDHLLGTAGVGVEYKLTNHLSTRLEYQLYHDIRSKPRDTNLAYNFDTQFYGLSLVYSWGAAPAVVAPVVDTAPPVQAATVTVEPSTVTIAYGVDGKHLTQEDKQRLQPMIQRLTRYPSATVEVTGYTSNTGSVAYNQKLSEKRAKNVADLLSQYVADASQITAKGMGEANPIATNDTAKGRAENRRVEIYSPALKIATEDAAERPDCCAMENNL

SEQ ID NO: 18153 - protein, 762 aa, Pseudomonas syringae
MSAVRGVVARKKRALAFVAGVAGLSLGAAAQAEEAASAAAEAAPELSGVDVTGARHREPESPKFTAPLVDTPRTVTVIPREVIERTAATSLTDILRTSPGITFGAGEGGQPLADRPFIRGQASGNNIFVDGVRDTGGQTREVFSLEQVEVIKGADSAYSGRGSGGGSINLTSKRPRLDSFVGVQASAGTDAYYRAVVDANHQIGETSAVRLNLMGMEADTPGRDAAETSRYGLLAGIATGLGTETRATLLYYRLRTDDLPDYGVPLFTKARDLPRTDSGVLPVPRDSFYGLKARDYQETEADIATFVAEHDVSGAFRLRNVFRASRTLNDYVVTNPGDGGAAQFVAGEWWMKRGTKSRWNPTRTIANVTDVYGKFATGFAEHSYAVGLELSREQNKNASYVVYTAAGSPCPAGFAGASNNAGVGDCTRLFAPNPDDPWQGTLARPTPSRNDAKTTGVYAFDTVSFGDRWLLNLGIRHDRYSVSGTDVSATSAAGVITGETLTHRDGEWEFTNYQAGLVYKPTEHSSLYVSYGTTSTPPTIAAGDQNTGTGTGQGNLANVLLEPEEVTSFEVGAKWALFGERLSASVAYFDLTRENAQIQVSPGVYAQAGEAQVKGVEVGVSGAVTERWQVFGGYTYQDSELVRGAYNVVNVGDPLANTPKHSFSLFTTYDVTDALIVGGGAYHVSKSFGGNQGGAGGGNNLVYAPSYWRFDLFAAYRVTDKVDLQLNVQNVADEDYIVRTNGVHHADYGQARQAILTLNVRY

SEQ ID NO: 18154 - protein, 355 aa, Pseudomonas syringae
MKIRCGVVAATASLIAGTAFAQSNVTLYGVADAGIEYLSNAPSASNGSNLVRMSSGNMSTSRWGLRGSEDLGGGLKAVFELESGFSLDTAVLSSSPRLFDRAALVGLGSKYGLVTLGRQTTPIYDVGLQLDPMGFAPRYSLYRSDDIIAGRADNAVKYRGTFGGLTATALYSFSRTGGGEIPGNFKVDRNIGISLMYETGGLAVGAVYDEFRGSTVATDERKDRRALVGASYAFGPAKAFLGYRWFNGNAGTLAASGANLYWAGLRYSMTPALSLTGAAYYTDTRNSSADPLMFVASADYAFSKRTDVYMNVAYARNKNGSQLGLNGYNSLSGAPTSVAPGKNQVGAVIGVRHKF

SEQ ID NO: 18155 - protein, 800 aa, Pseudomonas syringae
MGNFKRNVLATAIFSANLLSVAGISANAYAAETTDEQNNQGASTLGTVIVTGTRAQERTASASLSPIDVISGDSLRSSGSSELGTVLARLIPSINFPRPSLVDGAELTRPAQLRGLSPDQVLVLVNGKRRHTSAFVNLGGAVGRGSAPADLNAIPLSAIDHIEVLRDGASARYGSDAIAGVINIILKSADHGGSISSKYGQYKKGDGIQRQVSGNTGFALGDNGTLNLSGEGANNDYTNRAGDDLRASSIGSTTYGQQVFRQGEPETHEGKLQYNAEYSFNDAAEFYSFGGYSKRRGETAAFYRPSNASNNIAAIYPNGYLPLIHGTLEDTTFVTGLRGELADDWHYDLSANYGKNSYELRTKTINTSLGLNTPRSFDNGTLTNDQKQLSLDLSREFNATWLPYPVSVAFGAEYLRQGYQIEAGQAESYFQTGSSGLGGFRAADAGSYSRHNFAQYLDVETNLTEKLGVSAAVRHEDYSDFGSNVSGSLSARYDFTPQVALRGSVSTGFRAPSLAQQNFTFTSSQLIGSTIQEAGTFPAGSNVAQLLGAEDLKPEKSRNYSLGLVLQPLDSLTVTADVYRIDIQDRISLSSNLVLNNTAINYLRANGVGDINYTSARYFTNATDTSTDGVDLVANYRYQFDNGVRWNSTVGYNYNHTKVTDVKDNPAILNQLGVNLVRVDRRERIGLLGDTTPQHKLTLGNDLTFGNWALHSNLVRYGEFTSYQADKVNDQTFSAAWLLDLAADYKLKNWVFTLGGDNVTDKYPEKLNDFSSSGGNLAYSTFSPYGYSGAFYYGKVTYNW

SEQ ID NO: 18156 - protein, 703 aa, Pseudomonas syringae
MSSRRIASLAGLAIGVLGSNSYAQEQPQTIELGSVNVTSDYQYETATSPVQGYRATRSATATKTNSAIRDIPQSISVVPASVLKDLGSNSVERALDFAGGVSKQNNFGGLTLYEYSIRGFTTSEFYKDGFSANRGYPTTPDAANIERIEVLKGPAASLYGRGDPGGTVNIVTKKPQREAFTTLQTSAGSWDRYRTALDVNTPLDEQGNLLSRVNLAVEDNNSFRDHVESKRVFVAPSFSWQLNPDTSLLVETEFVRHTSTFDRGVVAPNNKWSGVSRSTFLGEPDDDIDNDNNMVQFALDHQLNDVWSLRLASHYKQGEMSGFASESRPLNADGRTVNRRYRERDNNWHDSITQLELRGRFDGLGVEHEVLIGTEYENYRKNERVTTIAGSPYAIDIYNPVYGQPKPNGARSGTDFYEHIESRALNLQDQIVFTDKLRGMVGTRIEHFDQQVDDFTTNATSGQRHDAFTQRAGLLYQLTPQVGLFANASTSFKPNNGLDAAGKTFDPEEGVGYEVGIKSELFDDRLSTTLAAFHIEKENVLALDPGTDTNRAVGKARSQGFDLQFTGQVTDAVRIIGAFAYIDAEVTKGDRTIPSGSRILGVAKHSGSLLSVYEFQEGVLRGSDVGAAYTYVGDRSGQSGTDFELPAYQTVDLLAHYKASDNVTVGLNLNNIFDEKYYERSYSNYWVAPGEPRNFTVSLTLSL

SEQ ID NO: 18157 - protein, 790 aa, Pseudomonas syringae
MRVNSFLRRCTCAVVSTMMAPLALAQQDVNLAESQTSSQMVLEEVIVTAQKREQNLQYIPVSVLVLSNERLQNADINTIEELQTYVPNLMVTDTLLGPKLHIRGIGSAVNQGFEQSVGMYIDGIYRGRAQQSRMAMIDVERVEVLRGPQSILLQKQHCRGTEYFHGHANRNFEAGITGLYSPDFEQKEVTAYISGPLSETFSGRLTAHARDMDGYMENLTLDKDEPNRKERLVRGILDWHPNDDLDITLKVEAGRYDTIGEQMEIINDRAAEAGPFTGLNYAQILQLFGQDPSVANNFQDFKRASNGDDFSNDTEEFVLTLNYRNWGDLLLTSITGYTAYDMVEICDCDNTGGHVFSADFREDFQQFSQELRLTSPGGAKIDWMAGLYYQSSDLDFFDAVRLPANSILVPLIAGIAGPAAGALMANTSAPRFFDQDTDLISVFGQVSWNINDRWFITGGARISREQKDASRILEIADIHGGPLPPATAPITESLYAAVFNITPHSLKGDRDKTRFMPSLDIQYDVNDNAMVYFSTSMGVKSGGFDVRSNNAPDNGGSFEFDDEDAVSFELGSKLSFSDGVAELNIALFYMDFSDLQVSAFDGVLGFTVGNAAKAVTQGLELDGRWLVTDHLLLSGSFAYTDFEYKEFFGQCYFGQVPDAPDGVNCDYRGETNTLTPEYSGIVSAQYKSPLGNTLRWGWSIDALFSADYLTSSNQDPLQVQSSYTKFNARLSLAGQSGRWEVALVGKNLTDETIMTLSGDVPLAGATFGTPGFSAFYEQPRSIALQVTARY

SEQ ID NO: 18158 - protein, 343 aa, Pseudomonas syringae
MKLKNTLGLAIGTIVAATSFGALAQGQGAVEIEGFAKKEQFDSARNFKNNGNLFGGSVGYFLTDDVELRLGYDEVHNVRSDDSRKIKGANLARDALSHFNCPGDMLRPYVSAGFSDQSIARWSGGRNRHLANVGTGGKLYFTENFYARAGVEAQYNIDQGDTEWAPKRGMGVNFGGGSKKVEAAPVEAAPAVCSDSDNDGVCDNVDKCPNTPANVTVDANGCPAVAEVVRVQLDVKFDFDKSVVKPNSYRDIKNLADFMKQYPQTTTTVEGHTDSVGPDAYNQKLSERRANAVKQVLVNQYGVGANRVSSVGYGETRPVADNATDAGRAVNRRVEAEVEAQAK

SEQ ID NO: 18159 - protein, 714 aa, Pseudomonas syringae
MNAPFFRLSLLSLTLAAGFAHAAENNANVALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYSRNDEKDYEAGKGFRNNFNGGKTVPYSALDKRSYLAKIGTSFGDGDHRIVLSHMKDQHRGIRTVREEFTVGGDKERISMKRQAPSYRETTQSNTNLAYTGKDLGFVEKLDANAYVLEKKRYSADDSGSGYAGNVKGPNHTQITTRGANFNFDSRLAEQTLLKYGINYRHQEIKPQAFLNSQFKIEDKEKATDEEKNKNRENEKIAKAYRLTNPTKTDAGAYIEAIHEIDGFTLTGGLRYDRFKVKTHDGKTVSSSSLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFKNPNLEIGWRGRYVQKAVGSILVAGQKDRSGKLENVVRQGFGVNDVFANWKPLGKDTLNVNLSVNNVFNTFYYPHSQRWTNTLPGVGRDVRLGVNYKF

SEQ ID NO: 18160 - protein, 704 aa, Pseudomonas syringae
MHNNRFKLSALLVSVLSSTSVWAQDTNETTIDESIEVVGDFQKQTITQTTRSIAIVDENSMQQRASRHLQDVLNSVANVNFSGGSSTARFIQIRGIGERSQFVDAINPSVGLVIDGIDYSGLGSAATLFDVGQVEVYRGPQSGRFGVNGLAGMVLLESNQPTEVTSGEWLIGVGNYSESTLAGAVGGSLGALGNARLSLMQFDQDGYTENTFLNRDDTEQRDEFTARLSIDTQLGQDWLLKTRIHKMDIDNGYDAFSLENDRTTLSDEPGFDRLDSTAGRLQLDYSGFEKFTIETAVNVLSADKDYAFDEDWTYVGIAPGWEYSSFDAYYRERDDVTAEVRFTSDAPINLWGLPTDWTVGVYYYSKDVNLTRDYYNWDIGSPSIFGSSYETQNQAIYGELVQQVNDNWSWIGGLRIERYDNDYVDSNGVVAEPSDTMVGGNLSLRYQYAPQSYAYATLARGYKAGGVNGEALGRAKDQQLDELEAYLLDRATFAPEILWNAEVGMKATRSDWSYRVAAFYNWRDDVQLKSWVNRNQSFVGYIENAAQGSNYGLEAELRYRLSDSISAFASLGWLDTEIDGFVTEDGRDMSGRDQAHAPNYQANIGLEGQLTNALSWSVQTDLKDGFYFSNSHNQQADSMALLHAQLNYDWNQWRFTLWGRNLTDEDYEIRGFYFGNDPRDEYVTETYVQYGEPRRFGLTARYTF

SEQ ID NO: 18161 - protein, 944 aa, Pseudomonas syringae
MQSRTPPLRQELQQGSQAPQKQHAIPKTRLAARLSAISLAMMVAGFSTSALAVGKLEGQIRDNVSQQPLAGATVTLKELNLSQQAGRDGRFFFVGVQDGDYTLVVNYLGAMPLEHSVSIRDKQTTLQDINLSSQDVEHIRVVGQQGALSKSMNRQRGADNVLSVVSADVLGNFPDSNISESLQRVPGLSIERDQGEGRFVRVRGMAPDYNSVSMNGTRLPSPESDRRAVALDVVPSDLLQSVEVSKTLTPDMDADALGGAIEVKSLSAFDRDDTYLNLNAEASQDTLTDNTNPKLAASYSDIFADKLGVAIGASWYNRDFGSDNVETGGKWEFAGDNGLEDAALESIDARDYEINRERLGIGVNFDYRPSDDTDLYLRTLYSEFDDTETRNSAKTKWKSPQQANALSQGKTTRSLKSRTENQNITSFVLGGQTRFERWTFDYQASHSTASAEKPRDIAGADFVAKIDNTGFSNTKQPQIIAPEDYFQNANFELDEIEIAASKAEDTINSGQLDLTRQLTLADYSVELKTGVKLSRRDKSNREDIWIYSDLGDQGVSDDDLLLSQYAGNELDYDLGRFGSGINAAPLWQLIDSLDADSNRDDIESTINDFDISEDINAAYLMGHIDIDKLRILTGLRFEQNQWDSSGYGYDGAKGEFIDIKHSRDEDHWLPALHLTYRYSDNTVLRAAWTNTLVRPTFGQLAPGYLLEEDDGDIDLTFGNPQLKSLESMNFDLSLEHYFGNIGLISAGLFYKDIDNFIYQADLAGRGDYVDAHSAVTFVNGDSADIYGVELSYVQEFNFLPEPFNALVLNSNLTYTDSSAKISWLEDGQLLSRDIPMPSQSDLTANLSLGYENSYASVWLSAAYKSEYLQEVTELSDERYDLYQDNHLQWDFVAKAHLTSNLTLYFKGVNLTDEPYYSYTGDSAYNAQYEAYGRTFQLGVQYTNY

SEQ ID NO: 18162 - protein, 410 aa, Pseudomonas syringae
MNRTHFMSAAWLATLALPMPALADFIGDSHARLELRNHYINRDFRQSNAPQAKAEEWGQGFTAKLESGFTEGPVGFGVDAMGQLGIKLDSSRDRRNTGLLPFGPNSHEPVDDYSELGLTGKVRVSKSTLRLGTLQPILPVVVYNDTRLLASTFQGGLLTSQDLEGLTFNGGRLTKANLRDSSGRDDIGYGAATSDHLDFGGGSYAITPQTSVSYYYAKLEDIYRQQFVGLIDTRPLSEGVSLRSDLRYFDSRNDGAERAGNIDNRNFNAMFTLGVRAHKFTATWQQMSGDSAFPFVNGGDPFTVNLVTYNTFTRAGLDSWQVRYDYDFVAMGIPGLSFMSRYTDGRHAQTATVSNGRERERDTDITYVIQSGPFKDVSLRWRNVTFRSGNGLTNAVDENRLIIGYTLALW

SEQ ID NO: 18163 - protein, 684 aa, Pseudomonas syringae
MSGQQHSSDNKNWAEKGIVIREVEILGKRPMKDIGVQQTRFDSLVLKENIALSMADILTFNSSIFVKSYGRATLSTVSFRGTSASHTQVTWNGMRINNPMLGMTDFSMIPSYFIDDASLLHGTSSVNMAGGGLGGLVKLSTVPAHQEGFGMQYVQGIGSFSTFDEFLQLKYGDKHWQISTRAVYQSSPNDYKYRNHDKKENIYDDKYNIIEQYYPIERNRSGAYKDLHILQEVYYNTGKGDRFGLNAWYTDSNRELALLTTDQGDLMDFENRQREHTLRSVLSWDHTRENWKVSARGGYVHTWLAYDYKRDLGNGIMATMTRSRSKVNTFYGQLDGEYFFSDKLLLTAGVSAHQHLVNSLDKDLNKDDNKNDKYGQGRKNDSIVYFDKGRIELSGNVSLKWQPVNRLGMSLVLRGEMFGTKWAPVIPAFFVDYVLSKRGNIMAKASITRNYRFPTLNDLYFLPGGNPALNNESGFTYETGLSFSVDKDNVYTLSGSASWFDQHINDWIIWLPTSKGFYSPVNLKKVHAYGVEVQADYAVAIDKAWKLGLNGTFAWTPSINEGEPTSKADQSVGKQLPYIPEYSATLSGRLTYRSWGLLYKWCYYSERYTMTSNAVSYTGHLPPYLMSNVTLEKGFSLRWADLSLKGTVNNLFDEEYLSVLSRPMPGINFEFFIGITPKWGKKKK

SEQ ID NO: 18164 - protein, 1673 aa, Pseudomonas syringae
MRVLTQNSPFGRRGVAGWSMFRRLEAQGREWLRQGLLAVLAIWLTVLSQGALAAACTVSFSTNMNAQKSYVFTAADTSNCDPFLSGIAYDSSGGTNSSSGPLFLTATAQGGKVAIYSGSVPPSGDPYTNGFVYTPPSNFSGTDTATFYTSNDSVTWVPNGIVSIAVIPTAPTVTGIAPNTGTTGGGTSVNISGTNFTVATAVKFGATNATNFTVNSATQITATSPAGSTGVVDVTVTNGGGTSTTSAADRFTYVLPPTAGPTSITVAHGSTNNHATVDVTGATSVAVGTQPTHGTATVSGGSITYTPNPSYSGMDSFTYTASNAGGTTAPATITVTVSNATVNYAPSSPAGGTVGAAYSQSLASASGGTAPYTYTIASGALPPGLTLTSNGMLSGTPTADGSFNFAVTATDSSTGTGPFSATSSTLSLVIGTPTITVSPVSLTNATVAAAYSQTITASGGTGPYTYAITSGALPAGLTLSSGGVLSGTPTAGGTFNFTVTTTDSSTGTGPYTGSRTYTLVVNAPTLALTPASGSLSASTGVAYSQTFTGSGGLAPYTYSLAVHSGTMPTGLSFNTGTGVLSGTPTTTGVVNFSVTATDHATGAGPYSTSGTYTLTTSAPTITVSPTTLSAATVGAAYGQTAAAGGGAAPYSYALTAGALPTGLSLNGSTGAITGTPTAGGTFNFAVTATDANSYTGSRAYTLTVNAATVSVSPSTLPGGTIATAYSQTMLASGGTGPYTYAVTAGSLPTGLTLSSNGTLSGTPTAGGVFNFTVTATDSSTGTGPYTGSRAYSLTIGSPTLTITPASGSLSGVAGTAYSRNFTASGGTNPYTYGFVVNSGTVPTGLTWNGTTGRLAGTPTTAGTVSFTVTATDSSTGTGAPFAVSGVYTLTIAAPSLTVSPATLPNPGIATAYSQTITAANGTAPYTYAVTAGALPAGLSLNTSGFLSGTPTAGGTFNFTITTTDANSFTASRAYSVTIGAPTVTVNPAAATSAQVTTAYSQTFTATGGTAPYTYAVTTGTLPAGLSLNASTGVLSGTPTTLGSSSFTVRATDSSTGTGAPYSGTRSFTITVGQVIGTAPAITATTMSTAPITLHATANATGGPFSSVTIVNPPASGTAVVNGLDIVYTPTQTTSGAVNFTYALINTAGTSAPIPVTVNVNAVPIAVAQRQAITSSGQGVSVDLTEGATGGPFTAATLVSVVPYNAGTASIVQKAIQTPAGLKPQAVAASTYVLNFTPSGTYSGQAVLTYTLSNAFATSTAATVQVSVAPRKDPSADPDVAGLINAQVQAARRFATTQIDNYNRRLEALHGTGRPPSSNGLTVAMPGQRADMQARCQDVAGISAHDACMRGDGQGVRPFARGKRNADAASGSTDKSTADAGPDLPGADAASAGPDNTDPNLAFWSAGTLDFGFASAGTQRSGFRFTTGGVTAGADYRVSDQLSIGGGFGYGRDSTDIGNAGTRSTGDSYSLALYGSYRPLPSLFVDGVAGFGTLSFDSRRWVTDSNDFATGKRSGKQVFASVSAGYEHRDRAWLISPYGRLSVSQSTLDQFTESGAGINALTYFDQTVTTVSGTLGLRAEYTQKTKWGTFLPFARVEYQHDFNGQSNAGLAYADLASAGPAYYVPGTPFGRDRMQIGLGTKFRTGPLTFGLDYSVMAGMGGLQQGVRLTFAAPF

SEQ ID NO: 18165 - protein, 453 aa, Pseudomonas syringae
MKKINKGKSLSRFQLVSTLSVLGAMGLAGSVHAADAFSADSPWMTGDWNGKRTELLDKGYDFSLEYVSEMASNIKGGYNDDKTGRYSDQFALGMKVDLQKAFGWQDAEFKLAITERSGRNISNDRIGDPRAGTLSSSQEVWGRGQTWRLTQMWIKQKYFDGALDVKAGRFGPGEDFNSFPCDFQNLSFCGSQVGNYVNTWYNWPISQWALRVKYNITPEVYAQVGVYEQNPSNLETGNGFKLSGSGTKGMILPVELVWTPTVNSLPGEYRVGFYKSTPNADDVYEDVNGQPQAATGAAFKSHDSKHGWWVVAQQQLTTHDGDASRGLSIFANATVHDKATNFVDNYQQIGFTYKGPFNSRPKDDIGIGIARIHVNDDVQDRVRLANQISGINDYDNPGYLPVQSTEYNSEIYYGFHVTNWLTVRPNLQYVKHPGGVDQVDDAIVAGIKIQSKF

SEQ ID NO: 18166 - protein, 857 aa, Pseudomonas syringae
MSSTFTPAVQNRARLRLSLLTVAVLGASLQAIPAHAAAETNRSVRPAGTYSFSIGPQSLVSALNEFSRITGWQVGVSSDFAQNVTSPGARGNLSPAQALDALLAGSSLSYRNLGNNNAVLEKRAAGVMALDQITVSATRQAQEVVTVPSTVSVHSREQLDRNNVNTIRDLVRYEPGVSVGGAGQRAGTTGYNIRGIDGNRIMTQVDGVEVPDSFFTGPYAQTHRNYVDPEIVKRVEILRGPASALYGSSAIGGVVSYYTLDPDDIIKPGKDVGARLKTGYSSADESWLNSATVAGRQGEFDGLLHVSQRNGHETESYGETGGTGLSRTEANPEDARSTNVLAKLGWNYADGSRLALAYEKYKDDRNTNLKSAVGGPFTNGSGLGMYQSRESNDTISRERFGIENSFALDSLLADNLKWSLNYQTAKTDQSTQERYFPFSRDVYRQRETQYQEKQWIFDAQLDKAFSIASTDHVLTYGTTLKQQKVTGLRSGSGTCARVFGTCRVVGADSPSDRLAATSDFPDPTITSYALFAQDQISWKDWTFMPGVRYDHTRLDPKFTPEFLRSVSLTDPSQANDETRTWHRLSPKFGVTYAFSDAYTWYGQYAEGFRTPSAKALYGRFENPTAGYVVEPNPNLEPETSKSYETGLRGRFESGSFDIAVFHNKYRDFINEDAITPGYSELTFQSSNIKHATMKGAEVKGRINLDSLGAPNGLYSQASVAYVHGRNNDTGEPINSVNPLTGVIGLGYEQRDYGSQLSWTLVKRKTRVDDSSFHSPDGTSSQFKTPGFGILDLTGYYKVSDDVTVNAGLYNLTDKKYWRWDDVRGYDGVGEAGVTAPANLDRLTQPGRNFSVNVVWDI

SEQ ID NO: 18167 - protein, 782 aa, Pseudomonas syringae
MSARPTQLSPLVRTLRHVIFGASLSVGSLSMAYAADVAPKVYHIAPSELEAALSQFGRESGVLISYGSQITSGLKSRGLEGQYTPEQGLNALLEGTGLQAMADGNNGFTLQSASAAGAPIELGASTVIGDWLGEAQQTNVFEHPGARDVVRREEFERVGATSAREVLNRIPGVNAPDNNGTGSHDMALNFGIRGLNPRLASRSTVLMDGIPVPFAPYGQPQLSFAPISMGNMDAVDVVRGGGAVRYGPQNVGGIVNFVTRAIPDAPTLKGGIQTETSPSSSHDGFKTTGNLLAGGTADNGLGGAILYSGVRGGDWREHSDTQIDDLILKGKYQIDEANSLNATAQYYEGEAQMPGGLSVKDYDADPYQSTRLKDKFWGRRTLFNFGYRYEEDARVFTANTFFTKTLRSGYLDQGSFVSLSPREYWVRGLETRFSQGFALGETWHEVGVGYRYVNEAGHELRYREPVTGNLPTTASRNDRDTRGATEAHAFYIDDRIDIGKWTITPGVRYEMIDTAQNNNLTNARYQGDYSTALPALNVLYHLTDTWNLYANTEGSFGSVQYSQMPNRVTGDEVKPEKARTWELGTRYDNGNLRAEIGAFLINFDNQYDSNQTNDTVIARGETRHQGIETSVNYALEGLNPILAGYDVYATYAFVDATIREDGPNKGNRVPFSSKHKGTMGVSYTEGPWKLNFDSSFQSDQFADNANTAAESADGSTGKIPGYMLFSTRANYDFGPQLSDLNVAVGMKNIFNRQYYTRSFDDNNRGKYVGEPRTVYVQTSVAF

SEQ ID NO: 18168 - protein, 140 aa, Pseudomonas syringae
TGDSTQVYRLGLQSNWDASWWQTSVGRLTGYWDGAYTYWDGDETASNHSLSFAPVFVYEFAGESVKPYIEAGIGVAAFASTELESNELGSSFQFEDRIGFGLRFAGGHEIGVRAIHYSNAGIKQPNDGVESYSLHYRMAL

SEQ ID NO: 18169 - protein, 422 aa, Pseudomonas syringae
MTSHTSRSRILLGVGGMTLIFPMLSMAEGFVDDTKATLTLRNAYFNRNFTNPAFPNSAAPQNKAEEWTQNFILDAKSGFTQGVVGFGVDVLGLYSLKLDGGKGTGGTQLLPIHSDGRPADDFGRLGVAGKARVSKTELKVGEWMPVLPILRSDDGRSLPQTFQGGQVTSREIDGLTLYGGQFRGNSPRNDASMEDMSMNGRGAFTSDRFNFGGGEYVFNDKRTQVGVWYSELQDIYQQQYFNLLHSQPIGDWTLGANLGFFTGKEDGNKLAGDLDNKTTYALLSARYGGSTFYVGLQKLTGDTAWMRVNGTSGGTLANDSYNSSYDNAKEKSWQLRHDYNFAVLGVPGLTMMNRYISGDNVHTGTITDGKEWGRESELAYTVQSGALKNLNVKWRNASIRRDFSVNEFDENRVFISYPISLL

SEQ ID NO: 18170 - protein, 796 aa, Pseudomonas syringae
MKFSPRCVPLWLGLATLPAIAVAPLACAAEQQQAYAFAQPAQPLAQALNAFSRTTGQSVVYTLELPGVQAPALNGRYSAEQALQQLLGTSGLAWRRVDARTFTLEAADTSGALNLQATTVTSQLDDYSYQPPASASIMRGQGPNQDIPQAINVVPAQVIRDQAPRNLDDALANVSGITQGNNFGGTSDTVMKRGFGDNRDGSIMRDGMPIVQGRSLNASTERVEVLKGPASLLYGIQDPGGVINVVSKRPQLQQYNALTVRGSTYGSGKNGSGGGLDSTGALGDSNFAYRLVVDHEDEDYWRNYGVHRESLVAPSLAWLGEDTQVVVAYEHREFLYPFDRGTAFGNNGHPLNIPATRRLDEPFNDMEGRSDLYRLEVDHQLADDWKLHFGYSFNRETYDASQVRVTAVNEAKGTLTRSIDGTHNAMSRDQFATVSLAGNVEVAGMQHDLLFGIDHEDRKIFRGDLIRQTAKSTFSYVDPVYGQEVEGSTVRASDSDQTDKLRTDALFVQDALHLDEHWILVAGARFQQYDQYAGRGRPFHVNTDISGQAWVPHAGIVYKVDDQLSFYGSYSESFKPNSTIAPLTGNIVLDSSVAPEEGKSWELGAKLDMPGRITGTLALFDITKRNVLVSNFDASTSETVYSNAGEVNSRGVELDLTGQLTDRWSLIGSYAYTDAKVTKDPDLQGNRLQNVAKHSGSLSAVYDFGSLFGGDKLRVGAGARYVGERSGNSTNTFDLPSYTVADAFASYETKLDEHNVRLQLNVKNLFDKVYYSSAVNQYFVAIGDARQVSLSSTFEF

SEQ ID NO: 18171 - protein, 706 aa, Pseudomonas syringae
MFRKSSLYVRAGLGFAAFSLALPSFAADVPPAIDDSTLATLPQVTVKATKRKPALHQQTNSGALGSHAVIDTPFSFKSVGSDEIQARQAGILSEAVKYDASVTSISSSYGTHPATLAVRGLPLDDLNGYKVDGMANINRGVEMPLEMFERVDVLKGLSGFMYGFGSPGGIVNYVTKRPTDKTTLSVDAGYQSDNVYKEHLDAGGRLDDPRFGYRVNVVHEEGDAASGDAKVNRTAVGVALNAQLSDDLSVDFDTLYQKRNTSGGTDIIVNTKNALPSPIDGSKRLYSNGSYTDVDYSLSTVSATYKFSPDWTGKLAYRYSDSTRRYVKDQYQISSDAGAYTDKVTSEYHAYDYNDTMGTLEGKFTTGWFTHDVVLGASYSQLNSDKSVVTPKTTVGKGNLYNPTIFSVYNIDYSGGTYGDDNVKESAVFASDTIGLGEHWSLLAGLRNENYREQTHDSATSAVTPYKARPATPTVALMYKPTQDVTLYASYVESLESGGTAPSSAVNSDQTLSPLLSKQYEVGVKAQQRNWSATAAAFRIDRGAEYTNDANVYVQSGTIRYQGLELNASVDATPDLTVEGSVMSLDSAYHDAGDGVDGNRAAGAAHYQAATQVTYRVPVVPGMFLHTGAQRIGEMAVDSGNVHTLPAYSLFDAGGGYRLRLGDGHALTLGANLTNLANKKYWTYYQENYLQPGSPRTLSLNTRYDF

SEQ ID NO: 18172 - protein, 737 aa, Pseudomonas syringae
MDLLFKSDSRADHHLLKCGPRFTLLALSLGMLAGCTINTNPTALPKPIREPQSQSVINETLQNEQAQDPAQRKRDRFGITPNQRQSVRVITPDDSTLGEGLRGDAISMNVNNFPLPAFINEVFGNRLGLSFTMTPELQKKSDLVTLRMSDPQTPSVLFNTARNVLSDYGVEVKLRDGLYTFNVAQTVANDALPIMVSGGALPDVPMSHRPVFQIVPMKVVRSDQMAAWLAEMFENSQLKIKDDRVINALMLRGPVELVKQASEAISLFDQPALKSSHSLAISPVYSDAEQLGNALMKVLQSEGYDVSDSPPFGGVLVLKMKELQRIIVFAAEPRVLSHIRQWVEVLDRESQEKVENGLFIYQVRNTQAAAIATMLGALGYGANIPATGVNSTNTVTATGEQSGAGSLTAASPATSAPTSIAPKGEQGSVVVDGNRNALIFKGSGREWVTLRPLLDELDKPVPSVMIDVLLAEVSLNDKEGLGVDWSNIHTDLGAKDLIMSTANGIGNSGLNLTLNSAGQTRAKLNAFYENKQAVIRSSPKLMVRSGEEARIEVGNEIPVVTGTSQSTDNPDAPINKTVQYRKTGVILTIKPTVQASGVVDLTISQELSEQADTSTSTDALSPTIMNRKVNTALTLRDGGSVMLAGLISSTKGEGDTGVPLLGDIPWIGSLFKSKSNSQNRTELVVMIIPYVLRDFHEAQSLTERYQQQLELNNAPTLKRRFLPGMEPKETTPSRVEQ

SEQ ID NO: 18173 - protein, 272 aa, Pseudomonas syringae
MNLPFRAMVSDLDGTLLTPEHLVGDLTIDTLRALEQKGVDIILATGRNHTDVSSILGKIGAERAVMITSNGARVRDLQGNLLYSNSLPEELVLELYKTPFDTSKVCMNSYQDEGWFTNKDIPAMRQFHKESGFDYNVVDFSKHHGRGTEKVFFIGKTPEDLVEVETYLRDKFGDVTTIVYSALACLEVMNKNVSKGDALKHLLESREYELKDCIAFGDGMNDVEMLSWAGKGCIMKDADIRLKMACPELEVIGSNKEESVARYLRTQFGLDY

SEQ ID NO: 18174 - protein, 270 aa, Neisseria flava
MNPAPKKPSLLFSSLLFSSLLFSSLLFSSAAQAASEDGSRSPYYVQADLAYAAERITHDYPQATGANNTSTVSDYFRNIRTHSIHPRVSVGYDFGDWRIAADYASYRKWNDNKYSVNTKNVQVNKSNGNRQDLKTENQENGTFHAVSSLGLSAVYDFNTGSRFKPYAGVRVAYGHVRHSIDSTKKTTNVLTVPTNIPGGTPTIYNQGSTQDAYHESHSIRRLGLGVVAGVGFDITPKLTLDTGYRYHNWGRLENTRFKTHEVSLGVRYRF

SEQ ID NO: 18175 - protein, 511 aa, Neisseria gonorrhoeae
SLVWLLGYEDMERSSAQDSEVGLDPWDGATYFLDGTGAESFSTEVQLQSDEYGDFIWIVGANYFHEKTTTLGYYDNPMDDKAFWDQPDRSTDAFALFGQGTYKLTDKLHATFGYRFSDETKQDKGGRTYRCSNADGCAVGWLNRTDLNNLPVDYYEDPSIYASYFENDNKGSWQHHDFRVGLDYDVSAQTMIYTYLASGFKAGGIGDVYEVVNDRTGDVTRFETKFNPEEVLTWEIGAKSSFFDNSLNLKAAFFYTDYTDMQYASVGSIGNVERLSVVEDDNGSPILDENGEPVLDFQNQPVIAYYTQNVPGSTIKGIEFEYDWKPYPNGRITGYVTWTDAKISEDWQTKWDYDSEYLFDISYEESIDPENTLLATNLKGNNLAMTPKYTANISYTHTFNLGEYGFIHSWLNASWKDESYSTVWNVDKHLDDMDFSVSDEAAQYIDDSRDAFAVYNASIKYEPQGQSWYAEVFVNNASDETIQYWNNTSKGVPKGSFGMPRYYGVRAGFSF

SEQ ID NO: 18176 - protein, 319 aa, Neisseria gonorrhoeae
DVTLYGTIKAGVQTYRSVEHTEGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDGQVYSMPSFVEKLQVHRLVAGYDNNALYASVAAQQQDAKLYNSHNSQTEVATTVAYRFGNLTPRVSYAHGFKGTVDSANHDNTYDQVVVGAEYDFSKRTSALVSAGWLQKGKGADKIVSTASAVVL

SEQ ID NO: 18177 - protein, 317 aa, Neisseria gonorrhoeae
DVTLYGAIKAGVQTYRSVEHREGKVVGVGTGSEISDFGSKIGFKGQEDLGNGLKAIWQLEQGASVAGTNSGWGNKQSFIGLKGGFGTIRAGSLNSPLKNTGSKVNAWESGKYTGEFLEISKMAEREHRYLSARYDSPEFAGFSGSVQYAPKDNSGSNGESYHVGLNYRNNGFFAQYAGLFQRYGEGTKKMEGYSYNIPSFVEKLQVHRLVGGYDNNALYASVAAQQQDAKLYNSHNSQTEVAATVAYRFGNVTPRVSYAHGFKGTVDNADYDNTYDQVVVGAEYDFSKRTSALVSAGWLQEGKGADKIVSTASAVVL

SEQ ID NO: 18178 - protein, 329 aa, Neisseria gonorrhoeae
DVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYEHQVYSIPSLFVEKLQVHRLVGGYDNNALYVSVAAQQQDAKLYGARRANSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 18179 - protein, 328 aa, Neisseria gonorrhoeae
DVTLYGAIKAGVQTYRSVEHREGKVVGVETGSEISDFGSKIGFKGQEDLGNGLKAVWQLEQGASVAGTNTGWGNKQSFVGLKGGFGTIRAGSLNSPLKNTKDNVNAWESGKFTGNVLEISGMAQREHRYLSVRYDSPEFAGFSGSVQYAPKDNSGSNGESYHVGLNYQNSGFFAQYAGLFQRYGEGTKKMEGYYLYNIPSLFVEKLQVHRLVGGYDNNALYASVAAQQQDAKLYGTWSANSHNSQTEVAATVAYRFGNVTPRVSYAHGFKGTVDSADHDNTYDQVVVGAEYDFSKRTSALVSAGWLQEGKGADKIVSTASAVVLRHKF

SEQ ID NO: 18180 - protein, 319 aa, Neisseria gonorrhoeae
DVTLYGAIKAGVQTYRSVEHREGKVVGVETGSEISDFGSKIGFKGQEDLGNGLKAVWQLEQGASVAGTNTGWGNKQSFVGLKGGFGTIRAGSLNSPLKNTGANVNAWESGKYTGEFLEISKMAQREHRYLSVRYDSPEFAGFSGSVQYAPKDNSGSNGESYHVGLNYRNNGFFAQYAGLFQRYGEGTKKIEYEYQVYSIPSFVEKLQVHRLVGGYDNNALYVSVAAQQQDAKLYNSHNSQTEVAATAAYRFGNVTPRVSYAHGFKGTVDSADHDNTYDQVVVGAEYDFSKRTSALVSAGWLQEGKGADKIVSTASAVVL

SEQ ID NO: 18181 - protein, 319 aa, Neisseria gonorrhoeae
DVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYDGQVYSMPSFVEKLQVHRLVGGYDNNALYVSVAAQQQDAKLYNSHNSQTEVAATAAYRFGNVTPRVSYAHGFKGTVDNANHDNTYDQVVVGAEYDFSKRTSALVSAGWLQEGKGADKIVSTASAVVL

SEQ ID NO: 18182 - protein, 319 aa, Neisseria gonorrhoeae
DVTLYGAIKAGVQTYRSVGHWEGKVVSVETGSEISDFGSKIGFKGQEDLGNGLKAVWQLEQGASVAGTNTGWGNKQSFIGLKGGFGTIRVGSLNSPLKNTGANVNAWESGKYTGEFLEISKMAEREHRYLSARYDSPEFAGFSGSVQYAPKDNSGSNGESYHVGLNYRNGGFFAQYAGLFQRYGEGTKKIEYDNQFYSIPSFVEKLQVHRLVGGYDNNALYASVAAQQQDAKLYNSHNSQTEVAATAAYRFGNLTPRVSYAHGFKGSVRSADYDNTYDQVVVGAEYDFSKRTSALVSAGWLQEGKGADKIVSTASAVVL

SEQ ID NO: 18183 - protein, 697 aa, Neisseria gonorrhoeae
MNPAARRRCLPLSALLLSPWAAVAEPAPTALPAVQVQAARVPGIDPFALPASQDTVWIDASRAGTGAQLSEALAGVPGLLARDRQNFAQDTQLSIRGFGARSTFGVRGVRVLIDGVPATMPDGQGQLSHASLLGAERIEVLRGPFSALYGNSSGGVLQVWSAQGQAGDPWRLRVNAGADNTLSVGAQLKGAGQVLDYNIAANHFRTDGWRDHSRARRESLNARIGGELGGGRLELLLNALDAPDAQDPLGLTRAQVAADPRQATAVAHQYNTRKTVRQQQAGLRWTRETGAQRWQLMGYAGQRAVRQYLPIPPAPQTNSPLHAGGVIDLQGGYGGLDARWGWHGDLAGRPLDLVAGLSADRQRQHRTGFENFIGSALGVRGRLRRDQIDVVQNVDQFTQAWWQWSPRWSLLAGLRHSAVRFESNDRYIVGANPDDSGHRRYQATTPVAGVSFEASPQWRLHAAVGRGFETPTFNELGYRADGQAGLALDLAAARSRSIEVGSKWHAQDGNQLDISLFRADTDDELAVASNIGGRSTYRNIGRTRRQGLELQYRQPLAEHLELQLAWTWLQAQVRSPYLTSNTLVAAGSRLPGVPRQQAFARLQWSPADWQWALEATASSDTVVNDVATERAPGYALLHLEAGRRWTLPGGELRAFARLENVLDQAYIGSVIVNDGNGRFYEPGPGRRANVGLQWSWR

SEQ ID NO: 18184 - protein, 714 aa, Neisseria gonorrhoeae
MNAPFFRLSLLSLTLAAGFAHAAENNAKVVLDTITVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNNEKDYEAGKGFRNNFNGGKTVPYSALDKRSYLAKIGTSFGDGDHRIVLSHMKDQHRGIRTVREEFTVGGDKERISMERQAPAYRETTQSNTNLAYTGKNLGFVEKLDANAYVLEKKRYSADDKGSGYAGNVEGPNHTRITTHGANFNFDSRLAEQTLLKYGINYRHQEIKPQAFLNGEFKIKDKSGATQAEKQKNRDDENIVKAYRLTNPTKTDTGAYIEAIHEIDGFTLTGGLRYDRFKVKTHDGKTVSSSSLNPSFGVIWQPHEYWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFKNPNLEIGWRGRYVQKAVGSILVAGQKDRQGNLENVVRKGFGVNDVFANWKPLGKDTLNVNLSVNNVFNTFYYPHSQRWTNTLPGVGRDVRLGVNYKF

SEQ ID NO: 18185 - protein, 943 aa, Neisseria gonorrhoeae
MNKKHGFPLTLTALAIATAFPAYAAQAGAAALDAAQSQSLKEVTVRAAKVGRRSKEATGLGKIVKTSETLNKEQVLGIRDLTRYDPGVAVVEQGNGASGGYSIRGVDKNRVAVSVDGVAQIQAFTVQGSLSGYGGRGGSGAINEIEYENISTVEIDKGAGSSDHGSGALGGAVAFRTKEAADLISDGKSRGIQAKTAYGSKNRQFMKSLGAGFSKDGWEGLLIRTERQGRETRPHGDIADGVEYGIDRLDAFRQTYDIKRKTTEPFFLVEGENTLKPVAKLAGYGIYLNRQLNRWVKERIEQNQPLSAEEEAQVREAQARHENLSAQAYTGGGRILPDPMDYRSGSWLAKLGYRFGGRHYVGGVFEDTKQRYDIRDMTEKQYYGTDEAEKFRDKSGVYDGDDFRDGLYFVPNIEEWKGDKNLVKGIGLKYSRTKFIDEHHRRRRMGLLYRYENEKYSDNWADKAVLSFDKQGVATDNNTLKLNCAVYPAVDKSCRASADKPYSYDSSDRFHYREQHNVLNASFEKSLKNKWTKHHLTLGFGYDASKAISRPEQLSHNAARISESTGFDEKNQDKYRLGKPEVVEGSVCGYIETLRSRKCVPRKINGSNIHISLNDRFSIGKYFDFSLGGRYDRKNFTTSEELVRSGRYADRSWNSGIVFKPNRHFSVSYRASSGFRTPSFQELFGIDIYHDYPKGWQRPALKSEKAANREIGLQWKGDFGFLEISSFRNRYTDMIAVADQKTKLPDSAGRLTEIDIRDYYNAQNMSLQGINILGKIDWNGVYGKLPEGLYTTLAYNRIKPKSVSNRPDLSLRSYALDAVQPSRYVLGFGYDQPEGKWGANIMLTYSKGKNPDELAYLAGDQKRYSAGRVTSSWKTADVSAYLNLKKRLTLRAAIYNIGNYRYVTWESLRQTAESTANRHGGDSNYGRYAAPGRNFSLALEMKF

SEQ ID NO: 18186 - protein, 88 aa, Neisseria gonorrhoeae
NGESYHVGLNYQNSGFFAQYAGLFQRYGEGTKKIEYDGQAYSMPSLFVEKLQVHRLVGGYDNNALYVSVAAQQQDAKLYGATRVNSHN

SEQ ID NO: 18187 - protein, 88 aa, Neisseria gonorrhoeae
NGESYHVGLNYQNSGFFAQYAGLFQRYGEGTKKIEYNDQAYSIPSLFVEKLQVHRLVGGYDNNALYVSVAAQQQDAKLYGAISGNSHN

SEQ ID NO: 18188 - protein, 94 aa, Neisseria gonorrhoeae
NGESYHVGLNYRNNGFFAQYAGLFQRYGEGTKKIEGYQYNSPSLFVEKLQVHRLVGGYDNNALYASVAAQQQDAKLYGTWRANSHNSQTEVAAT

SEQ ID NO: 18189 - protein, 158 aa, Neisseria gonorrhoeae
NGEILPLFTKIEGIEYKKGTDSHNPLKASFIAGGGAFGYKMDDIRVDVEGVYSQLSKNNVDGAALTPADAIADSLTAISGLVNVYYDIAIEDMHITPYIGGGVGAAYISTPLKTAVNGQNSKFGFAGQVKAGVSYDVTPEVKLYAGARYFGSYGANFD

SEQ ID NO: 18190 - protein, 95 aa, Neisseria gonorrhoeae
NGESYHVGLNYQNSGFFAQYAGLFQRYGEGTKKMEGYYLYNIPSLFVEKLQVHRLVGGYDNNALYASVAAQQQDAKLYGTWHANSHNSQTEVAAT

SEQ ID NO: 18191 - protein, 88 aa, Neisseria gonorrhoeae
NGESYHEGLNYQNSGFFAQYAGLFQRYGEGTKKIEYDGQAYSMPSLFVEKLQVHRLVGGYDNNALYVSVAAQQQDAKLYGATRVNSHN

SEQ ID NO: 18192 - protein, 327 aa, Neisseria gonorrhoeae
DVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKIEDYQYNIPSLFVEKLQVHRLVGGYDNNALYASVAAQQQDAKLYGTWRANSHNSQTEVAATVAYRFGNVTPRVSYAHGFKGTVNDANHDNTYDQVVVGAEYDFSKRTSALVSAGWLQEGKGADKIVSTASAVVLRHKF

SEQ ID NO: 18193 - protein, 319 aa, Neisseria gonorrhoeae
DVTLYGAIKAGVQTYRSVEHTNGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQTYSIPSFVEKLQVHRLVGGYDNNALYVSVAAQQQDAKLYNSHNSQTEVAATAAYRFGNVTPRVSYAHGFKGTVDSANHDNTYDQVVVGAEYDFSKRTSALVSVGWLQEGKGADKIVSTASAVVL

SEQ ID NO: 18194 - protein, 895 aa, Neisseria gonorrhoeae
MQPNSILAKAVRFALIGGAATAALSVPAVYSADEDSVERIQVTGSRIKRTDMETATPVTVMSAEDMAKQGFTNVQDALESLTSTTSAMTTQSVHGFTPAASSISLRGAGANRTLTLINGKRLNQYPKPSGGTDNFVDTANLPMEAVQRIEVLQSGGSAIYGADAVGGVINIILKKDFEGVALKYRHGDTTNGGGGSDRIALSLGASSDRGNVSTFIEFTDNEQLKATDRENFGLHTDKVPYSEFSAYSSYGARIVGSGTGARQLTEEECTAGGYLWTGSLCGFDRSEWRDLQPKSSRFISSTNFNYELADDISFVGRLDFAEAKSTTNIEPMAINDYDIKVAGNSVTVSNGDLSKTFNDKTTALGGDFANATDGDYNYLRRLHEFSNRAGETKTRNYFFTAGLEGTLADEYSWDASVNYGRTNVDVFRSGYATVGGMFDYITAGENGNSLLKNMSAEDVEQASYSPFEKAQSTQKNIQANISGMAFEMPAGDAQFAFGAEYTEQDYETNTDSESKKGNILTTGGSSGAGERSFWATYAELSLPVLDVLTVDAALRYDRYDDFGGNLSPQLTIEYRPLSELLVRGSISSVFRAPDMHRVYGDATKGFSTVIDFKQCQALGGIPGQGYPGDETLNAVCKELHVDTTTGANKDLEAETGYTANIGAVWGGDALNASFDLWEWKLDDMVSDISASKAAREYEQYESMLTRDASGTITHVNAVAQNLAFQKVRGLDITAGYSWDLDNIGELKLNFTGTYILLSEYQLSPTDPVEDDLENGGLPQYRANVVLGYYIDDFEATLGAYHTARMHGVQYKTFKQSAIDNNEAFDESAHEVASQTKWNLTAGYNITDAIKVKAGVVNLFDAGPNFDPTDTSWPHYPRSVYNARGREWFLEGEVKF

SEQ ID NO: 18195 - protein, 278 aa, Neisseria gonorrhoeae
MNPARKKPSLLFSSLLFSSLLFSSLLFSSAAQAASEGNGRGPYVQADLAYAAERITHDYPEPTAPGKNKISTVSDYFRNIRTHSIHPRVSVGYDFGGWRIAADYARYRKWHNNKYSVNIKELERKNNKTFGGNQLNIKYQKTEHQENGTFHAVSSLGLSAVYDFKLNDKFKPYIGARVAYGHVRHSIDSTKKITGTLTAYPSDADAAVTVYPDGHPQKNTYQKSNSSRRLGFGAMAGVGIDVAPGLTLDAGYRYHNWGRLENTRFKTHEASLGMRYRF

SEQ ID NO: 18196 - protein, 72 aa, Neisseria gonorrhoeae
QYAGLFQRYGEGTKKIEYDDQVYSIPSLFVEKLQVHRLVGGYDNNALYVSVAAQQQDAKLYGAMSGNSHNSQ

SEQ ID NO: 18197 - protein, 72 aa, Neisseria gonorrhoeae
QYAGLFQRYGEGTKKIEYDSQYYSIPSLFVEKLQVHRLVGGYDNNALYASVAAQQQDAKLYGTWRANSHNSQ

SEQ ID NO: 18198 - protein, 74 aa, Neisseria gonorrhoeae
QYAGLFQRYGEGTKKFEYEYQAYSIPSLFVEKLQVHRLVGGYDNNALYASVAVQQQDAKLYQNQLVRDNSHNSQ

SEQ ID NO: 18199 - protein, 291 aa, Neisseria gonorrhoeae
QVIHLYELNLENSLWEPRWDSDVSYLSLYNSHIRFNTKNESLVVGENRIRPTPDNALETEKDFKSRFSNIGYHSSSKIISYNNSRDYVLGYPSIRFAYDLSEREADKPVLTLKSKVRGKTAIVFEEKALNNLKNLTYRQLIKTETDIEPDAFFLLEEYKKGRYRLFLQQCPNGFCIGVEKLAIPTHLVASYAQQAQAANTLFALRLNDKNSDIFDRTLPRKGLWLRLISGHLSQDVQGKTAPVEGNRKGIQLGGDVFSLQNQDYQFSFGLMGGQAEQRSTFRNPDTGNVTT

SEQ ID NO: 18200 - protein, 316 aa, Neisseria gonorrhoeae
MKKSLIALTLAALPVAAMADVTLYGTIKAGVETSRSLDYQDGQVYSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDNVKIEKYQIHRLVSGYDNDALYASVAVQQQDAKLVEDNSHNSQTEVAATLAYRFGNVTPRVSYAHGFKGSFDDADLSNDYDQVVVGAEYDFSKRTSALVSAGWLQEGKGENKF

SEQ ID NO: 18201 - protein, 348 aa, Neisseria gonorrhoeae
MKKSLIALTLAALPVAATADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTDANVNAWESGKFTGNVLEISGMAKREHRYLSVRYDSPEFAGFSGSVQYAPKDNSGSNGESYHVGLNYQNSGFFAQYAGLFQRYGEGTKKIEYEHQVYSIPSLFVEKLQVHRLVGGYDNNALYVSVAAQQQDAKLYGARRANSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 18202 - protein, 327 aa, Neisseria gonorrhoeae
MKKSLIALTLAALPVAAMADVTLYGTIKVGVETSRSVAYHGAQADRVKTATEIADLGSKIGFKGQEDLGNGLKAIWQLEQKAYVSSTLEGWGNRQSFIGLKGGFGKVRVGRLNSVLKDTGGFNPWEGKSYYLGLSNIAQPEERHVSVRYDSPEFAGFSGSVQYVPNDNSGKNRSESYHAGFNYKNSGFFVQYAGSYKRHNFTTEKHQVHRLVGGYDHDALYASVAVQQQDAKLTWRDNNSHNSQTEVAATAAYRFGNVTPRVSYAHGFKGSVYDADNDNTYDQVVVGAEYDFSKRTSALVSAGWLQRGKGTEKFVATVGGVGLRHKF

SEQ ID NO: 18203 - protein, 327 aa, Neisseria gonorrhoeae
MKKSLIALTLAALPVAAMADVTLYGTIKVGVETSRSVAYHGAQADRVKTATEIADLGSKIGFKGQEDLGNGLKAIWQLEQKAYVSSTLEGWGNRQSFIGLKGGFGKVRVGRLNSVLKDTGGFNPWEGKSYYLGLSNIAQPEERHVSVRYDSPEFAGFSASVQYVPNDNSGKNRSESYHAGFNYKNSGFFVQYAGSYKRHNFTTEKHQVHRLVGGYDHDALYASVAVQQQDAKLTWRDNNSHNSQTEVAATAAYRFGNVTPRVSYAHGFKGSVYDADNDNTYDQVVVGAEYDFSKRTSALVSAGWLQRGKGTEKFVATVGGVGLRHKF

SEQ ID NO: 18204 - protein, 327 aa, Neisseria gonorrhoeae
MKKSLIALTLAALPVAAMADVTLYGTIKVGVETSRSVAYHGAQADHVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATAAYRFGNVTPRVSYAHGFKGSVYDADNDNTYDQVVVGAEYDFSKRTSALVSAGWLQRGKGTEKFVATVGGVGLRHKF

SEQ ID NO: 18205 - protein, 695 aa, Neisseria meningitidis
MSSPPPGAPFVARRLAVAACLVAAPHAYAQNAPADEQVLQSVEVKADWLGPATPEQVRTYSGARSVVSEEQLHERGALNVEDALRVVPGVHVLDETGTGILPNISVRGLNPLRSERAQILLDGYPIAIGPYSNIGLSLFPITMASVESIDVVRGGAAVHYGPNNLGGVLNFVTRPIPGEFSQTLAQRVTVAEETGNMLSDTYYRAGGFLNDDLGLQLQANTLRGDGSREHSSTKVNNFILDGIYFADARNEIRAQLQYYEVDADLPGALSPAAYRDDRTQSQRPNDGFDADMLRGTLTWVFTPSADTQFEWRNFAHDADRTFFFGQNLSGTGNAFDPALPETHVADSPRLFKVYGTEPRLSHRIGRHTFTLGARYVKEEVQFDVNRTALATGAYSAVRAWDFDTDAVAVYASDTMRFLDDRLAITPGLRYEDVRMDFHDERSGAAGDNHAEEVLPGLTVGYQTTDRVFLFTNAQRSLVPVQTAQATRDGDVANETAWNYEVGARFDPRPDVSTQATLFRIDYEDQIQFNAGAARFENLGETRLEGAELQAIWEVGANTRLSATYTYLDTEQLNGPNAGKQLQNAPHHRVSLTADHTLGPWAFSGSASYAAESYSDAANTRKETANGSAGRLPDYVVVNARIGRELKLGQGLDATIGLAVNNLFDEEYYFRGVDVSPVGRVPGPGRSFILEGQLNF

SEQ ID NO: 18206 - protein, 192 aa, Neisseria meningitidis
ASEDGSRSPYYVQADLAYAAERITHDYPQATGANNTSTVSDYFRNIRTHSIHPRVSVGYDFGDWRIAADYASYRKWNDNKYSVNTKNVQVNKSNGSRQDLKTENQENGTFHAVSSLGLSAVYDFKLNDKFKPYIGVRVAYGHVKHQVHSVESKTTIVTSKPTKGATQPGKLVSGPTPKPAYHESNSISSLGL

SEQ ID NO: 18207 - protein, 245 aa, Neisseria meningitidis
AAQAASEDGSRSPYYVQADLAYAAERITHDYPQATGANNTSTVSDYFRNIRTHSIHPRVSVGYDFGDWRIAADYASYRKWNDNKYSVNTKNVQVNKSNGNRQDLKTENQENGSFHASSSLGLSAIYDFKLNDKFDKFKPYIGVRVAYGHVKHQVHSVKKETTTTFLAPTGDAKVPGKIVEGPFSKPAYHESHSISSLGLGVIAGVGFDITPKLTLDTGYRYHNWGRLENTRFKTHEVSLGMRYHF

SEQ ID NO: 18208 - protein, 129 aa, Neisseria meningitidis
RHGAEDGVILSMEYIHRPFYEGRVFSAQLAGAIELVETGDAFLGGGVRGKWDLQQDWFIEASVLPGAYIEGTALNDLGSTFEIRSQLAVGKRFKSGKALSLALSHKSNASTADINPGVNALTLRWHIPL

SEQ ID NO: 18209 - protein, 287 aa, Neisseria meningitidis
ASVLFGRDNNVKFEITPTLNYNYFEGNLDMDNRYAPGIRLGYHFDDFWLDQLEFGLEHYSDVKYTNTNKTTDITRTYLSAIKGIDVGEKFYFYGLAGGGYEDFSNAAYDNKSGGFGHYGAGVKFRLSDSLALRLETRDQINFNHANHNWVSTLGISFGFGGKKEKAVEEVADTRPAPQAKCPVPSREGALLDENGCEKTISLEGHFGFDKTTINPTFQEKIKEIAKVLDENERYDTILEGHTDNIGSRAYNQKLSERRAKSVANELEKYGVEKSRIKTVGYGQDNPR

SEQ ID NO: 18210 - protein, 224 aa, Neisseria meningitidis
ADVSLYGEIKAGVEGRNYQLQLTEAQAANGGASGQVKVTKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAYYTKDTNNNLTLVPAVVGKPGSDVYYAGLNYKNGGFAGNYAFNMRK

SEQ ID NO: 18211 - protein, 138 aa, Neisseria meningitidis
ADYASYRKWNNNKYSVNTKEVLRHSNGNWQELKTENQENGSFHATSSLGLSAIYDFKLNDKFDKFKPYIGARVAYGHVKHQVHSVRKETTTVFSKSQGSTAPGKIPSSVTKPAYHESHSISSLGFGVIAGVGFDITPS

SEQ ID NO: 18212 - protein, 237 aa, Neisseria meningitidis
ASEDGSRSPYYVQADLAYAAERITHDYPQATGANNTSTVSDYFRNIRTHSIHPRVSVGYDFGDWRIAADYASYRKWNDNKYSVNTKNVQVNKSNGNRQDLKTENQENGTFHAVSSLGLSAVYDFNTGSRFKPYAGVRVAYGHVRHSIDSTKKTTNVLTVPTNIPGGTPTIYNQGSTQDAYHESHSIRRLGLGVVAGVGFDITPKLTLDTGYRYHNWGRLENTRFKTHEVSLGMRYHF

SEQ ID NO: 18213 - protein, 315 aa, Neisseria meningitidis
MKKSLIALTLAALPVAAMADVTLYGTIKAGVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFMQYGGAYKRHQNVDNVKIEKYQIHRLVSGYDNDALYASVAVQQQDAKLVKDNSHNSQTEVAATLAYRFGNVTPRVSYAHGFKGSFDDADYTNDYDQVVVGAEYDFSKRTSALVSAGWLQEGKGENK

SEQ ID NO: 18214 - protein, 329 aa, Neisseria meningitidis
MKKSLIALTLAALPVAAMADVTLYGTIKTGVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNVGRHNSESYHAGFNYKNGGFFVQYGGAYKRHQDVDDVKIEKYQIHRLVSGYDNDALYASVAVQQQDAKLVEDNSHNSQTEVAATLAYRFGNVTPRVSYAHGFKGSVDDAKRDNTYDQVVVGAEYDFSKRTSALVSAGWLQEGKGENKFVATAGGVGLRHKF

SEQ ID NO: 18215 - protein, 332 aa, Neisseria meningitidis
MKKSLIALTLAALPVAAMADVTLYGTIKAGVETSRSVAHNGAQAASVETGTGIVDLGSKIGFKGQEDLGNGLKAIWQVEQKASIVGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEDLNIEKYQIHRLVSGYDNDALYASVAVQQQDAKLALPNDNSHNSQTEVAATLAYRFGNVTPRVSYAHGFKGSFDDADLSNDYDQVVVGAEYDFSKRTSALVSAGWLQEGKGENKFVSTAGGVGLRHKF

SEQ ID NO: 18216 - protein, 316 aa, Neisseria meningitidis
MKKSLIALTLAALPVAAMADVTLYGTIKAGVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENK

SEQ ID NO: 18217 - protein, 315 aa, Neisseria meningitidis
MKKSLIALTLAALPVAAMADVTLYGTIKAGVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFMQYGGAYKRHQNVDNVKIEKYQIHRLVSGYDNDALYASVAVQQQDAKLVKDNSHNSQTEVAATLAYRFGNVTPRVSYAHGFKGSFDDADYTNDYDQVVVGAEYDFSKRTSALVSAGWLQEGKGESK

SEQ ID NO: 18218 - protein, 747 aa, Neisseria meningitidis
MKPLPLSLCALAVASALPVWAEEQAKPLINEVIVVSGSRMEQNIEQVAGSILVIDEEAIERNMSNDFGSLFRNESAVDIKGGAGKPTSVTIRGIGGNRVMMVKDGVRVNNQYASPLGPGAEGTGRGLTEVQSLKQIEVVKAAASTMYGSDALGGVVVMRTKDASDYLRGEDYYVSLNAGYSGINNEYSGGFTSAAAYSDFENLLTYQHRKGEELPNYFDTQPESDLLQDSLLFKSKYRFNEHTTVQLTLDYLEQTLERWEDKLNRAQVPQERIDTDRDTQVINGALQLRSDKATYLHDDLTVTAYFGQTEQLEHRDYFDLRTAARPLTEYRDYEFKDQRLGLTSTFSKYIGAEGYGHQLTYGMDYEWSQMMRHRNNNIASNGGDWQTETPFTFADTDSNRLGLFLQDDITLLNGDLNLIGGLRYDYFRNSPDQQQAMEAGKDPADFAVMSDTFWSPKVGLVYKLTDTVSAYAQYAYGYKMPTPDQKWGELEVDGGSMTDVIIQANYDLKSEQSHTWELGIRGNHADTQYELTTFDTHAVDFSDWQYVSFKPPVFGPVMQPMEFKYQYFNRDQVTLYGAEAQANHWLTDSIELWGNISYTHGTDENGQNLNSVSPLKGNLGVNWYSDIGGMETDIGAVVRWADKMDRTNDINLTIDDICVMGQCIPKESFNEVYNTAGYAVLDLTMGLHVTDNLHLRAGVYNLFDKEYVDYADVAGQSVFLLNSTMNLQKDDFTQPGRYFNLSMNYQF

SEQ ID NO: 18219 - protein, 283 aa, Neisseria meningitidis
QQRYQVVTSTYSNGTFYESGTSPTTSPVAQALGAAPLRAESSLSYSLGLVLQPFERFYLTLDTYQIDIAHRILLSSNLNDAAVLAALQQQGNSNVTSVRYFANAANTRTRGVDLVGTYTIPFAVGQLDLTTSYSGIGTRIRSAVTQPAALSAIGSTQTIVGRDEIGRLEESFPKDKLILSGTWKLTQWDLMLAATRYGTVTVRNPTSVSRDQTYGARWVVDASASYKSDMHWMLTLGANNLLNAYPDKTVNAINSIYGQMPYSNYAPFGFNGTYVYARIGYSW

SEQ ID NO: 18220 - protein, 295 aa, Neisseria meningitidis
GVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGKYNSESYHAGFNYKNGGFFVQYGGAYKRHVRVDENVNIEKYQIHRLVSGYDNDALHASVAVQQQDAKLVKDNYSHNSQTEVAATLAYRFGNVTPRVSYAHGFKGSFDDADLSNDYDQVVVGAEYDFSKRTSALVSAGWLQEGKGENKFVSTAGG

SEQ ID NO: 18221 - protein, 267 aa, Neisseria meningitidis
PPKTFSSLLFSSLLFSSLLFSSAAQAASEDSSRSPYYVQADLAYAAERITHDYPKPTGTDKDKISTVSDYFRNIRAHSIHPRVSVGYDFGGWRIAADYASYRKWNNNKYSVNIKKGRETQDNREELKTENQENGSFHAASSLGLSAIYDFKLNDKFDKFKPYIGARVAYGHVKHQVHSVETKTTIVTSKPTATSPQGGPIIQTDPSKPPYHESHSISSLGLGVIAGVGFDITPKLTLDTGYRYHNWGRLENTRFKTHEVSLGMRYHF

SEQ ID NO: 18222 - protein, 260 aa, Neisseria meningitidis
PKKPSLLFSSLLFSSAAQAASEDGSRSPYYVQADLAYAAERITHDYPKATGANNTSTVSDYFRNIRAHSIHPRVSVGYDFGDWRIAADYASYRKWNNNKYSVNTKELQRNNSSGIWQELKTENQENGTFHAVSSLGLSAIYDFKLNDKFDKFKPYIGARVAYGHVKHQVHSVRKETKTTFSKPGVGVTEPGKIVEGPTPKPPYHESNSISSLGLGVIAGVGFDITPKLTLDTGYRYHNWGRLKNTRFKTHEVSLGMRYRF

SEQ ID NO: 18223 - protein, 423 aa, Neisseria meningitidis
PPFVSDQAEAKGIVEDAKLLNMLVRNYYFNRDNKVGARDQYDWTQGIWGNFSSGSTQALIGVRVDAFGYLGVKLDGGVGTSGSGNMSRSDTVHADGSRDVNESQGKAGGAVKVRISKTDLKFGEMQPSTAPVYAVGGSRILPQTATGFQLQSSEVKDLDLEAGHFYSASSQDKNASDGGQFATYAGVEANSPYDYFGGKYAIIENLSASLYGAKLQDIWNQYYAYLNYTIPFGGDESLYLDGNIYNTQDNGDAKAGEISNAAYCLAAAISIMQAHTTSPAFQRVNGDTPFDYIGVGKNNRGRDSIFLANSNQYSDFYAPGEKSAQVRYDLKMAEYGVPGLSFMTRYVKGWDIDGTKTPVGSPYAGLYGEDGKHNDNNFEAKKVVQSGPAKDVSFRIRQAWHVANGEEGEGDTKEIRLIVDYPL

SEQ ID NO: 18224 - protein, 146 aa, Neisseria meningitidis
AEHGTDSWAGGIMLPWNWSYALGPGRMTGYWDLSLSRWSSDYQGGNRSTWVLGAQPTLRWRPAQGLSPWFLQAGLGLSYATNHRYISDHKEFSTRYNFASHIGIGYLFGEQLKNEISLRFEHQSNAGIKRPNPGENFLQLRYARHF

SEQ ID NO: 18225 - protein, 697 aa, Neisseria meningitidis
AENNAKVALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIVKTVDGQDLLKGLDKNWGVRLNSGFASNEGVSYGASVFGKEGNFDGLFSYNRNDEKDYEAGKGFRNVTGGKTVPYSALDKRSYLAKIGTSFGGDDHRIVLSHMKDQHRGIRTVGEEFTVTNNSRLDLDRQAPAYRETTQSNTNLAYTGKDLGFVEKLDANAYVLEKKRYSADDKDNGYAGNVKGPNHTRITTRGMNFNFDSRLAEQTLLKYGINYRHQEIKPQAFLNSKFSIPTTEKKNGQDVAKPADQQAKDRKDEALVHSYRLTNPTKTDTGAYIEAIHEINGFTLTGGLRYDRFKVKTHDGKTVSSSNLNPSFGVIWQPHEHWSFSASHNYASRSPRLYDALQTHGKRGIISIGDGTKAERARNTEIGFNYNEGTFAANGRYFWQTIKDALANPQNRHVSAAVREAVNAGYIKNHGYELGASYRTGGLTAKVGVSHSKPRFYDTHPKKLLSANPEFGAQVGRTWTASLAYRFQNPNLEIGWRGRYVQKAVGSILVAGQKDRNGKLENVVRKGFGVNDVFANWKPLGKDTHNVNLSVNNVFNTFYYPHSQRWTNTLPDVGRDVRLGVNYKF

SEQ ID NO: 18226 - protein, 122 aa, Neisseria meningitidis
TICRFLYGYDSPDFSGFSGSVQFVPAQNSKSAYTPATYTEGSSGVFTPVPAVVGKPGSDVYYAGLNYKNGGFAGNYAFKYAKHANVGRDAFNLFLLGRIGEDDEAKGTDPLKNHQVHRLTAA

SEQ ID NO: 18227 - protein, 303 aa, Neisseria meningitidis
TIKAGVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQESKGENKFVSTAGGVGLRH

SEQ ID NO: 18228 - protein, 306 aa, Neisseria meningitidis
YGTIKAGVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGKYNSESYHAGFNYKNGGFFVQYGGAYKRHVRVDENVNIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGGVGLRH

SEQ ID NO: 18229 - protein, 301 aa, Neisseria meningitidis
YGTIKAGVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGGV

SEQ ID NO: 18230 - protein, 368 aa, Neisseria meningitidis
DVSLYGEIKAGVEGRNYQLQLTEAQAANGGASGQVKVTKAKSRIRTKISDFGSFIGFKGSEDLGEGLKAVWQLEQDVSVAGGGATQWGNRESFIGLAGEFGTLRAGAVANQFDDAMAQAIDPWDSNNDVRSQLGIFKRHDDMPVSVRYDSPEFSGFSGSVQFVPAQNSKSAYKPAYWTTVNTGSATTTFVPAVVGKPGSDVYYAGLNYKNGGFAGNYAFKYARHANVGLDAFELFLLGSGSDQAKGTDQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 18231 - protein, 790 aa, Neisseria meningitidis
MNTNVPKKQSLIALSVLSAMSMTSLPAFAQEADTQASAKKQQEEDFESIVVTGRNVSYANSAASEEMKKQQTPMTSVLALVDNLPGVLVTEGDPFGSDEWSTSISIRGFQLNLESQQIGMTVDGISNGNSNYGGGTKASRYIDTENLRGVEVSQGTADISSRSNEALGGTMDFTTILPALDEQLTVSTTLAEHNARKFYVRYDTGEIAQDTFAWMSLSSQQNDDYMDGSITNKRDHAEGKIISTIGEVDLTAYVSYDDAEEYTYQRVYGLAQYEQNAEWDGLTEDWSGVPYQDQVFREGWVTERENFFTYLKADFAVGEVDFSTNVYYHENEGAGKWIPYYIADVTDDGVGNPNSELDSSTTAYGGASQGLIYFTNRAGETLSPIAGCESSIGFPYGGGGAEIDPGCYEQGAIPVSSNRHTHYDKKRYGVNGDFTWNTSISDMDNVLRGGFWYEDYQRDEYRDWHKTIDAATSPRYDETPYWVQYDREFPVETLMYYIEDELDAGFAKFRLGAKQFKVDVSKEDQFVPENDLDVSSDSDVLISAGFVAPLPLDGLEVFGGYAENFAAVKDAVLERDDADVSTVEPETADNIDFGLRYSTPGFNASLTYYNIKFENRITFISNEDVNGIDFLESAAGGFLNDGGIESDGIEASIDYKINENFGVYVSYTKNESTYTDDDQDIGGKTVIGSPEDMAVISFDYAKNDFYAGFSTKYVGERFLDQANTQEVDSYVVSDLYVGKTAYDIGGSIESVELSFTVNNVFDEEYLGSIAPNAGWIGAPRIASFNVRFVM

SEQ ID NO: 18232 - protein, 894 aa, Neisseria meningitidis
MKTKPSFTVNKLSLAIISVISAATLLTATPVYSQEPAPVRDPGEVIPIEPIEVISVTGRLRSSASEATEERREQIAVADIMGSEQISRTGDGDAAAALRRVTGLTLKDGKFIYVRGLGERYSSTSLNGATVPSPDPTRNVVPLDMFPASIIESLSVQKSASANSPAAFGGGHVDIRTKSIPADFFFKASVGGRYNTNDSNDSYTYNGGGDDWTGQDDGTRSMPSNINNTINQYGGISPIDIVSNSNGAINYPAAQKVNRELALDMYRDMTVHSQSTDPAMRGDIAIGDRWDITDDIIFGALSAVSYKKQAENYTKREVELDGDSSQVQVENQKDIVGTDSIVQVSGMLNLGLEIGYNHKIETFTTYLQDTSDDVSMGIEETIDTLGEPNALQVYAIDYEERSLISNQIKGHHFIEYLNDAEFNWKFSDARSERYAPNEVSYTYNVILDDSNQLLSRNLNTQDAPKYVYSRLEDDSQNYAWDFMYPINLDGAVVKLTTGYEYFERTRESYATRLGFDVDLSPTDANGAILAGDFDEIFSDKNITDNTLGLELKDASTDTEDYIAAEKNDAAFVSMDIDFDDVWRVYAGIRYEDFRRVTLPIDPNGEISDEGGRYQLSDYVIAEDGWFPSLSLTWKQTDTTQWRFGASKTIVRPDLREVSPVRFQDPVTGFDFFGNPELKSSDILNLDLRWEYYSDSGNNFSMGAFYKDVDAPIEPIQRISEAGRQLKFYNAQSGYVYGLETEFLQELEFLGRDGSIWEDFFVAGNLTLGDSEIDIAANGEIDPTNKTRRMTGHSQWVANLQLSYDSSDSYHSATLVYNVFGERIAYGGRGGLDDVFEKPFHSLDFTYSFFPTDSVTVKVKAKNILGETTEYEQQDLQVYAKDPGTEFTLQFSYEY

SEQ ID NO: 18233 - protein, 709 aa, Neisseria meningitidis
MNKKHPVLTPATLLLLQPVCIGSALAADQKDSDTLVVMAQPIGLTELGSPVSVSVIDGQDLRNAAPQINLSENLGSVPGLQLQNRQNYAQDLQLSIRGFGSRSMFGVRGVRMYVDGIPATMPDGQGQTSNIDINSVERIEVLRGPYSALYGNASGGVINVDTQTGTQPPTLEAGGYFGSDNTWRYGVKATGATGDGTQAGDVNYAISGTRFTTQGYRDHSAARKNLGNGKLGVRLDDVSTLTLMFNSVSIDAGDPGGLTEAEWKENPRQAPRADQYNTRKSLDQTQAGLRYQRQMSERDELTLTAYHGERHTTQYQSIPRGPQLNPTHAGGVIVLERKYQGIDTRWKHEDTLASLPVTLIGGLDYETMTERRQGFENFILRDGTVDYGEKGDQRRNEKNRIWNLDPYLQTSWQLTPHWTLDAGLRYSTVSFDSTDYYITPRNGDDSGSKRYHQWLPMGSLNYKINPAWNVYLSAGRGFETPTINELSYRPDGQAGLNIGLQPSTSDTVELGSKLRLGNGLVSAALFQTDTDNELVVAESSGGRTSYANAGKTRRRGLELALDQEFALDWRLHMAWTLLDATYRSDMCGKAVCTPAGNRLPGIARNMGYASLAYAPPEGWHAGAELRYMSDIQANDANSAQAPAYTVAGVNAGYRFTWNRWALDVFSRVDNVFDRRYVGSVIVNEGNGRYFEPAPGRNWGGGATLSYRFE

SEQ ID NO: 18234 - protein, 359 aa, Neisseria meningitidis
MRKKLTALVLSALPLAAVADVSLYGEIKAGVEGRNYQLQLTEPALPNIQPQVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAHFVQNKQNQRPTLVPAVVGKPGSDVYYAGLNYKNGGFAGNYAFKYARHANVGANAFELFLLGSATSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIV

SEQ ID NO: 18235 - protein, 358 aa, Neisseria meningitidis
MRKKLTALVLSALPLAAVADVSLYGEIKAGVEGRNYQLQLTEPAPKYSTTQVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAHFVQQTPKSQPTLVPAVVGKPGSDVYYAGLNYKNGGFAGNYAFKYARHANVGRDAFELFLLGSGSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIV

SEQ ID NO: 18236 - protein, 357 aa, Neisseria meningitidis
MRKKLTALVLSALPLAAVADVSLYGEIKAGVEGRNYQLQLTEPPSKSQPQVKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAHYTRQNNADVFVPAVVGKPGSDVYYAGLNYKNGGFAGNYAFKYARHANVGRDAFELFLLGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIV

SEQ ID NO: 18237 - protein, 391 aa, Neisseria meningitidis
MRKKLTALVLSALPLAAVADVSLYGEIKAGVEGRNYQLQLTEKPSSTNPKTGNKVEVTKAKSRIRTRISDFGSFIGFKGSEDLGDGLKAVWQLEQDVSVAGGGATRWGNRESFVGLAGEFGTLRAGRVANQFDDASKAIDPWDSNNVVASQLGIFKRHDDMPVSVRYDSPDFSGFSGSVQFVPAQNSKSAYTPAYYTKDKNNALTLVPAVVGKPGSDVYYAGLNYKNGGFAGNYAFKYARHANVGRDAFELFLLGSGSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRHK

SEQ ID NO: 18238 - protein, 358 aa, Neisseria meningitidis
MRKKLTALVLSALPLAAVADVSLYGEIKAGVEGRNYQLQLTEPAPKYSTTQVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAHFVQETPKSQPTLVPAVVGKPGSDVYYAGLNYKNGGFAGNYAFKYARHANVGRNAFELFLLGSGSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIV

SEQ ID NO: 18239 - protein, 359 aa, Neisseria meningitidis
MRKKLTALVLSALPLAAVADVSLYGEIKAGVEGRNYQLQLTEPALPNIQPQVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAHFVQNKQNQWATLVPAVVGKPGSDVYYAGLNYKNGGFAGNYAFKYARHANVGRNAFELFLLGSPSSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIV

SEQ ID NO: 18240 - protein, 359 aa, Neisseria meningitidis
MRKKLTALVLSALPLAAVADVSLYGEIKAGVEGRNYQLQLTEPALPNIQPQVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAHFVQNKQNQRATLVPAVVGKPGSDVYYAGLNYKNGGFAGNYAFKYARHANVGRNAFELFLLGSATSDEPKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIV

SEQ ID NO: 18241 - protein, 357 aa, Neisseria meningitidis
MRKKLTALVLSALPLAAVADVSLYGEIKAGVEGRNYQLQLTEPPSKSQPQVKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAHYTRQNNADVFVPAVVGKPGSDVYYAGLNYKNGGFAGNYAFKYARHANVGRDAFELFLLGSTSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIV

SEQ ID NO: 18242 - protein, 359 aa, Neisseria meningitidis
MRKKLTALVLSALPLAAVADVSLYGEIKAGVEGRNYQLQLTEPAPKYSTTQVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAHFAQNKQNQRATLVPAVVGKPGSDVYYAGLNYKNGGFAGNYAFKYARHANVGRNAFELFLLGSATSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIV

SEQ ID NO: 18243 - protein, 358 aa, Neisseria meningitidis
MRKKLTALVLSALPLAAVADVSLYGEIKAGVEGRNYQLQLTEPAPKYSTTQVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAHFVQETPKSQPTLVPAVVGKPGSDVYYAGLNYKNGGFAGNYAFKYARHANVGRNAFELFLLGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIV

SEQ ID NO: 18244 - protein, 386 aa, Neisseria meningitidis
MRKKLTALVLSALPLAAVADVSLYGEIKAGVEGRNYQLQLTEPPQKNQSQPVVTKAKSRIRTRISDFGSFIGFKGSEDLGEGLKAVWQLEQDVSVAGGGATRWGNRESFVGLAGEFGTLRAGRVANQFDDASQAIDPWDSNNDVASQLGIFKRHDDMPVSVRYDSPDFSGFSGSVQFVPIQNSKSAYTPAYYTKDNKNDNLTLVPAVVGKPGSDVYYAGLNYKNGGFAGNYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDFIERGKKGENTSYDQIIAGVDYDFSKRTSAIVSGAWLKRNTGIGNYTQINAASVGLR

SEQ ID NO: 18245 - protein, 100 aa, Neisseria meningitidis
AGVEGRNYQLQLTEAQAANGGASGQVKVTKVTKAKSRIRTKISDFGSFIGFKGQFVPIQNSKSAYTPAYYTKNTNNNLTLVPAVVGKPGSDVYYAGLNYK

SEQ ID NO: 18246 - protein, 352 aa, Neisseria meningitidis
EGRNIQLQLTEKLSSTNAKTGNKVEVTKAKSRIRTRISDFGSFIGFKGSEDLGDGLKAVWQLEQDVSVAGGGATRWGNRESFIGLAGEFGTLRAGRVANQFDDASQAIDPWDSNNDVASQLGIFKRHDDMPVSVRYDSPEFSGFSGSVQFVPIQNSKSAYTPAYYTKDTNNNLTLVPAVVGKPGSDVYYAGLNYKNGGFAGNYAFKYARHANVGRNAFELFLIGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAAS

SEQ ID NO: 18247 - protein, 354 aa, Neisseria meningitidis
EGRNYQLQLTEAQAANGGASGQVKVTKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAYYTKNTNNNLTLVPAVVGKPGSDVYYAGLNYKNGGFAGNYAFKYARHANVGRNAFELFLIGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAAS

SEQ ID NO: 18248 - protein, 350 aa, Neisseria meningitidis
EGNNIQLQLTEPPSQGQTGNKVTKGKSRIRTKISDFGSFIGFRGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPATLANGANNTIIRVPAVVGKPGSDVYYAGLNYKNGGFAGNYAFKYARHANVGRDAFNLFLLGRIGDDDEAKGTDPLKNHQVHRLTSGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAAS

SEQ ID NO: 18249 - protein, 348 aa, Neisseria meningitidis
EGRNIQLQLTEPLQNIQQPQVTKRKSRIRTKISDFGSFIGFKGSEDLGEGLKAVWQLEQDVSVAGGGATRWGNRESFVGLAGEFGTLRAGRVANQFDDASKAIDPWDSNNVVASQLGIFKRHDDMPVSVRYDSPEFSGFSGSVQFVPAQNSKSAYTPAHFVQQTPQSQPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAAS

SEQ ID NO: 18250 - protein, 350 aa, Neisseria meningitidis
EGNNIQLQLTEPPSKGQTGNKVTKGKSRIRTKINDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPATYTVDSSGVVTPVPAVVGKPGSDVYYAGLNYKNGGFAGNYAFKYAKHANVGRDAFNLFLLGRIGEGDEAKGTDPLKNHQVHRLTGGYEEGGLNLALAAQLDLSENGDKTKNSTTEIAATASYRFGNAVPRISYAHGFDFIERGKKGEHTSYDQIIAGVDYDFSKRTSAIVSGAWLKRNTGIGNYTQINAAS

SEQ ID NO: 18251 - protein, 355 aa, Neisseria meningitidis
EGRNYQLQLTEAQAANGGAGASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQINAAS

SEQ ID NO: 18252 - protein, 358 aa, Neisseria meningitidis
EGRNIQLQLTEQPSKAQGQTNNQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHWNTVYNTNGTTTTFVPAVVGKPGSDVYYAGLNYKNGGFAGNYAFKYARHANVGRDAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAAS

SEQ ID NO: 18253 - protein, 348 aa, Neisseria meningitidis
EGRNIQLQLTEQPSKAQGQTNNQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPAQNSKSAYTPAYVDEQSKYHAAVVGKPGSDVYYAGLNYKNGGFAGNYAFKYAKHANVGRDAFELFLLGSGSDQAKGTDPLKNHQVHRLTGGYEEGGLNLALAAQLDLSENGDKTKNSTTEIAATASYRFGNAVPRISYAHGFDLIERGKKGENTSYDQIIAGVDYDFSKRTSAIVSGAWLKRNTGIGNYTQINAAS

SEQ ID NO: 18254 - protein, 351 aa, Neisseria meningitidis
EGRNYQLQLTEAQAANGGASGQVKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAYYTKDTNNNLTLVPAVVGKPGSDVYYAGLNYKNGGFAGNYAFKYARHANVGRNAFELFLIGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAAS

SEQ ID NO: 18255 - protein, 350 aa, Neisseria meningitidis
EGRNIQLQLTEPLPNIQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNQRPTLVPAVVGKPGSDVYYAGLNYKNGGFAGNYAFKYAKHANVGRDAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAAS

SEQ ID NO: 18256 - protein, 154 aa, Neisseria meningitidis
LRQIDDAYPFAIKLDWSKHLITQESWDFCNCFPRVGVSLAYWDWDNPEVLGIGIIPLAYVEPYFLTQKRINLFVRMGLGGAFLTKQYDEISNPLNESYSTLFNFMIVLGVGVNYRLTDKLNLRLAAKYNHISNGGVRTPNKGLNFPSLNIGLNT

SEQ ID NO: 18257 - protein, 227 aa, Neisseria meningitidis
DVSLYGEIKAGVEGRNIQLQLTEPLPNIQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNQRPTLVPAVVGKPGSDVYYAGLNYKNGGFAGNYAFKYAKHANVGRDAFEL

SEQ ID NO: 18258 - protein, 343 aa, Neisseria meningitidis
EGRNIQLQLTEPLQNIQQPQVTKRKSRIRTKISDFGSFIGFKGSEDLGEGLKAVWQLEQDVSVAGGGATRWGNRESFVGLAGEFGTLRTGRVANQFDDASQAIDPWDSNNDVASQLGIFKRHDDMPVSVRYDSPDFSGFSGSVQFVPAQNSKSAYTPAYVDEQSKYHAAVVGKPGSDVYYAGLNYKNGGFAGNYAFKYARHANVGRDAFELFLLGSGSDQAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAAS

SEQ ID NO: 18259 - protein, 354 aa, Neisseria meningitidis
EGRNYQLQLTEAQAANGGASGQVKVTKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAYYTKDTNNNLTLVPAVVGKPGSDVYYAGLNYKNGGFAGNYAFKYARHANVGRNAFELFLIGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAAS

SEQ ID NO: 18260 - protein, 201 aa, Neisseria meningitidis
DVSLYGEIKAGVEGRNIQLQLTEQPSKAQGQTNNQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVDEKQVSHAAVVGKPGSDVYYAGLN

SEQ ID NO: 18261 - protein, 203 aa, Neisseria meningitidis
DVSGVMNGSFYVSGSYSPSFPSISSFAISESDRGGSYVKGYNKNLSTLNVSDPASFTQHEPSFKFAKSLLTSFDGATGYAIGGARVEVEVGYKKFETLAESDYKHVESHNFVAVGRDATLTPDNFFVMKIDSVKDISVMLNACYDVMHTDLPVSPYMCAGLGASFINIADHVTSKLAYRGKVGVSYKLTPEISLIAGGFYHGI

SEQ ID NO: 18262 - protein, 357 aa, Neisseria meningitidis
EGRNYQLQLTEAQAANGGARASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQSQRPTLVPAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQINAAS

SEQ ID NO: 18263 - protein, 354 aa, Neisseria meningitidis
EGRNYQLQLTEAQAANGGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYKPAYWTTVNTGSATTTTFVPAVVGKPGSDVYYAGLNYKNGGFAGNYAFKYARHANVGRDAFELFLLGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAAS

SEQ ID NO: 18264 - protein, 216 aa, Neisseria meningitidis
MRKKLTALVLSALPLASVADVSLYGEIKAGVEGRNYQLQLTEAQAANGGAGASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGK

SEQ ID NO: 18265 - protein, 363 aa, Neisseria meningitidis
DVSLYGEIKAGLEGNNIQLQLTEQPSKGQVGNKVTKGKSRIRTKINDFGSFIGFKGSEDLGEGLKAVWQLEQDVSVAGGGASPVGNRESFIGLAGEFGTLRAGRVANQFDDASQGIDPWDSNNDVASQLGIFKRHDDMPVSVRYDSPDFSGFSGSVQFVPAQNSKSAYTPAYVDEQSKYHAAVVGKPGSDVYYAGLNYKNGGFAGNYAFKYARHANVGRDAFELFLLGSGSDQAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 18266 - protein, 327 aa, Neisseria meningitidis
MKKSLIALTLAALPVAAMADVTLYGTIKAGVETSRSVAHHRAQADRVKTATEIADLGSKIGFKGQEDLGNGLKAIWQLEQKAYVSGTDTGWGNRQSFIGLKGGFGKVRVGRLNSVLKDTGGFNPWEGKSYYLGLSNIAQPEERHVSVRYDSPEFAGFSGSVQYVPNDNSGKNHSESYHAGFNYKNSGFFVQYAGFYKRHNYTTEKHQVHRLVGGYDHDALYASVAVQQQDAKLTWRNDNSHNSQTEVATTVAYRFGNVTPRVSYAHGFKGSVYDADNDNTYDQVVVGAEYDFSKRTSALVSAGWLQRGKGTEKFVATVGGVGLRHKF

SEQ ID NO: 18267 - protein, 303 aa, Neisseria meningitidis
DVTLYGTIKAGVETSRSVAHHGVQADRVKTTTEIADLGSKIGFKGQEDLGNGLKAIWQLEQKAYVSGTKEGWGSRQSFIGLKGGFGKVRVGHLNNILKDTGGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATVAYRFGNVTPRVSYAHGFKGSVYDADNDNTYDQVVVGAEYDFSKRTSALVSAGWLQRGKGTEKFVATVGGVG

SEQ ID NO: 18268 - protein, 303 aa, Neisseria meningitidis
DVTLYGTIKAGVETSRSVAYHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATVAYRFGNVTPRVSYAHGFKGSVYDANNDNTYDQVVVGAEYDFSKRTSALVSAGWLQRGKGTEKFVATVGGVG

SEQ ID NO: 18269 - protein, 300 aa, Neisseria meningitidis
GVETSRSVFHQNGQVTEVTTATGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDDANIGNEYDQVVVGAEYDFSKRTSALVSAGWLQEGKGENKFVATAGGVGLRH

SEQ ID NO: 18270 - protein, 299 aa, Neisseria meningitidis
GVETSRSVEHNVGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGGVGLRH

SEQ ID NO: 18271 - protein, 313 aa, Neisseria meningitidis
DVSLYGEIKAGVETSRSVFHQNGQVTEVTTATGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDNADIGNEYDQVVVGAEYDFSKRTSALVSAGWLQEGKGENKFVATAAPSVGLRHKF

SEQ ID NO: 18272 - protein, 301 aa, Neisseria meningitidis
GVETSRSVAHNRAQAASVETGTGIVDLGSKIGFKGQEDLGNGLKAIWQVEQKASIVGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEGLNIEKYQIHRLVSGYDNDALYASVAVQQQDAKLALPNDNSHNSQTEVAATLAYRFGNVTPRVSYAHGFKGLVDNADLSNDYDQVVVGAEYDFSKRTSALVSAGWLQEGKGENKFVSTAGGVGLRH

SEQ ID NO: 18273 - protein, 298 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALYASVAVQQQDAKLVEDNSHNSQTEVAATLAYRFGNVTPRVSYAHGFKGSFDDADLSNDYDQVVVGAEYDFSKRTSALVSAGWLQEGKGENKFVSTAGGVGLRH

SEQ ID NO: 18274 - protein, 312 aa, Neisseria meningitidis
DVTLYGTIKAGVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGKYNSESYHAGFNYKNGGFFVQYGGAYKRHVRVDENVNIEKYQIHRLVSGYDNDALHASDAVQQQDAKLVEDNYSHNSQTEVAATLAYRFGNVTPRVSYAHGFKGSFDNADIGNEYDQVVVGAEYDFSKRTSALVSAGWLQEGKGENKFVSTAGGVGLRHKF

SEQ ID NO: 18275 - protein, 359 aa, Neisseria meningitidis
MKKSLIALTLAALPVAAMADVTLYGTIKAGVETSRSVEHNGGQVVSVETGTGIVDLGSKIGFKGQEDLGNGLKAIWQVEQKASIAGTDSGWGNRQSFIGLKGGFGTVRAGNLNTVLKDSGDNVNAWESGSNTENILGLGTIGRVESREISVRYDSPVFAGFSGSVQYVPRDNANDKDKYTHMKSSRESYHAGLKYENAGFFGQYAGSFAKYADLNTDAERVAVNTANAHPVKDYQVHRVVAGYDANDLYVSVAGQYEAAKNNEVGSTAIGKKHEQTQVAATAAYRFGNVTPRVSYAHGFKAKVNGVKKASYQYDQVIVGADYDFSKRTSALVSAGWLKEGKGVNKTEKTASMVGLSHKF

SEQ ID NO: 18276 - protein, 316 aa, Neisseria meningitidis
EVSRVKNQGVKTKTATQIADFGSKIGFKGQEDLGNGMKAIWQLEQKASIAGTNSGWGNRQSFIGLKGGFGTVRVGNLNTVLKDSGDNVNAWESGSNTENVLGLGTIGRVESREISVRYDSPVFAGFSGSVQYVPRDNANDKDKYTHKQSSRESYHAGLKYENAGFFGQYAGSFAKYADLNKDAERVAAGTSGAYAVKDYQVHRVVAGYDANDLYVSVAGQYEAAKNNKGAAKQGKKHEQTQVAATAAYRFGNVTPRVSYAHGFKAKVNGEKVARYQYDQVIVGADYDFSKRTSALVSVGWLKEGKGVNKTEKTASM

SEQ ID NO: 18277 - protein, 322 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTEDVLGLGTIGRVESREISVRYDSPVFAGFSGSVQYVPRDNANDVDKYKHTKSSRESYHAGLKYENAGFFGQYAGSFAKYADLNTDAERVAVNTANAHPVKDYQVHRVVAGYDANDLYVSVAGQYEAAKNNEVGSIKGKKHEQTQVAATAAYRFGNVTPRVSYAHGFKAKVNGVKDANYQYDQVIVGADYDFSKRTSALVSAGWLKQGKGAGKVEQTASM

SEQ ID NO: 18278 - protein, 323 aa, Neisseria meningitidis
EVSRVKDAGTYKAQGGKSKTATQIADFGSKIGFKGQEDLGNGMKAIWQLEQKASIAGTNSGWGNRQSFIGLKGDFGTVRAGNLNTVLKDSGDNVNAWESGSNTEDVLGLGTIGRVESREISVRYDSPVFAGFSGSVQYVPRDNANDVDKYKHTKSSRESYHAGLKYENAGFFGQYAGSFAKYADLNTDAERVAVGATDANPVKDYQVHRVVAGYDANDLYVSVAGQYEAAKNNTVSVGEQGKKHEQTQVAATAAYRFGNVTPRVSYAHGFKAKVNGKKAARYQYDQVIVGADYDFSKRTSALVSVGWLKEGKGVNKTEKTASM

SEQ ID NO: 18279 - protein, 329 aa, Neisseria meningitidis
EVSRVKDAGTYKAQGGKSKTATQIADFGSKIGFKGQEDLGNGMKAIWQLEQKASIAGTNSGWGNRQSFIGLKGDFGTVRAGNLNTVLKDSGDNVNAWESGSNTEDVLGLGTIGRVESREISVRYDSPVFAGFSGSVQYVPRDNANDVDKYKHTKSSRESYHAGLKYENAGFFGQYAGSFAKYADLNTDAERVAVGATDANPVKDYQVHRVVAGYDANDLYVSVAGQYEAAKNNTVSVGEQGKKHEQTQVAATAAYRFGNVTPRVSYAHGFKAKDGFKAKVNGKKAARYQYDQVIVGADYDFSKRTSALVSVGWLKEGKGVNKTEKTASM

SEQ ID NO: 18280 - protein, 116 aa, Neisseria meningitidis
ASYRKWNNNKYSVNTKELENKHNNKKDLKTENQENGTFHAASSLGLSAIYDFKLNDKFDKFKPYIGVRVAYGHVKHQVHSVGSKTTIVTSKPTKGATQPGKLVSGPTPKPAYHESN

SEQ ID NO: 18281 - protein, 1638 aa, Neisseria meningitidis
KPNFLKKIISAGLVTASTATIVAGFSGVAMGAAMQYNRTTNAAATTFDGIGFDQAAGANIPVAPNSVITANANNPITFNTPNGHLNSLFLDTANDLAVTINEDTTLGFITNIAQQAKFFNFTVAAGKILNITGQGITVQEASNTINAQNALTKVHGGAAINANDLSGLGSITFAAAPSVLEFNLINPTTQEAPLTLGANSKIVNGGNGTLNITNGFIQVSDNTFAGIKTINIDDCQGLMFNSTPDAANTLNLQVGGNTINFNGIDGTGKLVLVSKNGAATEFNVTGTLGGNLKGIIELNTAAVAGKLISQGGAANAVIGTDNGAGRAAGFIVSVDNGNAATISGQVYAKNMVIQSANAGGQVTFEHIVDVGLGGTTNFKTADSKVIITENSNFGSTNFGNLDTQIVVPDTKILKGNFIGDVKNNGNTAGVITFNANGALVSASTDPNIAVTNINAIEAEGAGVVELSGIHIAELRLGNGGSIFKLADGTVINGPVNQNALMNNNALAAGSIQLDGSAIITGDIGNGGVNAALQHITLANDASKILALDGANIIGANVGGAIHFQANGGTIKLTNTQNNIVVNFDLDITTDKTGVVDASSLTNNQTLTINGSIGTVVANTKTLAQLNIGSSKTILNAGDVAINELVIENNGSVQLNHNTYLITKTINAANQGQIIVAADPLNTNTTLADGTNLGSAENPLSTIHFATKAANADSILNVGKGVNLYANNITTNDANVGSLHFRSGGTSIVSGTVGGQQGHKLNNLILDNGTTVKFLGDTTFNGGTKIEGKSILQISNNYTTDHVESADNTGTLEFVNTDPITVTLNKQGAYFGVLKQVIISGPGNIVFNEIGNVGIVHGIAANSISFENASLGTSLFLPSGTPLDVLTIKSTVGNGTVDNFNAPIVVVSGIDSMINNGQIIGDKKNIIALSLGSDNSITVNANTLYSGIRTTKNNQGTVTLSGGMPNNPGTIYGLGLENGSPKLKQVTFTTDYNNLGSIIANNVTINDDVTLTTGGIAGTDFDAKITLGSVNGNANVRFVDSTFSDPRSMIVATQANKGTVTYLGNALVSNIGSLDTPVASVRFTGNDSGAGLQGNIYSQNIDFGTYNLTILNSNVILGGGTTAINGEIDLLTNNLIFANGTSTWGDNTSISTTLNVSSGNIGQVVIAEDAQVNATTTGTTTIKIQDNANANFSGTQAYTLIQGGARFNGTLGAPNFAVTGSNIFVKYELIRDSNQDYVLTRTNDVLNVVTTAVGNSAIANAPGVSQNISRCLESTNTAAYNNMLLAKDPSDVATFVGAIATDTSAAVTTVNLNDTQKTQDLLSNRLGTLRYLSNAETSDVAGSATGAVSSGDEAEVSYGVWAKPFYNIAEQDKKGGIAGYKAKTTGVVVGLDTLASDNLMIGAAIGITKTDIKHQDYKKGDKTDINGLSFSLYGSQQLVKNFFAQGNAIFTLNKVKSKSQRYFFESNGKMSKQIAAGNYDNMTFGGNLIFGYDYNAMPNVLVTPMAGLSYLKSSNENYKETGTTVANKRINSKFSDRVDLIVGAKVAGSTVNITDIVIYPEIHSFVVHKVNGKLSNSQSMLDGQTAPFISQPDRTAKTSYNIGLSANIKSDAKMEYGIGYDFNSASKYTAHQGTLKVRV

SEQ ID NO: 18282 - protein, 148 aa, Neisseria meningitidis
KLPGFSTANVNGEILFSKPLITTDPFWQAFVPRPTVGGSYNTGGRTSYAYIGATWTVDLFPETLDRRVFLEGFFGGAAHNGYTGLKANAPYGFNALGCNPLFREAAALGFRIDAHWSVMATVEHMSNAGLCGDNRGLTNFGGKLGYTF

SEQ ID NO: 18283 - protein, 416 aa, Neisseria sicca
MNHTPCVALGLTLLSQPLLAAEGGFFEDSKATLSARNYYFSRDFSDIVGANKQSKAEEWAQGFILDFKSGYTPGTVGFGVDALGLLGIKLDSSPDRANTGLLPVHGDGRAADEYSRLAPTFKARLSKTELRIGELQPNLPVLTFSDIRLLPPTYQGASLSSSEIDGLTLQAGHLKSTHLRNEGGDGKMNAMLGHVPMRQAESDAFNYVGGDYAFNANQSSVSLWYGQLEDIYEQGFVGLKHSKPVGDWVLSANLGYFTAREDGDALLGNIDNQAFFSMFTARHGGHSFHVGYQGIYGDSPFPRVFANISPLGNEVPTYEFAYTDERSYQVRYDYNFAAMGVPGLTATVRYITGNNVDTGLGYEGRDRERDLDIGYAVQSGVLKGLGIRVRNAMARSNYRSDIDENRLTLVYTWQLF

SEQ ID NO: 18284 - protein, 804 aa, Pseudomonas aeruginosa
MPVRTLRPRSLSLAIHAAAMTLALAGAAPALLAAEAPAASSARSYDIAPGPLGRTLSAFASDNGVSLAFDPALTEGRRSAALRGRYAPVEALHRLLLGSGLELQQRSDGSYTLVPATTDGALELQSSLITAQAAGAETLPAEYAGGQVARGARLGMLGNADVMDAPFSITSYTARTIEQQQARSVADLLQANDPSVRVVGGRGDLVDSYTIRGFSVQNADVAFNGLYGLLPFWRVPIEFAERVEVLKGPNALLGGISPGGSVGGTINLVPKRADDQPLTRVSVDWTQRGQLGTHLDIGRRFGENNAFGVRFNGVYRNGDTAVDHQSREFPMLSLGLDFRGERLRLSSDLLYQKESLEGVVRPLLTGPGTTHIPHAPDSKTRFGLRDSYLDQEDYSMVNRGEYDLADNLTAFASIGGRQSNYETIAANSILIGNQGDIVNSLARQRGDRRTYSAEVGLRGNFDTGPLRHDWTLSANRLHERLGMVYAFTGMQPGNLYQTSPHTPLPDFSSLDGSIPKTNETDLGGVALADRLSFLEDRVQVTLGVRRQQIESRNYDQTSGARTSHDKRHVWTPMASVLVKPLQDLSLYANYIQGLSQGEAAPMTAANAGQVLAPYKAEQYEIGAKYDLGGFTTTLALFEIRKPNAYTDASNVFRADGEQRNRGVELSLYGEPLDGVRVMAGATYIKPEQNKTGDPASEGKDAPGVARRQANLGVSWDTPFVDGLTLDSRWIYTGSAYVDSANALAVPHWNRVDLGAAYAFQVAGKPLVARANLENALGKDYWTAANGYLSISSPRTLSLSLTADF

SEQ ID NO: 18285 - protein, 97 aa, Plectonema boryanum
  misc_feature (29)..(29): Xaa can be any naturally occurring amino acid
AEVYNKDGNKLDLYGKVHAQHYFSDDNGXDGDTGRTTGVATYRNTDFFGLVEGLNFAATFGEDAAGDAFIANKTQNFSTFVDYKINLLDDNDFTKAA

SEQ ID NO: 18286 - protein, 317 aa, Pseudomonas fluorescens
KNTLGLAIGSLIAATSFGVLAQGQGAVEGELFYKKQYNDSVKHIEDGFNPGARIGYFLTDDLSLNLSYDKTNHTRSNDGTGSQKIKGDTGSLVAQYHFGQAGVDSLRPYVEGGFGHQSRGNVQADGHSGRDQTTFATVGTGVKYYFTNNLYARAGVEADYGLDNGKWDYSALVGLGVNFGGNAGAAAPAPTPAPAPEPTPEPEAPVAQVVRVELDVKFDFDKSVVKPNSYGDVKNLADFMAQYPATNVEVAGHTDSVGPDAYNQKLSQRRADAVKQVLVKDGVAPSRVTAVGYGESRPVADNATEAGRAVNRRVEAS

SEQ ID NO: 18287 - protein, 317 aa, Pseudomonas fluorescens
KNTLGFAIGSLIAATSFGALAQGQGAVEGQLFYKKQYNDSVKHIEDGFNPGASIGYFLTDDVSINLNYDTTNHTRSNDGTGSQKIKGDTGSVTAQYHFGQAGVDSLRPYVEGGFGHQSRTNVEVDGHKGRDQSTLAIAGAGVKYYFTNNLFARAGVESDYNLDNGKWDYSALVGLGVNFGGNAGAVAPAPTPAPAPEPTPEPEAPVAQVVRVELDVKFDFDKSVVKPNSYGDVKNLADFMKQYPQTTTVVEGHTDSVGPDAYNQKLSQRRADAVKQVLVKDGIAPNRVSSVGYGKSRPVADNATEAGRAINRRVEAS

SEQ ID NO: 18288 - protein, 136 aa, Pseudomonas fluorescens
KNPLSVKPSVGVSYNHLGSTNFESNSTNKTALKNGASSQHLFNASANVEARYYYGDTSYFYMNAGVLQEFANFGSSNVVSLNTFKVNTARNPLNTHARVMMGGELKLAKEVFLNLGFIYLHNLISNAGYFASILGM

SEQ ID NO: 18289 - protein, 317 aa, Pseudomonas fluorescens
KNTLGLAIGSLIAATSFGVLAQGQGAVEGELFYKKQYNDSVKHIEDGFNPGARIGYFLTDDLSLNLSYDKTNHTRSNDGTGNQKIKGDTGSLVAQYHFGQAGVDSLRPYVEGGFGHQSRTNVKVDGHSGRDQTTFATIGTGVKYYFTNNLYARAGVEADYGLDNGKWDYSALVGLGVNFGGNAGAAAPAPTPAPAPEPVPEPEAPVAQVVRVELDVKFDFDKSVVKPNSYGDVKNLADFMAQYPDTNVEVAGHTDSVGPDAYNQKLSQRRADAVKQVLVKDGVAPSRITSVGYGESRPVADNATEAGRAVNRRVEAA

SEQ ID NO: 18290 - protein, 317 aa, Pseudomonas fluorescens
KNTLGLAIGTLIAATSFGALAQGQGAVEGELFYKKQYNDSVKHIEDGFNPGARIGYFLTDDLSLNLSYDKTNHTRSNDGTGNQKIGGDTGSLTAQYHFGQAGVDSLRPYVEGGFGHQSRSNVEADGHKGRDQSTLAIAGAGVKYYFTNNLYARAGVEADYAIDNGKWDYSALVGLGVNFGGNAGAAAPAPTPAPAPEPTPEPEAPVAQVVRVELDVKFDFDKSVVKPNSYGDVKNLADFMKQYPQTTTVVEGHTDSVGPDAYNQKLSQRRADAVKQVLVKDGIAPNRVSSVGYGKSRPVADNATEAGRAINRRVEAS

SEQ ID NO: 18291 - protein, 296 aa, Pseudomonas fluorescens
KNTLGLAIGSLIAATSFGVLAQGQGAVEGELFYKKQYNDSVKHIEDGFNPGARIGYFLTDDLSLNLSYDKTNHTRSNDGTGNQKIKGDTGSLVAQYHFGQAGVDSLRPYVEGGFGHQSRTNVQADGHSGRDQTTFATVGTGVKYYFTNNLYARAGVEADYGLDNGKWDYSALVGLGVNFGGNAGAAAPAPTPAPAPEPTPEPEAPVAQVVRVELDVKFDFDKAVVKPNSYGDVKNLADFMAQYPATNVEVAGHTDSVGPDAYNQKLSQRRADAVKQVLVKDGVAPSRVTAVGYGGS

SEQ ID NO: 18292 - protein, 453 aa, Pseudomonas putida
MKIASVLALPLSGYAFSVHATQVFDLEGYGAISRAMGGTSSSYYTGNAALISNPATLSFAPDGNQFELGLDVVTTDIKVHDSHGAEAKSSTRSNNRGPYVGPQLSYVAQLDDWRFGAGLFVSSGLGTEYGSKSFLSQTENGIQTSFDNSSRLIVLRAPIGFSYQATSKLTFGASVDLVWTSLNLELLLPSSQVGALTAQGNLSGGLVPSLAGFVGTGGAAHFSLSRNSTAGGAVDAVGWGGRLGLTYKLTDNTVLGAMYNFKTSVGDLEGKATLSAISGDGAVLPLDGDIRVKNFEMPASLTLGLAHQFNERWVVAADIKRAYWGDVMDSMNVAFISQLGGIDVALPHRYQDITVASIGTAYKYNNDLTLRAGYSYAQQALDSELILPVIPAYLKRHVTFGGEYDFDKDSRINLAISFGLRERVQTPSYLAGTEMLRQSHSQINAVVSYSKNF

SEQ ID NO: 18293 - protein, 317 aa, Pseudomonas tolaasii
KNTLGLAIGSLIAATSFGVLAQGQGAVEGELFYKKQYNDTVKHIEDGFNPGARIGYFLTDDLSLNLSYDKTNHTRSNDGTGNQKIKGDTGSLVAQYHFGQAGVDSLRPYVEGGFGHQSRTNVQADGHSGRDQTTFATVGTGVKYYFTNNLYARAGVEADYGLDNGKWDYSALVGLGVNFGGNAGAVAPAPTPAPAPEPTPEPEAPVAQVVRVELDVKFDFDKSVVKPNSYGDVKNLADFMAQYPATNVEVAGHTDSVGPDAYNQKLSQRRADAVKQVLVKDGVAPSRITAVGYGESRPVADNATEAGRAVNRRVEAS

SEQ ID NO: 18294 - protein, 289 aa, Rahnella aquatilis
EISLNGYGRFGLQYVEDRGVGLEDTIISSRLRINIVGTTETDQGVTFGAKLRMQWDDGDAFAGTAGNAAQFWTSYNGVTVSVGNVDTAFDSVALTYDSEMGYEASSFGDAQSSFFAYNSKYDASGALDNYNGIAVTYSISGVNLYLSYVDPDQTVDSSLVTEEFGIAADWSNDMISLAAAYTTDAGGIVDNDIAFVGAAYKFNDAGTVGLNWYDNGLSTAGDQVTLYGNYAFGATTVRAYVSDIDRAGADTAYGIGADYQFAEGVKVSGSVQSGFANETVADVGVRFDF

SEQ ID NO: 18295 - protein, 315 aa, Rhodobacter capsulatus
MKKLLIASTALVMVAGAAAAEVKLSGDARMGAVYDSEDWNFSSRSRVQFTLSGTTDSGLEFGAKFRTSDIRNAEDPRNGNRGTVFLSGAFGKITMGDIASASEELFGDLADVGYLGDDQGTAGITFAGLGTNAIPYLTLDNETTSGLMYTYSAGAFSVAAAMTDGHGYGSLAAGTFEADTQSYSVAAAYTFGNYTVGLGHEILDRDGAGLDMSQTELAGMAKFGNTDVKGYYPSAATKTRLTTAIGLSVASFGATTVKGYVQKVDFVAAGVDSVTWYGLGADYDLGGGAILAAGIQDDDVDGSDPVANMGVKFKF

SEQ ID NO: 18296 - protein, 319 aa, Rhodobacter capsulatus
MKKLLIASTALVATSGFAYADVTLGGSAQFGIIYIEDRADPVDPTEDEELFLDYELQFDFSASGETDGGLGFGMSAELESDSDAEGNQLSDNNVDPEIFITSGFGTLTVGALDTAPDQAGFGNTRDPGYDGVGVDNLIDAILFLDAGALFNADEGGKSNIMYQGSFGGLSLTATAHAHEQDFGIVAEYDFGAFRAGLSYMEVDEVEIDGDLGGGDTIGVTVGGTFAGFDLDFVYADHSNDFDVDAEAYGLSGAYDLGAYGITFGVNQVEIGDVDGTTYGIGVEYDLGGGAELQAGVASLWDPEDDDNFTTASFGIAMSF

SEQ ID NO: 18297 - protein, 350 aa, Enterobacter sakazakii
MKKTAIAIAVALAGFATVAQAAPKDNTWYAGAKLGWSQYHDTGFINNDGPTHENQLGAGAFGGYQVNPYVGFEMGYDWLGRMPYKGDNINGAYKAQGVQLTAKLGYPITDDLDVYTRLGGMVWRADTKSNVPGGPSTKDHDTGVSPVFAGGIEYAITPEIATRLEYQWTNNIGDANTIGTRPDNGLLSVGVSYRFGQQEAAPVVAPAPAPAPEVQTKHFTLKSDVLFNFNKSTLKPEGQQALDQLYSQLSNLDPKDGSVVVLGFTDRIGSDAYNQGLSEKRAQSVVDYLISKGIPSNKISARGMGESNPVTGNTCDNVKPRAALIDCLAPDRRVEIEVKGVKDVVTQPQA

SEQ ID NO: 18298 - protein, 302 aa, Neisseria gonorrhoeae
LIALTLAALPVAAMADVTLYGTIKAGVETYRFVAHNGAQASGVETATEIADLGSKIGFKGQEDLGNGLKAIWQLEQKAYVSGTNTGWGNRQSFIGLKGGFGKVRVGRLNSVLKDTGGFNPWEGKSEYLSLSNIARPEERPISVRYDSPEFAGFSGSVQYVPNDNSGENKSESYHAGFNYKNSGFFVQYAGSYKRHNYTTEKHQIHRLVGGYDHDALYASVAVQQQDAKLAWPDDNSHNSQTEVATTVAYRFGNVTPRVSYAHGFKGSVYEANHDNTYDQVVVGAEYDFSKRTSALVSAGWLQ

SEQ ID NO: 18299 - protein, 323 aa, Neisseria gonorrhoeae
LIALTLAALPVAATADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKGNVNAWESGKFTGNVLEISGMAKREHRYLSVRYDSPEFAGFSGSVQYAPKDNSGPNGESYHVGLNYQNSGFFAQYAGLFQRYGEGTKKIEYDGQAYSIPSLFVEKLQVHRLVGGYDNNALYVSVAAQQQDAKLYGTWRANSHNSQTEVAATAAYRFGNLTPRVSYAHGFKGSVHSADYDNTYDQVVVGAEYDFSKRTSALVSAGWLQ

SEQ ID NO: 18300 - protein, 323 aa, Neisseria gonorrhoeae
LIALTLAALPVAATADVTLYGAIKAGVQTYRSVEHTDGRVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYDGQAYSMPSLFVEKLQVHRLVGGYDNNALYVSVAAQQQDAKLYGATRVNSHNSQTEVAATAAYRFGNVTPRVSYAHGFKDTVDSANHDNTYDQVVVGAEYDFSKRTSALVSAGWLQ

SEQ ID NO: 18301 - protein, 302 aa, Neisseria gonorrhoeae
LIALTLAALPVAAMADVTLYGTIKAGVETSRSVAYHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGFYKRHNYTTEKHQVHRLVGGYDHDALYASVAVQQQDAKLTWSNDNSHNSQTEVAATAAYRFGNVTPRVSYAHGFKGSVYDADNDNTYDQVVVGAEYDFSKRTSALVSAGWLQ

SEQ ID NO: 18302 - protein, 1055 aa, Neisseria gonorrhoeae
LHYTLGGSLDANNIDFGARSTLEFNGGGGIPYYFKGAIANGNNAILNVNTKLLTAYHLTIGTVAEINIGAGNIFAIDASAGDVTILNAQDIHFRALDSTLLLSNLTGVGVNNILLAADLVAPGADEGTVVFNGGVNGLNIGSNVAGTARNIGDGGGNKFNALLIYNAVTITDDVNLEGIQNVLINNNADFTSSTAFNAGAIQIQNATYTIDANNGNLNIPAGNIQFAHADAQLILQNSSGNDRTITLGANIDPDNDNEGVVILNSVTAGKKLTIAGGKTFGGAHKLQTIVFKGAGDCSAAGTTFNTTNIELDITGKLELGATKANVVLFNDAVQLTQTGHIGGFLDFNAKNGTVTLNNNVSVAGAVQNTGGTNNGTLIVLGASNLNRVNGIAMLKVGAGNVTIAKGGNVKIGEIQGTGTNTLTLPANFNLTGSINKTGGQALKLNFTNGGSVKGVVGTAANSVGDITTAGATSFASSVNAKGTATLGGTTSFANTFTNTGAVTLAKGSITSFAKNVTATSFVANSATINFGNSLAFNSNITGSGTTITLGANHVTYTGTGSFTDTLTLNTTFDGAAKSGGNILIKSGSTLDLSGVSTLALVVTATNFDMNNISPDTKYTVISAETAGDLKPTPKENVKITINNDNRFVDFTFDASTLTLFAEDIAADVIDEDFAPGGPLANIPNAANIKKSLELMEDAPNGSDARQAFNNFGLMTPLQEADATTHLIQDVVKPTDTIAAVNNQVVASNISSNITALNARMDKVQVVNKGPVPSGDEDMDAKFGAWISPFVGNAKQKMCNNISGYKSDTTGGTIGFDGFVSDDLALGLAYTRSDTDIKLKNNKTGDKNKVESNIYSLYGLYNVPYENLFVEAIASYSDNKIRSKSRRVIATALETVGYQTANGKYKSESYTGQLMAGYTYMMPENINLTPLAGLRYSTIKDKGYKETGTTYQNLTVKGKNYNTFDGLLGAKVSSNINVNEIVLTPELYAMVDYAFKNKVSAIDARLQGMTAPLPTNSFKQSKTSFDVGVGVTAKHKMMEYGINYDTNIGSKCFAQQ

SEQ ID NO: 18303 - protein, 302 aa, Neisseria gonorrhoeae
LIALTLAALPVAAMADVTLYGTIKAGVETSRSVAYHGAQAGRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSEPYHAGFNYKNSGFFVQYAGFYKRHNYTTEKHQVHRLVGGYDHDALYASVAVQQQDAKLTWSNDNSHNSQTEVAATAAYRFGNVTPRVSYAHGFKGSVYDADNDNTYDQVVVGAEYDFSKRTSALVSAGWLQ

SEQ ID NO: 18304 - protein, 185 aa, Wolbachia endosymbiont
SYYVRLQYNGEILPFYTKVDGIKNAKDKEKDSPLTRSFIAAGGAFGYKMDDIRVDVEGLYSQLAKDTAVVDTSETNVADSLTAFSGLVNVYYDIAIEDMPITPYVGVGVGAAYISNPSKADTVKDQKGFGFAYQAKAGVSYDVTPEIKLFAGARYFGSYGASFDKAANDDTGIKNVVYSTVGAEA

SEQ ID NO: 18305 - protein, 184 aa, Wolbachia endosymbiont
SYYVRLQYNGEVLPFKTRIDGVKYKSGKDNNSPLKASFLAGGGAFGYKMDDIRVDVEGLYSQLSKDADVVDTSPEVVESLTAFSGLVNVYYDIAIEDMPITPYVGVGVGAAYVSNPLVTEVTGDKKSGFGFAYQAKAGVSYDVTPEIKLYAGARYFGSYGANFGKAAKDDGGIKVLYSTVGAEA

SEQ ID NO: 18306 - protein, 163 aa, Wolbachia endosymbiont
  misc_feature (16)..(17): Xaa can be any naturally occurring amino acid
SYYVRLQYNGEFLPLXXKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPFEPAVNDQKSKFGFAGQVKAGVSYDVTPEVKLYAGARYFGSYGA

SEQ ID NO: 18307 - protein, 186 aa, Wolbachia endosymbiont
SYYVRLQYNGEVLPFKTRIDGIKYQKGTEVHDPLKASFMAGGAAFGYKMDDIRVDVEGLYSQLNKNDVNGAAFIPTTVANSVAAFSGLVNVYYDIAIEDMPITPYVGVGVGAAYISNPSEASAVKDQKGFGFAYQAKAGVSYDVTPEIKFFAGARYFGSYGASFNKEAVSATKEINVLYSAVGAEA

SEQ ID NO: 18308 - protein, 184 aa, Wolbachia endosymbiont
SYYVRLQYNGEILPFYTKVDGIKIATGKEKDSPFTRSFIAGGGAFGYKMDDIRVDVEGLYSQLAKDTAVVGTTETSVADSLTAFSGLVNVYYDIAIEDMPITLYVGVGVGAAYISNPLNDTTVKDQKGFGFAHQAKAGVSYDVTPEIKLYAGARYFGSYGASFDKDKSSDTKINVLYSTVGAEA

SEQ ID NO: 18309 - protein, 184 aa, Wolbachia endosymbiont
SYYVRLQYNGEVLPFKTRIDGVKYKSGKDNNSPLKASFLAGGGAFGYKMDDIRVDVEGLYSQLSKDADVVDTSPEVVESLTAFSGLVNVYYDIAIEDMPITPYVGVGVGAAYVSNPLVTEVTGDKKPGFGFAYQAKAGVSYDVTPEIKLYAGARYFGSYGANFGKAAKDDGGIKVLYSTVGAEA

SEQ ID NO: 18310 - protein, 184 aa, Wolbachia endosymbiont
  misc_feature (17)..(17): Xaa can be any naturally occurring amino acid
  misc_feature (178)..(178): Xaa can be any naturally occurring amino acid
SYYVRLQYNGEVLPFKXKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARYFGSYGANFGKTAKDDGGIKVLYXTVGAEA

SEQ ID NO: 18311 - protein, 185 aa, Wolbachia endosymbiont
SYYVRLQYNGEILPFYTKVDGIKNAKDKEKDSPLTRSFIAAGGAFGYKMDDIRVDVEGLYSQLAKDTAVVDTSETNVADSLTAFSGLVNVYYDIAIEDMPITPYVGIGVGAAYISNPSKADTVKDQKGFGFAYQAKAGVSYDVTPEIKLFAGARYFGSYGASFDKAANDDTGIKNVVYSTVGAEA

SEQ ID NO: 18312 - protein, 180 aa, Wolbachia endosymbiont
SYYVRLQYNGEILPFYTKIDGITYASGKSPLKASFLAGGGAFGYKMDDIRVDVEGLYSQLAKDAAVVSDGEAADSVTAFSGLVNVYYDIAIEDMPITPYVGVGVGAAYISNPSKVHAVKEQKGFGFAYQAKAGVSYDVTPEIKLFAGARYFGSYGASFDKAAKDDTGIKNVLYSTVGAEA

SEQ ID NO: 18313 - protein, 108 aa, Uncultured bacterium
MRKSLLALSLLAATSAPVLAADYSDGDIHKNDYKWMQFNLMGAFDELPGKSSHDYLEMEFGGRSGIFDLYGYVDVFNLATNKSSDKVGDPKNLHEVCSTYVSGCIYWR

SEQ ID NO: 18314 - protein, 170 aa, Serratia marcescens
MKKIACLSALACVLAVSAGSAVAGTATVTGGYAQSDAQGVMNKMNGFNLKYRYEFDDSNPLGVIGSFTYTEKDRTEDGVYGKNQYYGITAGPAYRINDWASIYGVVGVGYDKAQATNGTDKADTSDYGFSYGAGLQFNPVQDVALDFSYEQSRVRNTDIGTWIAGVGYRF

SEQ ID NO: 18315 - protein, 1119 aa, Serratia marcescens
MEKKKFVRKQERFVLFLMLLLLFPLGALAQQKLIKGQVVDEMGEPIIGATVMVKGVTGGTITDIDGNFSIQGKVGSTLSVTYVGYAPLQVKVTKQEGNRLVMKEDAKVLDEVVVVGMDTQKRNTITAAVATLKDDAIVNRPVTDVTSALQGNIAGLNFASDAVGGGVGGEIGADIKFSIRGIGSINGGEPYVLVDGVEQSMQNVNPADIASISVLKDASASAVYGARAAYGVVLVTTKSGKKERASVTYRGTVGFSAPINMPKMMNALEYAAYNNQQYDNGGASSGLQKISDKTIEKIKGFMQNPYSAEFPGIEANTTGDDWAGAYYNQYGNTDWFEYYFKDKSVRHSHNLSVQGGSDKVNYYIGMGYTYQEGLLDKVQDDLSKYNLNTKLQFKTSDWLRFNLNNNITLQMIKRPMANQMILYNKIGSHRPTQVTELPVESEYNIPSWNEMLYLKNSNYQRNRISDALSFSATVTPLEGWDITGEMKIRFDVENNNLKMKDDQKYETPAGTFKPGDATNQRQGFAYPGISWKNMYFGSYTRGSMFNYYLSPNLSSSYTHQWGDHFFKAMAGYQMELQEYSEEYMYKDGMLSNDIYSFDNASGNVIAGEARSHWATMGFYTRLNWNYNNIYFLEFSGRYDGSSRFAPGHRWGFFPSFSAGYDIARTPYFQQLALPVSQLKVRVSYGRLGNQNGAGLYDYIAQMPLDAQGTNAWLLPGISSSTASKGTIAKTPKMISPYITWEKVDNANLGFDLMLLKNRLSITADFYQRTTRDMIGPAESIPSISGIASDDRAKVNNATLRNRGWELSVSWNDKLKCGFSYGVGFNVFNYKAVVTKYNNPEGIIYNNHTGLAANKGYYEGMDIGEIWGYRADDLFLSNREIDDYLRNVNLTAFKSNDLWRRGDLKYIDSNGDGRVDGGKGTLADHGDLQIIGNTTPKYSFGINLNLGYKGFEVSTLLQGVAKRDFPISGSNYMFGGNNYNFKEHLDYFSTENPNGYLPRLTGWKDDKDFLVNTGYNTTRYLLNAAYMRMKNLTVAYTFNKKQLKHIGISNLKVYVTCDNLFTVTKLPKQFDPETLNQVNMSAGGDAQNTAPGLTSPMKQNGNGMVYPMNRNFVFGLDFTF

SEQ ID NO: 18316 - protein, 585 aa, Serratia marcescens
MTTTKRRGIFPLHALAAATALGCATQASAVSFNIGEIEGQFDSSLSVGASWSMRSADKDYIGTRNGGHASSQTSDDGRLNFKKGETFSKIFKGIHDLELKYGDTGAFFRGKYWYDFELKDEHRLLYDIDDHNRKEGAKSSGAQLLDAFLYHNYSIGDLPGSVRVGKQVVSWGESTFIQNSINSINPMDVAAFRRPGAEIKEGLIPVNMLYLSQGISDALTVEGFYQLEWDQTVIDNCGTFFSTTDVVADGCERMVYAGSDFDPNPANGYRYLPRAGDRDARDSGQWGLALRWYAAELNDTEFGLYAMNYHSRNPYYSVIAGNGLATSDPVTGRSTGYYFIDYPEDIRLYGLSFQTNIGSTSVAGELSYRPNMPLQINSTDMSIAAIYPTTLFGNPIYDSGFATPRAGEVINGYVRKPVTQAQVTVTQFFDRVLAADRLTVVGEVGYNHLSGVDGDDLRYGRDAIYGIGELPNNALCTGALNVANPQECNSHGFYTRNSWGYRLRGILEYPNVFAGVNLKPNLAWSHDVEGYGPNFSEGAKAVSVGLDADYQNTYTASISYTDFFGGNYNPINDRDFLAVSFGVNF

SEQ ID NO: 18317 - protein, 1493 aa, Vibrio cholerae
MYKKSLLLCTAAIAVTLFGTHFNAYAENLEVADGKVEKISQKTYETIHAKPGGKITGEKLTITGNKDTNKDTYVVKAEGDNSEITLTGSTIKSNDNDSDIHLGIKAKDGAKIKMTGGRITAIESGASFENSRSENELTTVIISGKDDHFIDKGINATHSNLTLKDTTVSLANNGIFAEDHSAIKVSSGVFNGKTNGVYAKQGSSITLDGKTTVTSSEGNGIHTEDSGAKVTMVEGTVSGKQNALFAEKGGKIDVSNITLTANGTGTGAKADGSNSTVELHKNTTIKDAFIGLQANGGTIKMTDGSITASIIGAVFSDSKSNENENKLENVTISSGQSGRFIDKGINAEKSTVTLNKVTVTNANTGIFANDDSTITVSEGSFDGKTNGVYAKQGSSITLDEKTTVTSSEGNGIHAEGSEAKITKTGGTVSGKQNALFAEKGGKIDVTDVALTTTDGKGTGAKADGTDSVITLKGKTTIEKVANGLEIENGATIKMTDGSITASQIGAVFNASKSNENKLENVTISSGKGNPLMDKGINAEKSTVTLNKVTVTNANTGIFANDDSTITVSEGSFDGKTNGVYAKQGSSIILDEKTTVTSSEGNGIHAEGSEAKITKTGGTISGKQNALFAEKGGKIAATDVTLTTDGRGTGAFAHGEKSTIELHGNTTINNTFNGLGASVGGKITSENLTITGGKAINLETPEVQSAVWVGESGEINLTGTTTIRHFDEGLYADSGGKIVSGDLTIIGGESKKATIGVSTWESESKIELNGNTTIQNTDIGLGAIEDATIKMKNGTKNEIKAKKNVLAVVNGGHMDLTNLSATAEIGGLQFANSTDNDPHEHNDPQKYRSNEINLNHAIFNIDNGRGILIGAIVEKSIENSPALSIGTLNLKDSEIHADILLDDGIFWNKISWQDKNMWDGKEVKEIANGSFTLNADHSTLEGRANIAKERNVSFNLTNGTQWFLKNSTQEKDTDGNLLDIAQRSRSDISVLSLENSSVVFKEPTEDHYHTLHIGSGKPDTQEVYNATGDAKIYFNAEWSDGVAIADQKTDRLLINGNVAGTTAVYVTGRLEDNNVKQNISTASNIRGLSLIQVSGKATEDSFKLVNGYTTRDGLPDKYTLRAYGPESSHGQANIEQNLFDEKNENFWDFRLQPELLGTDSGSGSGTGSGSSPSVIAPVPQTASYLVMPNALFHAGLTDIAKQNALLATMRTSVLGKEEEKQTGFFLYTYGNTATLSSERGPLKYGYGADIRYAALQAGVTLAAIEGQNTSTHLGFVGTYGQLSFTPKNIADAGKSTLDKWALTAYGSIQHSSGFYIDTLLSYGILKGHIANALIGKTAKLNNAKMFSISTTVGKEFATGVEGLTFEPQAQVAYQHLMFNTIEDADNFTIDMKNPSQWLIRVGGRLTKTISTENNRPMSFYGKVNLIKTFGDDGSIHIGRDFELDPMGPAIEGGVGINAQLSHNFSLHGDVSYQQKLQKTGISGASFSGGIRYQF

SEQ ID NO: 18318 - protein, 211 aa, Vibrio cholerae
MYQPDFPPVPFRSGLYPVVDSVQWIERLLDAGVRTLQLRIKDRRDEEVEADVVAAIALGRRYNARLFINDYWRLAIKHQAYGVHLGQEDLQATDLNAIRAAGLRLGVSTHDDMEIDVALAARPSYIALGHVFPTQTKQMPSAPQGLEQLARHVERLADYPTVAIGGISLARAPAVIATGVGSIAVVSAITQAADWRLATAQLLEIAGVGDE

SEQ ID NO: 18319 - protein, 702 aa, Xanthomonas campestris
MIDFRFAAGLLAIPLLASAGPAAAQQPETPETVTTGEAGEQPPRVWGLDQITVTTTGLGTPRATHTGNIAKISGDDVDFIAPVQPAEALNRLPGVGIQQGSGAEHLTAIRSPVLSGGAGAGSFLYLEDGVPMRAAGFANVNALMEAMDEVSGGIEVVRGPGGARYGSNAEHGLINFLSRPPAPDSDAELSAWAGPHDLFKIAGTASKTLRGEGLATHGFRGSFSTLHDGGFRASSGLDQQKARLRYDFETPETRMQATLTAVNVNQETAGFVVGPDAYKNPALYKTNPDPDAYRDAWAVRAAVRIERDLADDLMLVLTPYARKNDMNFLMHFMPGTPVEENAHWSGGLLSSLVKDLDDGHRLIFGFDSEYTDGTLTEFQEGPTVGISPQGLHYDYTVKALVLAPYLHSEWRLSPATLFTAGVRFEYTRYDYTNHAPNGTFGRFLRIPSRVDEFADVTPKFGVLHKFNDAITGYVNIARGSRAPQTTDLYRLQQFQVPGEAKSEELDSIEIGARGEWMGVSYETNLFYMEKSNFYFRDANGFNVSDGKTDHAGIEAEIAAPLGAGFDIAAAATYARHTYAFDNFISPTSTETIRDGDDVDTAPRTLANVRLGYVFNEGAGRAEIEWVHMGAYWMDAANTAKYDGHDIFNIRLDYTLTEHLALFGKVTNVFDTRYADRADFAFGNERYFPGEDRGLILGASLRF

SEQ ID NO: 18320 - protein, 1182 aa, Rickettsia africae
MKLSVVIRVTAVTFLLCLSGAALFAQSERGTISGTVTDASGAAVPEVKVTVTERSTNTSVTTVTNSAGDYTLPNLPTGQYNAHFERAGFASAGINGIKLDAAATARADATLTVGSTKQTIEVTAAAAQLQASDSKTSATVTNQMVDQLPLVVSGSVRSPFDLANITPESKNLGGDNGFILGGGQAASYGTTLDGVSTNTSRALSMSWVSSNAPSLEAITEFTVDTNGFKAEYGHAGGGVMTFSSKSGTNQVHGSAYEYLRNNDFDANRFFSNAAGVPRAIYKQSDFGGSFGGPIYIPKIHKGKDKSFFFFAYEGFRNRVGATAFSTTVPTSEMYKGDFSKWVNASGQVIPIYDPTTQVVNATTGAVTRTPFANNQIPTNLIAPEATKALGVFASGAGGQIAPNNGAAPGTAAYVNNNYLVTNGSQVNPINKFSIKGDHYFSAKDHLSGYYGYDREKATPGPNGPSTLPGNYTNYNDLTQSSDVFRMSWDHTFGPTKYNHFYAGGNNWRQNHDSPQEYIGGWKSKFCLPNAPDCDLNLVNFTFSNSYGQWGAPANNGSENTIYSFNDDFTWVKGSHTLKAGGMYQLTHYNGFGRQCVSGCAGFSFTETGRGGDTNFATAGGNPFASLLLGYADSGSLDTIRFIGQQFGYFAGYIQDDWRVSRKLTVNYGVRWENQMPSTGLDDRWSDFSPTTPNPAANNIPGAVIFAGSGPGRVGSRTLADSYFKAFGPRLGFAYTVNDKTVIRGGAGISYGAIASVTGSTHNMGFTLTQSFSNSNNGISPTFTLAQGLPPWTAPPFVNPSVSNGANVAWYQGREGARPPEDLSINLSIQRQISSSMVLEGSYNGVMGSHLQTGLLQYNQLNPAYLAKYGTALLTSSITSAGAVAAGLSSPFPAFTSLWGSRGTVAQALRPFPQYANIDTAAGGGDHSGHSTYHAGIVKLERRFSSGLTFTTSYVFSKLLTDSDSYWPGSAAADFYNRGLEKSIGSYDVTHNFKMSVVYDLPVGKGKPWLSHGVGAYVLGNWRLGFISAYASGTPVSVGTSYSLPIFNGRTPAYVSSYEGWRAQTKGGSFDPAVDNFFVPYGSGPFPLQGTGTALNGLGNETRNNPKVRLFPNLSENLSLAKTFPIKERVKLDFRVETFNTFNRVRFGTGNTQLQSPLFGKLTSNGDLLNTPRTMQLAAKLYF

SEQ ID NO: 18321 - protein, 514 aa, Rickettsia africae
KGPSSVLYGRSNPGGLASLTTKRPQFTDAARIDLTYGSNDYKSLGFDVTGPLNENIAYRVVGVAKDADSQVDYVEETRYTLMPSLTLNLSEDTSLNLYAYLQRDPNGGYHGSLPASGTLDKRNGRRLSGSFFEGDPDIEEFKRTQTMVGYEFQHRFNDVWSARQNVRYLDAEVENSQVWQSGYYGATSDLLYRGFSGGEESLHAWIVDNMLQSEFATGSALHTVVFGLDYQYTKNKTLDEFDFTSVSPLDIANPIYPDNALSDLAVSSNALRRQKQAGLYVQDLIELGSWNLSLGLRQDWYDVSIDDAVRGKDANQGEKLSGHVGVLYAFENGISPYLSYSTSFNPTSNYSSGAQILEPTTGKQWETGVKYQPVGSDDLYTLSFFTIDMENLFAKENSLVTDNFYKGVGGVKSRGVELEARVSVTQNLRLLGSVTLNDVEYSKSYYAYNSAGGVVDAKGNTPYQTPERMASLWADYNFADELLAGLNIGAGARYVGYSWGNDAHDFKVPSYTLF

SEQ ID NO: 18322 - protein, 186 aa, Wolbachia endosymbiont
SYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYK

SEQ ID NO: 18323 - protein, 193 aa, Wolbachia endosymbiont
SYYVRLQYNGEILPLFTKIDGIDYKKGTDIYSPLKASFIAGGGAFGYKMDDIRVDVEGVYSYLNKNDVKDVTFDPANTIADSVTAISGLVNVYYDIAIEDMPITPYVGVGVGAAHISTPLKTAVDSQTYKFGFAGQVKAGVSYDVTPEIKLYAGARYFGSYGANFDGKKTDPQDLTKQVTDAGAYKVLYSTVG

SEQ ID NO: 18324 - protein, 186 aa, Wolbachia endosymbiont
  misc_feature (153)..(153): Xaa can be any naturally occurring amino acid
SYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAXARYFGSYGASFNKEAVSATKEINVLYSAVGAEA

SEQ ID NO: 18325 - protein, 195 aa, Wolbachia endosymbiont
SYYVRLQYNGEILPLFTKIEGIEYKKATDIHNPLKASFIAGGGAFGYKMDDIRVDVEGVYSYLNKNDVTDAKFTPDTIADSLTAISGLVNVYYDIAIEDMPITPYVGVGVGAAYISTPLKDAVNDQKSKFGFAGQVKAGVSYDVTPEVKLYAGARYFGSYGANFDGKKTDPKGSTRQVTDAGAYKVLYSTVGAEA

SEQ ID NO: 18326 - protein, 160 aa, Wolbachia endosymbiont
SYYVRLQYNGEFLPLFTKVDGITYKKDKSDYSPLKPSFIAGGGAFGYKMADIRVDVEGVYSYLNKNDVKDVTFDPANPIADSVTAISGLVNVYYDIAIEDMPITPYIGVGVGAAYISTPLEPAVNDQKSKFGFAGQVTAGVSYDVTPEVKLYAGARYFGS

SEQ ID NO: 18327 - protein, 182 aa, Wolbachia endosymbiont
SYYVRLQYNGEILPLFTKIDGIKNAAGKEKDSPLKASFIAGGGAFGYKMDDIRVDVEGLYSQLNKDAGVAGTTVADNLTAISGLVNVYYDIAIEDMPITPYIGVGVGAAYVSNPLATKVTDDKASGFGVAYQAKAGISYDVTPEIKLYAGARYFGSYGANFGKTTKDDAGIKVLYSTVGAEA

SEQ ID NO: 18328 - protein, 140 aa, Wolbachia endosymbiont
YKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGA

SEQ ID NO: 18329 - protein, 144 aa, Wolbachia endosymbiont
GEERHHLSLLSASYGQMISGVKGADSWYRGNWELRGEILGGMQFNSETSWLLGITPHVRYHFSTGAPWVPYADFGLGITATEIREPDLGGSFQFNLQAIIGVNYFVRDNLAVNFEGRYIHLSSAGFFEPNNGVNSIGIFLGVNT

SEQ ID NO: 18330 - protein, 184 aa, Wolbachia endosymbiont
SYYVRLQYNGEFLPLFTKVDGITNATGKEKDSPLKASFIAGGGAFGYKMDDIRVDVEGLYSWLNKDADVVGDTVADNLTAISGLVNVYYDVAIEDMPITPYIGVGVGAAYISTPLKTPINDQKSKFGFAGQVKAGVSYDVTPEIKLYAGARYFGSFGAHFDKSEEVDKAGGGKETKVTKDAYKV

SEQ ID NO: 18331 - protein, 188 aa, Wolbachia endosymbiont
SYYVRLQYNGEILPLFTKVDGATGAKKKNADAGTTTDLYKASFMAGGGAFGYKMDDIRVDVEGLYSKLSKDTLDVAPTPAIAESLTAISGLVNVYYDIAIEDMPITPYVGVGVGAAYISTPLATAVNSQNGKFAFAGQARAGVSYDITPEIKLYAGARYFGSYGANFDKAAKDDAGIKVLYSTVGAEA

SEQ ID NO: 18332 - protein, 189 aa, Wolbachia endosymbiont
SYYVRLQYNGEILPLFTKVDGATGAKKKNADAGTTTDLYKASFMAGGGAFGYKMDDIRVDVEGLYSQLSKDTLEKAPDPAIADSLTAISGLVNVYYDIAIEDMPITPYIGVGVGAAYVSNPLATKVTDDKASGFGVAYQAKAGVSYDVTPEIKLYAGARYFGSYGANFGKAAKDDAGIKVLYSTVGAEA

SEQ ID NO: 18333 - protein, 185 aa, Wolbachia endosymbiont
SYYVRLQYNGEFLPLFTKVDGITYKKDKSDYSPLKPSFIAGGGAFGYKMDDIRVDVEGLYSQLSKDTTIINTSETNVADSLTAFSGLVNVYYDIAIEDMPITPYVGVGVGAAYISNPSKADAVKDQRGFGFAYQAKAGVSYDVTPEIKLYAGARYFGSYGASFDKAAKDDAEIKKVLYSTVGAEA

SEQ ID NO: 18334 - protein, 198 aa, Wolbachia endosymbiont
  misc_feature (94)..(94): Xaa can be any naturally occurring amino acid
SYYVRLQYNGEFLPLFTKVDGITYKKDKSDYSPLKPSFIAGGGAFGYKMDDIRVDVEGVYSYLNKNDVKDVTFDPANTIADSVTAISGLVNVYXDIAIEDMPITPYIGVGVGAAYISTPLEPAVNDQKSKFGFAGQVKAGVSYDVTPEVKLYAGARYFGSFGAHFDKSEEVDKAGGGKETKVTKDAYKVLYSTVGAEA

SEQ ID NO: 18335 - protein, 625 aa, Escherichia coli
SETTETVAENNPQESETVEKNEQDATETTAQNGEITKEAKPSVKANTQTNEVAQSGSETEETQTTETKETAKVETEKTQEAPQMASQASPKQAEPAPEKVSTDTKVEETQVQAQLQTQPTTVVAVEATSPNSKLAAETQPSEKANAEPVTPVVSKNQTENKVSQPTETEKTQEVPQVASQASPKQEQSETVQPQTALESENVPTVKNAEEVQAQLQTQTSATVSTEQPAKETSSNVEQPVTESTTVNTGNSATVADNSKSSETKRRSRRSVSQPQETSAEETTVTSTNETTVADNSENNKTNTRRRSRRSVRSVPHNVEPATTSSNDRSAMPLRDLTSTTTNAVLSDAMAKAQFVALNVGKAVSQHISQLEMNNEGQYNVWVSNTPMNENYSSSQYRGFSSKSTQTQLGWDQTISNNVQLGGVFTYVRDSNNFDKATSKNTLAQVNFYSKYYADNHWYLAVDLGYGNFQSKLQTNHNAKFARHTAQFGLTAGKAFNLGNFGITPIVGVRYSYLSNADFALDQARIKVNPISVKTAFAQVDLSYTYHLGELSVTPILSARYDANQGSGKINVTRYDFAYNVENQQQYNAGLKLKYHNVKLSLIGGLTKANQAEKQKTAELKLSFSF

SEQ ID NO: 18336 - protein, 199 aa, Escherichia coli
MRKLCAVILSAVVWLVAAGTPASAAEHQSTLSAGYLQTHTDMPGSDDLKGINVKYRYEFTDTLGLVTSFSYANAKDEQKTHYSDTRWHEDSVRNRWFSMMAGPSVRVNEWFSAYAMAGVAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 18337 - protein, 732 aa, Moraxella catarrhalis
MMISKKYTLWALNPLLLTMMAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNMHHIEVIFGATSLYGGGSTGGLINIVTKKGQPETMMEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTDGHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAAFLQSGYDINNLFTLNGGVRYQYTENKIDDFIGYAQQRQIGAGKATSADAFWRLSRLRHFLFNAGLLMHITEPQQAWLNFSQGLELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTVDLLGSYQLPVGTLSFSIENLFDRDYTTVWGQRAPLYYSPGYGPASLYDYKGRGRTFGLNYSVLF

SEQ ID NO: 18338 - protein, 366 aa, Aeromonas punctata
AVASSQDESKGFVEDSKLNVRMRNLYFSRDYRKTESAGNKPAGLRHDQREWGQGFIGTFESGFTQGTVGVGVDAIGMLGIKLDSGRGYSGTGLFPSGSDQRSQDDYSKGGAAVKFRISDTVLKVGDQFTALPVFATDDSRLLPETAQGALLTSNEIKGLTLHAGRFKSMRAQAETDRDRISDGLGRRGLKEADVFGGSYAFTDSLSTSLYYSKVEDYWRKYYANVNWALPISDKQGLVFDFNIYDPKGEGDNLYRATTDGDKLDNRAYSFSGAYNIGAHTFTLAYQKVTGDGEYANGIDGGGSIFLDNSVARSDFNAEGEKSWQVRYDLNFAEFGVPGLTFMTRYVRGTGARTADTNDGKEWDRDL

SEQ ID NO: 18339 - protein, 303 aa, Neisseria meningitidis
YGTIKAGVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGGVGL

SEQ ID NO: 18340 - protein, 88 aa, Neisseria gonorrhoeae
NGESYHVGLNYQNSGFFAQYAGLFQRYGEGTKKIEYEHQVYSIPSLFVEKLQVHRLVGGYDNNALYVSVAAQQQDAKLYGARRANSHN

SEQ ID NO: 18341 - protein, 96 aa, Neisseria gonorrhoeae
SNGESYHVGLNYRNNGFFAQYAGLFQRYGEGTKKIEDYQYNIPSLFVEKLQVHRLVGGYDNNALYASVAAQQQDAKLYGTWRANSHNSQTEVAATV

SEQ ID NO: 18342 - protein, 316 aa, Neisseria meningitidis
MKKSLIALTLAALPVAAMADVTLYGTIKAGVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENK

SEQ ID NO: 18343 - protein, 88 aa, Neisseria gonorrhoeae
NGESYHVGLNYRNNGFFAQYAGLFQRYGEGTKKMEGYAYNIPSLFVEKLQVHRLVGGYDNNALYASVAAQQQDAKLYQNQIVRDNSHN

SEQ ID NO: 18344 - protein, 693 aa, Brucella abortus
MIGFWSITMLTRSHVFALSILSLSIQHVFAQNSPSDAAVNDLPTIELQAQASPKQPFNEAAGDASVGRDQLIQGATTIGNALNGQSGVYSAQYTGGVSRPVIRGLDGARVKITQNGGDTLDVSSVSPDHAVTVDPNASDQIQILKGPEALLYGAGSVGGLVNVIDHKIPSKMPDNGYEGQLGVRYNTGDDGLVYSGDSTVALGSQFALNVGGLKRDANDYILPHDLQGTSRREESTFARSHDYHAGLSWIYDRGYTGIAYSERHDKYGIPGDNPLYGLCKPSHGKLDCGSLVDQQAAMQANDGAAAWINLKEKRYDLKSELNDPFAGFSKLAAQATYTDYQHQEMDGDEPDTTFISKGTDARITLDNTPWAGWEGQFGTQYTQQKLTINGDEALMDPTVTKRYSVFGLQEKQVDQLHFQVSSRIDHQTIDIDGNDVDVGAKNYSGTAYSLAGSTDWAFKPNYKLSLTGSHQERLPLAQELYSNGAHMATNTFELGNDDLDKEKSNNIELGLHFDNDRLKYNVSAFQSWYDNFIYANTLDRFQDFRLIQYDQTNARFYGVDGDISYQLSPRYNAGLFGDYVRGKLDDAGNAPRIPGGRLGTRIKADFGQGYSGTAEYYHVFNQDDIANYETEGKGYNMLNMGLAYDGQINAKAGYQLYAKANNLLDSKVYLHESFLSDVPQIGRNFTMGVNFNF

SEQ ID NO: 18345 - protein, 462 aa, Brucella abortus
MNRFSNHWPCILVGFVLWFVSASRTVAQNASETTVSYDTDTAVLSEADVLRIALSENATVKVADMDVRKQEYARRAARADLFPKVDLNGVYSHTLKKQVLYIDMPGFSSSEGIEMGRTHNTQGGVNVSMPLVSAQLWKSIAMTGEQLDLALEKARSSRIDLVAEVKKAYLSVLLAEDSYGVFKRSYDNALANYKNISDKFDRGLVAEYDKIRANVQVRNIEPNLLQAQNSVALALWQLKVLMSMEVETPIRLSGSLSDYKEQVYTGYFAADTLISNNSSLRQLDIQRRLAVSADKLNKYSFLPTLNLGGQYTYSLNSNDIKFWGEGQRWTPFSTISLSLYIPIFNGGKRLYNVKQSALSIRQIDLQRRHIEQSIRMGIKNQNDRLRTCMQRFVASEEAVRSAEKGYQIAEKRYQTGEGTLVELNDADVALLQARLNYNQAIFDFMTAKAELDKMNGMGIPEQ

SEQ ID NO: 18346 - protein, 250 aa, Salmonella choleraesuis
MPLYPSRWMAASLYLKNGFIMKSLNTLVILTSVISTSVFAGAYVENREAYNLASDQMEFMLRVGYNSDMGAGIMLTNTYTLQRDDELKHGYNEIEGWYPLFKPTDKLTIQPGGLINDKSIGSGGAVYLDVNYKFTPWFNLTVRNRYNHNNYSSTDLNGELDNNDSYEIGNYWNFIITDKFSYTFEPHYFYNVNDFNSSNGTKHHWEITNTFRYRINEHWLPYFELRWLDRNVGPYHREQNQIRIGAKYFF

SEQ ID NO: 18347 - protein, 373 aa, Salmonella choleraesuis
MQDVTLYAYDSRGNLTQVTNALGQVTRLGDYDERGKPGSITDANGVTSSLAYTGVDGWLASVSTAGSTTRFDYDAVGQITRVTRGDGSWLSYEYDDARRLVAIGNNLGERLEYDVDTKGNRTAQRIKDASGSLVRQQQWAYDELGRLLRAVGAGGQTRSFAYDLNDNPVGETNPRQFAHSQAFDALDRLVGQSDPLGGKTRLAYDAQDNLTEVKDPRGVTTRYEYDGLGNLTRLVSPDSGTTTFEHDAAGNVIRRTDARGTVTEYRYDALNRLIERHSPSDPSLDVQYRYDLTADGNKGIGRLGSIEGARDSLVYRYDERGNLVEQVRSIRLDQQTLLDRVTYRYDAANQLLEIGYPSGLAIREKGTDLFSLL

SEQ ID NO: 18348 - protein, 256 aa, Salmonella choleraesuis
RERELGDGLMSVCQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRITVCPWFRFDRTR

SEQ ID NO: 18349 - protein, 398 aa, Salmonella choleraesuis
MNRKVLALLVPALLVAGAANAAEIYNKNGNKLDLYGKVDGLRYFSDNAGDDGDQSYARIGFKGETQINDMLTGYGQWEYNIKVNTTEGEGANSWTRLGFAGLKFGEYGSFDYGRNYGVIYDIEAWTDALPEFGGDTYTQTDVYMLGRTNGVATYRNTDFFGLVEGLNFALQYQGNNEDPGAGEGTANGSDANSGSRKLARENGDGFGMSASYDFDFGLSLGAAYSSSDRTDNQVARGYGDGHHYYANSYAGGETAEAWTVGAKYDAYNVYLAAMYAETRNMTYYGGGDGGNGGIANKTQNFEVVAQYQFDFGLRPSIAYLQSKGKDLGGQDKDSRGNYRYTDKDLVKYVDVGMTYYFNKNMSTYVDYKINLLDEDDDFYANNGIATDDIVGVGLVYQF

SEQ ID NO: 18350 - protein, 212 aa, Salmonella choleraesuis
MKKFTVAALALTTLLSGSAFAHEAGEFFMRAGPATVRPTEGAGGTLGHLNGFDVSNNTQLGLTFTYMATDNIGVELLAATPFRHKVGTGATGDIATVHLLPPTLMAQWYFGDSSSKVRPYVGVGVNYTTFFDNGFNDNGKNAGLSDLSFKDSWGAAGQVGVDYLINRDWLIGASVWYMDIDTTANYKMGGVQHHDSVRLDPWVFMFSAGYRF

SEQ ID NO: 18351 - protein, 513 aa, Salmonella choleraesuis
MRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNRVDIKADDPGGLVEAEWKANPQQAPRAEQYDTRKTIKQTQAGLRYERSLSSRDDMSVMMYAGERETTQYQSIPMAPQLNPSHAGGVITLQRHYQEIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYITPGNGDDSGDASYHKWLPAGSLKYAMTDAWNIYLAAGRGFETPTINELSYHADGQSGMNFGLKPSTNDTIEIGSKTRIGDGLLSLALFQTDTDDEIVVDSSSGGRTTYKNAGKTRRQGAELAWDQRFAGDFRVNAS

SEQ ID NO: 18352 - protein, 372 aa, Salmonella choleraesuis
MKKVVVLSAVAAAVMMAGAANAAEIYNKDGNKLDLYGKVDGLHYFSSNHSTDGDQSYIRMGIKGETQITDQLTGFGQWEYQVNANRPEDGDSSGSPQSWTRLGFAGLAFADMGSVDYGRNYGVLYDIGSWTDVLPEFGNDSYEASDNFMTGRANGVLTYRNNDFFGLVDGLNIALQYQGKNDGLSKEGDPLSNNARKSIAYQNGDGFGASATYDLGMGVSLGAAYTSSKRTLDQMTQDKYDNGDRAEAWTGGVKYDANNIYLAANYTRTYDMTYMGDTLGGFAHKTDNWEMVGQYQFDNGLRPSLAFLQSRANDVDGLGSFDLVKYIDVGSYYYFNKNMSAYVDYKINLLKDGNPSNPNTDNTVALGLVYEF

SEQ ID NO: 18353 - protein, 728 aa, Salmonella choleraesuis
MSFINHSRDGQRQPVATPTLLAACIAMALMPTASFAAPNTEDTVIVDGSQSGSANDEQDYSVKTTTVGTKMQMVQRDIPQSVTIVSEQRMEDQQLQTLGDVMDSTMGISKSTADSDRSSYYSRGFQIDNYMVDGIPTYFESRWNLGDALSDTALFERVEVVRGANGLMTGTGNPSAAINMVRKHATSREFKGNVSAEYGSWNKQRYVMDMQSPLTDDGNVRARIVAGYQDNDSWLDRYNQKKTFFSGIVDADLGETTSLSAGYEYQRIDVNNQTWGGLPRWNTDGSVRHYDRAHSTAPDWAYNDKEFNKFFATVKQRFADNWQATLNATHTEAKFDSKAMYLDAYVDKSTGMLAGPYVNYGPDYAYVGGTGWNSGKRKVDAVDLFADGGYELLGRQHTVMFGGSYSRQTNRYTNSWANVFPDELGSFYDYEGNFPETNWGSQSLAQDDKTYMKSLYAATRISLADPLHLILGARYTNWRVDTMTYGMEKNHTTPYAGLVFDIDDNWSTYASYTSIFQPQNYRDSSGSYLAPITGNNYEVGLKSDWMNSRLTTTLSVFRIEQDNVAQSTGRMIQGSTDTAYEGVDGTVSKGVEFEINGALTDNWQMTFGATRYVAEDSDGNAVNPNLPRTTVKLFTRYRLPALPALTVGGGVNWQNSVYSDVATPYGTWRAEQGSYALVDLFTRYQVTKNLSVQGNLNNLFDKTYDTNVEGALVYGEPRNVSVTASYQF

SEQ ID NO: 18354 - protein, 350 aa, Salmonella choleraesuis
MKKTAIAIAVALAGFATVAQAAPKDNTWYAGAKLGWSQYHDTGFINNDGPTHENQLGAGAFGGYQVNPYVGFEMGYDWLGRMPYKGDNINGAYKAQGVQLTAKLGYPITDDLDVYTRLGGMVWRADTKSNVPGGPSTKDHDTGVSPVFAGGIEYAITPEIATRLEYQWTNNIGDANTIGTRPDNGLLSVGVSYRFGQQEAAPVVAPAPAPAPEVQTKHFTLKSDVLFNFNKSTLKPEGQQALDQLYSQLSNLDPKDGSVVVLGFTDRIGSDAYNQGLSEKRAQSVVDYLISKGIPSDKISARGMGESNPVTGNTCDNVKPRAALIDCLAPDRRVEIEVKGVKDVVTQPQA

SEQ ID NO: 18355 - protein, 363 aa, Salmonella choleraesuis
MMKRKILAAVIPALLAAATANAAEIYNKDGNKLDLYGKAVGRHVWTTTGDSKNADQTYAQIGFKGETQINTDLTGFGQWEYRTKADRAEGEQQSSNLVRLAFAGLKYAEVGSIDYGRNYGIVYDVESYTDMAPYFSGETWGGAYTDNYMTSRAGGLLTYRNSDFFGLVDGLSFGIQYQGKNQDNHSINSQNGDGVGYTMAYEFDGFGVTAAYSNSKRTNDQQDRDGNGDRAESWAVGAKYDANNVYLAAVYAETRNMSIVENTVTDTVEMANKTQNLEVVAQYQFDFGLRPAISYVQSKGKQLNGADGSADLAKYIQAGATYYFNKNMNVWVDYRFNLLDENDYSSSYVGTDDQAAVGITYQF

SEQ ID NO: 18356 - protein, 468 aa, Salmonella choleraesuis
MRTFSGKRSTLALAIAGITAMSGWIVVPQAQASGFFDDSTLTGGIYYWQRERDRKDVTDGDKYKTNLSHATWNANLDFQSGYAADMFGLDIAAFTAIEMAENGDSGHPNEIAFSKKNKGYDEDYSGDKSGISLYKAAAKFKYGPVWARAGYIQPTGQTLLAPHWSFMPGTYQGAEAGASFDYGDAGALSFSYMWTNEYKAPWHTEMDKFYQADKKTNVDYLHSIGAKYDFKNDLVLEAAFGQSEGYVDQYFAKASYKFDLGGNPFTTSYQFYGARDKVDDRSVNDIYDGTAWLQALTFGYKVAEVVDLRLEGTWVKADGQQGYFLQRMTPTYASSNGRLDIWWDNRSDFNANGEKAVFFGAMYDLKNWNLPGWAVGASYVYAWDAKPATWQSNPDAYYDKNRTIEESSYSLDAVYTLQEGRAKGTMFKLHFTEYDNHSNIPSWGGGYGNIFQDERDVKFIVIAPFTIF

SEQ ID NO: 18357 - protein, 751 aa, Salmonella choleraesuis
MNKKIHSLTLLVNLGIYGAALPVMAEEKTDSAALTNEDTIVVTAAQQNLQAPGVSTITADEIRKNPPARDVSEIIRTMPGVNLTGNSTSGQRGNNRQIDIRGMGPENTLILIDGKPVTSRNSVRLGWRGERDTRGDTAWVPPEMIERIEVLRGPAAARYGNGAAGGVVNIITKKGGSEWHGSWNTYFNAPEHKDEGATKRTNFSLNGPLGGDFSFRLYGNLDKTQADARNINQGHQSERTGSYADTLPAGREGVINKDINGVVRWDFAPLQSLELEAGYSRQGNLYAGDTQNTNTNQLVKDNYGKETNRLYRQNYSLTWNGGWDNGVTTSNWVQYEHTRNSRMPEGLAGGTEGIFDPKASQKYADADLNDVTLHSEVSLPFDLLVNQNLTLGTEWAQQRMKDELSNSQTFMGGNIPGYSSTNRSPYSKAEIFSLFAENNMELTDSTMLTPGLRFDHHSIVGDNWSPSLNLSQGLGDDFTLKMGIARAYKAPSLYQTNPNYILYSKGQGCYATGAGTGIGCYMMGNDDLKAETSINKEIGLEFKRDGWLAGITWFRNDYRNKIEAGTVPLQRINNGKTDVYQWENVPKAVVEGLEGTLNVPVSDTVNWTNNVTYMLQSKNKETGERLSIIPQYTLNSTLSWQVRQDVSLQSTFTWYGKQEPKKYDYQGNPVTGTDKQAVSPYSIVGLSATWDVTKNVSLTGGVDNLFDKRLWREGNAQTVRDTQTGAYMAGAGAYTYNEPGRTWYMSINTHF

SEQ ID NO: 18358 - protein, 656 aa, Salmonella choleraesuis
MTQKRTLLKYGILSLALAAPLSACAFDSLTVIGDSLSDTGNNGRWTWDSGQNKLYDEQLAELYGLALSPSSNGGSNYAAGGATATPELNPQDNTADQVRQWLAKTGGKADHNGLYIHWVGGNDLAAAIARPAMAQQIAGNSATSAAAQVGLLLDAGAGLVVVPNVPDISATPMLLEAVITAGLGAAAPPALKAALEALAEGATPDFASRQQAIRKALLAAAATVSSNPFIQQLLVEQLLAGYEAAAGQASALTDDYNRMEEKGLEQHGGNIARADINGLFKEILAHPQAFGLTNTVGMACPPGVSASACSSAMPGFNASQDYLFADHLHPGPQVHTIIAQYIQSIIAAPVQATYLNQSVQSMAQGSRTTLDSRYQQLRQGETPVGSLGMFGGYSGGYQRYDNNEADGNGNHNNLTVGVDYQLNEQVLLGGLIAGSLDKQHPDDNYRYDARGFQATVFSHLRAGQAWLDGDLHYLSAKFSNIQRSITLGALRRVEEGETNGRLWGARLTSGYDFVMMPWLTTGPMLQYAWDYSHVNGYSEKLNTSTSMRFGDQNAHSQVGSAGWRLDLRHSIIHSWAQINYRRQFGDDTYVANGGLKSTALTFSRDGKAQDKNWVDIAIGADFPLSATVSAFAGLAQTAGLSDGNQTRYNVGFSARF

SEQ ID NO: 18359 - protein, 956 aa, Salmonella choleraesuis
MSNDAIAQKAIRGTVLDEANEPIIGASVLVKGTTNGSITGVDGTFNVKANPSDVLVISYVGYATVEQQVGNQTQLVIHLREDSKVLNDVVVIGYGSTTKKELTGSVTSMKKDDLNPGTFTNAMGMLQGKVAGLQIINPNGADPTAKYEVLLRGTNTLSAGQGPLIIIDGVAGADIRNINFQEVESIDVLKDGSAAAIYGTRGTNGVIIVTTKRARSGKTEVSYDGQLTVGVVSRRAKPLSASEYKSVIKEYRPELESYIFDSDTDWFKEITQTPFSHKHNLSISGGSEKFSHHTSFNYEKSDGLQKHNSSEKLMARTNIRQSLLDKWVDLDYNLNIIHRKYSPSSTSAFMQAFTHNPTEPVYDDSDPDAGGYSRIKAMEYYNPVAIINERNMESKNDNYGANIRATLNILPIKGLKWENFVSYDKEQYETREYYTHYYPSLIGTNGQAYIENYQENDTQYESTLNYSNIFGKHSIQALLGYTYQYTYSTSASMTNSGFDFDDNQTHNIGTGTNLTEGKASMSSNKEDNTYIGFFGRFMYNYDDKYLLSASLRRDGSSRFGDNNKWGWFPAVSVGWRINKEKFLSNVKWIDDLKLRAGYGVTGNQDFSNYKSLMMMTTAGKFYYNGQWINTYQPASNANPDLKWEKKAEFNVGVDMTMFDNHLSFTFDYYKRTTSNLLYDYIVPTPPYVYNTLFTNVGKVTNEGVELTISGTPFNTRDFTWNTSLTVSHNKNKLVKFTNDEFTNGTYKVGWSTSAACYTQRLIEGQSLGTFYGPIWLGTDTDGKDVLLGQNADGSVPEEQWEKIGCAYPDATLSWSNTFRYKKFDLSFSLRASIGGEILNNYAMEYENLSSIGLRNISSNWLSQTNFTSTTYKYSSKYIEDASYLKLDNVTFGYTWDFTSKMIKRLRLSLTAQNVFCITGYSGVDPEVALSGLEPGMESLSYYPRTTEFTFGVNIVF

SEQ ID NO: 18360 - protein, 961 aa, Salmonella choleraesuis
MHSWKKKLVVSQLALACTLAITSQANATTYDTFGYHDDAATVFGWDDTNDHDYLTYGGYVYNTPASDSGYFDTKFTGDTVNGVISTYYLNHDYANDTANTLDVTNSTIHGMITSYQMGYGQYVWTNGSDYTTHDWVDDDTFNLNISNSTIDDDFEAFYFTDTYLDSDGKTVKTDYDKLVTAGLGTAITLDVESNINITNNSHVAGIALYQNDLGNSTYTTEAHQWDNTINVANSTVTSGSWSEDEEQGHFGNSSEPSDYNGNGWNKDDVALAFVDDPYSNYRMVNNVTFTDSQLLGDVVLESSWNYNFYSNGRLVDDSTTVYTNGGWADDDQNVDHLTLTLNNTKWVGAAVNDSQSMDPVQFYDVDANSLDPDSTNYDAWGRVNSAASFQSGIFDVSLNNGSEWDTTKTSVIDTLAVNSGSQVDVANGSNLTADTITLNGGSAMNIGEGGYVDTDHLTVDTFSTVTLADDVSSAWSDDALYANTITVTHGGMLDIQTNNTNADSVIDTDTLELTSSNVADNNGNVYAGVFNIHSNDYTLNADLVNDRTWDTTQANYGYGVVAMNSDGHLTINGNGDINNGDEADASSTTDNVVAATGNYKVRIDNATGAGSVADYKGNELIYVNDINTDATFSAANKADLGAYTYQAKQEGNTVVLEQMELTDYANMALSIPSANTNIWNLEQDTVGTRLTNARHGLADNGGAWVSYFGGNFNGDNGTINYDQDVNGIMVGVDTKVDGNNAKWIVGAAAGFAKGDLSDRTGQVDQDSQSAYIYSSARFANNIFVDGNLSYSHFNNDLSANMSDGTYVDGNTSSDAWGFGLKLGYDLKLGDAGYVTPYGSVSGLFQSGDDYQLSNDMKVDGQSYDSMRYELGVDAGYTFTYSEDQALTPYFKLAYVYDDSNNDADVNGDSIDNGVEGFAVRVGLGTQFSFTKNFSAYTDANYLGGGDVDQDWSANVGVKYTW

SEQ ID NO: 18361 - protein, 702 aa, Salmonella choleraesuis
MPLEMFMFATTRMALLIGGAIGGATFPLFAQETTKNDTVIVTSPVQSGATKLATPDIETPQSVSIITRQQFEEQGATSVRQAVSYTPGVYSNQIGASNRFDYIVLRGFSDGSLDNVYLDGLKMMGDTNSHSSLVVDPWFLEDIEVVRGPASVLYGRSSPGGIVALTSRKPAFDVGGEVKLFAGNHNQRGAAFDVTGPLDDNERVAARLSGMTRYADSQFTPLKEERYALMPSLTWRITDRTRLDLMAYLHRDPEGGSHSGLPYQGTVVPYNGRKISNTFFEGEDDYDKYDRRENMVGYNIEHLFDNGWSVRQKLRYLHTKVTLNQVYAAGWLNETALNRGYSGSGEKMSAIALDNQLDGSVDTGAINHRLLVGIDYQDRSNHTTGYYGAFPPIDAFNPVYGAQPDYITLYSREKHKLRQTGYYLQDQMSWDRWRFTLGGRYDRVSVSNIDKLHDSRSDLDKNNVSTRAALLYLFDNGVAPYLSYSTAFTPTSFADENGNVLEPMKGKQWEAGVKYEPLGGNSQFSAAVYRINQTNIATKEEPTDPYRSIGEIESKGVELEAISHLSDSVRLQAAYTYTDIRYKKSSPQEQGKRAVYAPRNQASAWLSYDVKSGLLEGLTLGSGIRYVNGVTSDRLNTHTLPSYTLVDMVVGYDLSSIGLNGLSAQLNVNNLTDKRYVAACNSLSYCYFGAERSIVGSVSWAF

SEQ ID NO: 18362 - protein, 311 aa, Salmonella choleraesuis
MNKSTIALMMAMLSGTAYADSTQLTPNFSPESVTVSTSAGMLSGKSHEMVYDTGTGRKVSQLDWKIKNVAILKGDISWDAYSFLTLNARGWTSLASGAGHMDDYDWMNDNQSGWTDHSSHPSTNVNYANEFDLNAKGWVFQNENYKAGVMAGYQETRFSWTATGGSYNYDNGAYTGEFPAGERGIGYSQRFSMPYIGLVGQYRINDFEFNALFKFSDWVRAHDNDEHYMRDLTFREKTTSSRYYGTSIDAGYYVTPNAKVFAEFTYSKYEEAKGGTQIIDTNSGESASIGGDAAGISNKNYTITAGLQYRF

SEQ ID NO: 18363 - protein, 239 aa, Salmonella choleraesuis
MKNFFAVCIIPLVVAWSATASAKDGIYITGKAGTSVVNVYGINSTFSQDEIVNGHATLPDRTKGVFGGGVAIGYDFYDPFQLPVRLELDTTFRGETDAKGGQDIIAFGDPVHINVKNQIRMTTYMVNGYYDFHNSTAFTPYISAGVGLAHVKLSNNTIPVGFGINETLSASKNNFAWGAGIGAKYAVTDNIMIDASYKYINAGKVSISKNHYAGDEHTAYDADTKAASNDFMLGITYAF

SEQ ID NO: 18364 - protein, 747 aa, Salmonella choleraesuis
MARLKTAQPNSSLRKIAVVVATAVSGMSVYAQAAVQPKEETITVTAAPAAQESAWGPAATIAARQSATATKTDTPIQKVPQSISVVTAEEMALHQPKSVKEALSYTPGVAVGTRGASNTYDYLIIRGFAADGQSQNNYLNGLKMQGNFYNDAVIDPYMLERAEVMRGPVSVLYGKSSPGGLLNMVSKRPTTEPLKEIQFKMGTDSLFQTGFDFSDALDEEGVYSYRLTGLARSANAQQDRAEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRYAENKVSQNSVYGYGVCSDPANRDSKQCAALAPEDKGHYLARKYVVDDEKLQNFSVDTQLQSKFATGEVDHTLLTGVDFMRMRNDINAWFGYDDSVPLLDLYNPVYTDFDFASRDPATSGPYQILNKQKQTGLYVQDQAQWDKVLVTLGGRYDWADQESLNRTTGITSKRDDKQFTWRGGVNYLFDNGITPYFSYSESFEPASQTGENGKIFAPSKGKQYEAGVKYVPNDRPIVITGAVYQLTKTNNLMADPAGSFFSVEGGEIRARGVELEAKAALSASINVVGSYTYTDAEYTTDTTYKGNTPAQVPKHMASLWGDYTFFDGPLSGLTLGTGGRFTGSSYGDPANSFKVGSYTVVDALVRYDLARVGMAGSNVALHVNNLFDREYVASCFQTYGCFWGAERQVVATATFRF

SEQ ID NO: 18365 - protein, 385 aa, Ralstonia metallidurans
MKIRALAVLLVFTAAGALRAGTPEAVVETAAPKGDALLDKIWSIPKLYRDDHNSVIEEFDLIGRFQEDYYNVDSNRGSTSFFEIRRFRLGVDAFFAERHIEVEAEVDTALRAYHSPSIFYNRMTNLWVRFQASEEFGLRVGKFQPHVGYDREFSNNYLKTFERGFFDDQLIGTTDYITGAEVSGKFGHFGYLAAVYSTDVDKEFGQFDGGQAYQAEINYDFSKPWNAKKALWVLDYLHADGKNENTNVFTNYRNVLVTYLDLEKGRFSLVPQFAYGEQVAGKGDVYSLQLMPGYMITDKLEFFVRYQLGLASESNGISTLNRQQKTVGVFTGDTYNACYLGLNYYVYGHRLKLMFAEEYARLSGGTGPSAGYSGWTTLVGLRLFF

SEQ ID NO: 18366 - protein, 214 aa, Vibrio alginolyticus
MKKTICSLAVVAALVSPSVFAHKQGDFVLRVGAASVVPNDSSDKILGSQEELEVDSNTQLGLTFGYMFTDNISLELLAATPFSHDISTDLLGLGDIADTKHLPPTLMVQYYFGEPQSKFRPYVGAGLNYTMFFDEGFNSTGKGAGLSDLKLDDSFGLAANIGVDYMINDQWFLNAAAWYANIETEATYKAGGEKQKTDVKINPWVFMISGGYKF

SEQ ID NO: 18367 - protein, 246 aa, Haemophilus influenzae
TQAAEVYNKNANKLDVYGKIKAMHYFSDYDSKDGDQTYVRFGIKGETQINDDLTGYGRWESEFSGNKTESDSSQKTRLAFAGVKLKNYGSFDYGRNLGALYDVEAWTDMFPEFGGDSSAQTDNFMTKRASGLATYRNTDFFGLVDGLDMTLQYQGKNEGREAKKQNGDGVGTSLSYDFGGSDFAVSAAYTSSDRTNDQNLLARGQGSKAEAWATGLKYDANNIYLATMYSETRKMTPISGGLPTKR

SEQ ID NO: 18368 - protein, 160 aa, Haemophilus influenzae
LRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGA

SEQ ID NO: 18369 - protein, 94 aa, Haemophilus influenzae
SNGESYHVGLNYRNNGFFAQYAGLFQRYGEGTKKMEGYAYNIPSLFVEKLQVHRLVGGYDNNALYASVAAQQQDAKLYQNQIVRDNSHNSQTEV

SEQ ID NO: 18370 - protein, 160 aa, Wolbachia endosymbiont
KKATDIHNPLKASFIAGGGAFGYKMDDIRVDVEGLYSQLNKNDVTGAAFNPDTVADSLTAISGLVNVYYDIAIEDMPITPYVGVGVGAAYISTPLKDAVNDQKSKFGFAGQVKAGVSYDVTPEVKLYAGARYFGSFGAHFDKDTAAASKDKGELKVLYST

SEQ ID NO: 18371 - protein, 174 aa, Wolbachia endosymbiont
KKDKSDYSPLKPSFIAGGGAFGYKMDDIRVDVEGAYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSFGAHFDKSEEVDKAGGGKETKVTKDAYKVLYSTIGAEA

SEQ ID NO: 18372 - protein, 174 aa, Wolbachia endosymbiont
KKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSFGAHFDKSEEVDKAGGGKETKVTKDAYKVLYSTVGAEA

SEQ ID NO: 18373 - protein, 1067 aa, Uncultured murine large bowel bacterium BAC 31B
MKKLLSVLFLLSFTLASVYAQNIQVKGTVVSGSDNEPLPGVNVVVKGTTNGGITDLDGNFTLSVPADATLSITYIGFKSQEVAVNGKNSLKIVLQEDSETLDEVVVVGYGVQKKSVVTASIAKVSSEDLENKSPVRMDNALKGLAAGVDVTSASGQPGDSPRVRVRGIGTINNSDPLYIVDGMPIGGGLDFVNPNDIESIEVLKDAASGAIYGARAANGVILVTTKKGKMGKAQINYNFSYGWQSAWKRRDVTSATDYAILQNEANVNGGQAPIYADPYNLIDANGNSIKGFGTDWQDLVFYDNAPVVNHDVTVSGASEKVNYYLSLGYYSQDGIVGGNHGHSNYDRLTIRSNTQYNLIDASKERGFLNKLDLGVNLAYMRTHSTGVGTNSEFGSILGSALYLSPILTPTLTGDAAEKMIETYKDFDLPRDANGDPYTVPGYGGAYQEMNNPLAMMTLTPTKNWSHKFVPKFSIDLQLWDNLKYHFNYSADMGFWGNEGATKSKYYLSANNKATHTNASSFKAQNVTWQIENTLTYDKTIGKHTFGVVLGQSALKYKGDQLGGNRWNLVNPNKPSIDYATGNVEYTKDADGNITGATVQYGVYGGPYTEHRMSSMFARLSYNYNERYMIQATIRRDGSSRFGINNKYGTFPSVSVGWNVTNEEFMADTREWLSNLKVRASWGKNGNDNIAEFGYTSLTAMGNNVLLGKDAIKWNGSKAQRLANPDLKWEESEQTDLGIDLGFFNNALTFSADYYIKKTNGMIITMPIPSYVGETKPLGNVGDMENSGFEFELGYKWNIADAKFAVKGNATYLKNELKNLGNDTGYMDLDGIQGFSGGGTRGSNGQPFPYFYGYKTDGVFQNMDEVRAYVNKDGKMIMPDAVPGDTRFVDVNGDGSISADDRTNIGNGTPDWTYGLNLNADWKGFDFNIFFQGVAGADVFDGTYRTDVASGNYPSWMLGRWTGEGTSNKYPRLAVGNATNWMVSDLYVCDGSYLRLKNITLGYTLPKTLTRKLTIERLRVYVQAENLVTWTKYWGFDPEISSGATSLGVDRGIYPQARTYTVGVNVSF

SEQ ID NO: 18374 - protein, 1613 aa, Rickettsia conorii
MGAAIQQNRTTNAVATTVDGAGFDQTAALGNVAVPINAVITANVHQGINLNTPAGSFNGLFLNTANNLDVTVIEDTTLGFITHAVNNANHFNLTLNAGKTLTITGQGITNVQAAATKNAQNVVVQVNNGAAIDNNDLQGVGRIDFGAAASTLVFNLANPTTQNAPLILGDNAVIANGANGTLNVTNGFIKVSSKSFATVNAINIGDGQGIMFNTDANNANALNLQANGATINFNGTDGTGRLVLLSKNAAATDFNVTGSLGGNLKGIIEFNTVAVNGQLKANAGPANAVIGTNNGAGRAAGFVVSVDNGKVATIDGQVYAKDMVIQSANAVGQVNFRHIVDVGTDGTTAFKTAASKVAITQNSNFGTTDFGNLAAQITVPNTMTLKGNFTGDASNPGNTAGVITFDANGTLASASADANVAVTNNITAIEASGAGVVQLSGTHAAELRLGNVGSVFKLADGTVINGKVNQTVLVAGALAAGTITLDGSATITGDIGNAGGAAALQRITLANDATKTLTLGGANIIGANGGTIDFQANGGTIKLTSTQNNIVVDFDLAITTDQTGVVDASSLTNAQTLTINGKIGTIGANNKTLGQFNIGSSKTVLSDGDVAINELVIGNNGAVQFAHNTYLITRTTNAAGQGKIIFNPVVNNNTTLATGTNLGSATNPLAEINFGSKGVNVDTVLNVGEGVNLYATNITTTDANVGSFIFNAGGTNIVSGTVGGQQGNKFNNVALNNGTTVKFLGNATFNGNTTIAANSTLQIGGNYTTDFVASADGTGIVEFVNTGPITVTLNKQAAPVNALKQITVSGPGNVVINEIGNAGNYHGAVTDTIAFENSSLGAVVFLPRGIPFNDAGNIIPLTIKSTVGNKTATGFDVPSVIVLGVDSVIADGQVIGDQNNIVGLGLGSDNDIIVNATTLYAGIGTINDNQGTVTLSGGIPNTPGTVYGLGTGIGASKFKQVTFTTDYNNLGNIIATNATINDGVTVTTGGIAGIGFDGKITLGSVNGNGNVRFVDGILSNSTSMIGTTKANNGTVTYLGNAFVGNIGDSNTPVASVSFTGSDGGAGLQGNIYSQVIDFGTYNLGILNSNVILGGGTTAINGKINLRTNTLTFASGTSTWGNNTSIETTLTLANGNIGNIVILEGAQVNATTTGTTTIKVQDNANANFSGTQTYTLIQGGARFNGTLGGPNFVVTGSNRFVNYGLIRAANQDYVITRTNNAENVVTNDIANSPFGGAPGVGQNVTTFVNATNTAAYNNLLLAKNSANSAHFVGAIVTDTNAAITNAQLDVAKDIQAQLGNRLGALRYLGTAEMAGPEAGAIPAAVAAGDEAVDNVAYGIWAKPFYTDAHQSKKGGLAGYKAKTTGVVIGLDTLANDNLMIGAAIGITKTDIKHQDYKKGDKTDVNGFSFSLYGAQQLVKNFFAQGSAIFSLNQVKNKSQRYFFDANGNMSKQIAAGHYDNMTFGGNLTVGYDYNAMQGVLVTPMAGLSYLKSSDENYKETGTTVANKQVNSKFSDRTDLIVGAKVAGSTMNITDLAVYPEVHAFVVHKVTGRLSKTQSVLDGQVTPCISQPDRTAKTSYNLGLSASIRSDAKMEYGIGYDAQISSKYTAHQGTL

SEQ ID NO: 18375 - protein, 950 aa, Haemophilus ducreyi
ESNMQTEKLETIVVSSEDDSVHNKNVGEIKKNAKALSKQQVQDSRDLVRYETGVTVVEKGRFGSSGYAIRGVDENRVAVVVDGLHQAETISSQGFKELFEGYGNFNNTRNGVEVENLKQAVIQKGADAIRTGSGSLGGTVSFESKDARDYLIDKNYHFGYKTGYSSADNQKLHSVTAAGRYSDFDLLAVHTQRHGNELRNYGYRHYDGSVVRKEREKADPYKITKQSSLIKIGYQLNDTNRFTLGYDDSRNTSRGTDWSNAFTSYNGGPFLKDVRHTNDQSNRKNISFVYENFDTNDFWDTLKITHNHQKIKLKARLDEYCDVNGEIDCPAIANPSGLYINDKGIFLDKHDGEITHKKEGEFNNYFDSKGKEVRVKGFNVDSILINCDQYDCSKPMQLLSSTNNGYGGSPNKYIYKTYELFEKTMNNGNGKYAVLEIRSSGHEKFSRVYLPSEKGYVENQWKDRDLNTDTQQYNIDLTKSFKLKSVEHNATYGGLYSEVKKSMTNRAGYEAYNRQWWANIFFGKENNKPNKCQPYNGNSFTTLCSHEDRLFSFLIPVKTKTGALYVTDKIKLNDKVNLDVAYRYDRIKHDPKYIPGTTPKLPTDLILGRFIEFKPKNTYATQDEKNENAEKNAVYLASKKTKFSANSYSATFSFDPMDFLKIQAKYATGFRAPTSDEIYFVFQHPSFSIYPNLYLKAERSKNKEVAITLHKQKSFLTVNLFQTDYKDFLDLAYLKKGSLPYGNGGSQLETLLYQNVNRDKARVKGLEVNSKLHLGDVWRTLDGFNLSYKLSLQKGRMSSKVGEEGKQRDTNKLDTPMNAIQPQTHVVGVGYEHPQEKFGVDMYLTHASAKKEKDTFNMFYDGKDQKDQHIKWRSDRYTLVDLIAYVKPVKNVTLRAGVYNLTNREYGTWDSIRSIRPFGTTNLINQETGKGIKRFNAPGRNFRVNAEITF

SEQ ID NO: 18376 - protein, 950 aa, Haemophilus ducreyi
ESNMQTEKLETIVVSSEDDSVHNKNVGEIKKNAKALSKQQVQDSRDLVRYETGVTVVEKGRFGSSGYAIRGVDENRVAVVVDGLHQAETISSQGFKELFEGYGNFNNTRNGVEVENLKQAVIQKGADAIRTGSGSLGGTVSFESKDARDYLIDKNYHFGYKTGYSSADNQKLHSVTAAGRYSDFDLLAVHTQRHGNELRNYGYRHYDGSVVRKEREKADPYKITKQSSLIKIGYQLNDTNRFTLGYDDSRNTSRGTDWSNAFTSYNGGPFLKDVRHTNDQSNRKNISFVYENFDTNDFWDTLKITHNHQKIKLKARLDEYCDVNGEIDCPAIANPSGLYINDKGIFLDKHDGEITHKKEGEFNNYFDSKGKEVRVTGFNVDSILINCDQYDCSKPMQLLSSTNNGYGGSPNKYIYKTYELFEKTMNNGNGKYAVLEIRSSGHEKFSRVYLPSEKGYVENQWKDRDLNTDTQQYNIDLTKSFKLKSVEHNATYGGLYSEVKKSMTNRAGYEAYNRQWWANIFFGKENNKPNKCQPYNGNSFTTLCSHEDRLFSFLIPVKTKTGALYVTDKIKLNDKVNLDVAYRYDRIKHDPKYIPGPTPKLPTDLILGRFIEFKPKNTYATQDEKNENAEKNAVYLASKKTKFSANSYSATFSFDPMDFLKIQAKYATGFRAPTSDEIYFVFQHPSFSIYPNLYLKAERSKNKEVAITLHKQKSFLTVNLFQTDYKDFLDLAYLKKGSLPYGNGGSQLETLLYQNVNRDKARVKGLEVNSKLHLGDVWRTLDGFNLSYKLSLQKGRMSSKVGEEGKQRDTNKLDTPMNAIQPQTHVVGVGYEHPQEKFGVDMYLTHASAKKEKDTFNMFYDGKDQKDQHIKWRSDRYTLVDLIAYVKPVKNVTLRAGVYNLTNREYGTWDSIRSIRPFGTTNLINQETGKGIKRFNAPGRNFRVNAEITF

SEQ ID NO: 18377 - protein, 950 aa, Haemophilus ducreyi
ESNMQTEKLETIVVSSEDDSVHNKNVGEIKKNAKALSKQQVQDSRDLVRYETGVTVVEKGRFGSSGYAIRGVDENRVAVVVDGLHQAETISSQGFKELFEGYGNFNNTRNGVEVENLKQAVIQKGADAIRTGSGSLGGTVSFESKDARDYLIDKNYHFGYKTGYSSADNQKLHSVTAAGRYSDFDLLAVHTQRHGNELRNYGYRHYDGSVVRKEREKADPYKITKQSSLIKIGYQLNDTNRFTLGYDDSRNTSRGTDWSNAFTSYNGGPFLKDVRHTNDQSNRKNISFVYENFDTNDFWDTLKITHNHQKIKLKARLDEYCDVNGEIDCPAIANPSGLYINDKGIFLDKHDGEITHKKEGEFNNYFDSKGKEVRVTGFNVDSILINCDQYDCSKPMQLLSSTNNGYGGSPNKYIYKTYELFEKTMNNGNGKYAVLEIRSSGHEKFSRVYLPSEKGYVENQWKDRDLNTDTQQYNIDLTKSFKLKSVEHNATYGGLYSEVKKSMTNRAGYEAYNRQWWANIFFGKENNKPNKCQPYNGNSFTTLCSHEDRLFSFLIPVKTKTGALYVTDKIKLNDKVNLDVAYRYDRIKHDPKYIPGTTPKLPTDLILGRFIEFKPKNTYATQDEKNENAEKNAVYLASKKTKFSANSYSATFSFDPMDFLKIQAKYATGFRAPTSDEIYFVFQHPSFSIYPNLYLKAERSKNKEVAITLHKQKSFLTVNLFQTDYKDFLDLAYLKKGSLPYGNGGSQLETLLYQNVNRDKARVKGLEVNSKLHLGDVWRTLDGFNLSYKLSLQKGRMSSKVGEEGKQRDTNKLDTPMNAIQPQTHVVGVGYEHPQEKFGVDMYLTHASAKKEKDTFNMFYDGKDQKDQHIKWRSDRYTLVDLIAYVKPVKNVTLRAGVYNLTNREYGTWDSIRSIRPFGTTNLINQETGKGIKRFNAPGRNFRVNAEITF

SEQ ID NO: 18378 - protein, 950 aa, Haemophilus ducreyi
ESNMQTEKLETIVVSSEDDSVHNKNVGEIKKNAKALSKQQVQDSRDLVRYETGVTVVEKGRFGSSGYAIRGVDENRVAVVVDGLHQAETISSQGFKELFEGYGNFNNTRNGVEVENLKQAVIQKGADAIRTGSGSLGGTVSFESKDARDYLIDKNYHFGYKTGYSSADNQKLHSVTAAGRYSDFDLLAVHTQRHGNELRNYGYRHYDGSVVRKEREKADPYKITKQSSLIKIGYQLNDTNRFTLGYDDSRNTSRGTDWSNAFTSYNGGPFLKDVRHTNDQSNRKNISFVYENFDTNDFWDTLKITHNHQKIKLKARLDEYCDVNGEIDCPAIANPSGLYINDKGIFLDKHDGEITHKKEGEFNNYFDSKGKEVRVKGFNVDSILINCDQYDCSKPMQLLSSTNNGYGGSPNKYIYKTYELFEKTMNNGNGKYAVLEIRSSGHEKFSRVYLPSEKGYVENQWKDRDLNTDTQQYNIDLTKSFKLKSVEHNATYGGLYSEVKKSMTNRAGYEAYNRQWWANIFFGKENNKPNKCQPYNGNSFTTLCSHEDRLFSFLIPVKTKTGALYVTDKIKLNDKVNLDVAYRYDRIKHDPKYIPGTTPKLPTDLILGRFIEFKPKNTYATQDEKNENAEKNAVYLASKKTKFSANSYSATFSFDPMDFLKIQAKYATGFRAPTSDEIYFVFQHPSFSIYPNLYLKAERSKNKEVAITLHKQKSFLTVNLFQTDYKDFLDLAYLKKGSLPYGNGGSQLETLLYQNVNRDKARVKGLEVNSKLHLGDVWRTLDGFNLSYKLSLQKGRMSSKVGEEGKQRDTNKLDTPMNAIQPQTHVVGVGYEHPQEKFGVDMYLTHASAKKEKDTFNMFYDGKDQKDQHIKWRSDRYTLVDLIAYVKPVKNVTLRAGVFNLTNREYGTWDSIRSIRPFGTTNLINQETGKGIKRFNAPGRNFRVNAEITF

SEQ ID NO: 18379 - protein, 949 aa, Haemophilus ducreyi
ESNMQTEKLETIVVSSEDDSVHNKNVGEIKKNAKALSKQQVQDSRDLVRYETGITVVEKGRFGSSGYAIRGVDENRVAVVVDGLHQAETISSQGFKELFEGYGNFNNTRNGVEVENLKQVVIQKGADAIRTGSGSLGGTVSFESKDVRDYLIDKNYHFGYKTGYSSADNQKLHSVTAAGRYSDFDLLAVHTQRHGNELRNYGHRHYDGSVVRKEREKADPYKITKQSSLIKIGYQLNDTNRFTLGYDDSRNTSRGTDWSNAFTSYNGGPFLKDVRHTHDKSNRKNISVVYENFDTNDFWDTLKITHNHQKIKLKARLDEYCDVNGEIDCPTIANPSGLYINDKGIFLDKHDGKITHKKEGEFNNYFDSKGKEVRVKEFNVDSILINCDQYDCSKPMQLLSSTNNGYGNSPNEYKYITYELSEKPMNNGNGKYAVLESRGENKKFSRVYLPSEKGYVENQWRDRDLNTDTQQYNIDLTKSFKLKSVEHNATYGGLYSEVKKSMINRAGYEAYNRQWWANIFFGEENGKPNKCQPYNGNSFTTLCSHEDRLFSFLIPVKTKTGALYVTDKIKLNDKVNLDLAYRYDRIKHDPKYIPGTTPKLPTDLILGRFIELKPKNTYATQDEKNENAEKNAVYLASKKTKFSANSYSATFSFDPMDFLKIQAKYATGFRAPTSDEIYFVFQHPSFSIYPNLDLKAERSKNKEVAITLHKQQSFLTVNLFQTDYKDFLDLAYLKKGSLPYGNGGSQLETLLYQNVNRDKARVKGLEVNSRLHLGDVWGVLDGFNLSYKLSLQKGRMSSKVGEEGKQRDTNKLDTPMNVIQPQTHVVGLGYEHTQEKFGVDMYLTHASAKKEKDTFNMFYDGKDQKDQHIKWRSDSYTLVDLIAYIKPVKNVTLRAGVYNLTNREYGTWDSIRSIRPFGTTNLINQKTGKGIKRFNAPGRNFRVNAEITF

SEQ ID NO: 18380 - protein, 949 aa, Haemophilus ducreyi
ESNMQTEKLETIVVSSEDDSVHNKNVGEIKKNAKALSKQQVQDSRDLVRYETGITVVEKGRFGSSGYAIRGVDENRVAVVVDGLHQAETISSQGFKELFEGYGNFNNTRNGVEVENLKQVVIQKGADAIRTGSGSLGGTVSFESKDVRDYLIDKNYHFGYKTGYSSADNQKLHSVTAAGRYSDFDLLAVHTQRHGNELRNYGHRHYDGSVVRKEREKADPYKITKQSSLIKIGYQLNDTNRFTLGYDDSRNTSRGTDWSNAFTSYNGGPFLKDVRHTHDKSNRKNISVVYENFDTNDFWDTLKITHNHQKIKLKARLDEYCDVNGEIDCPTIANPSGLYINDKGIFLDKHDGKITHKKEGEFNNYFDSKGKEVRVKEFNVDSILINCDQYDCSKPMQLLSSTNNGYGNSPNEYKYITYELSEKTMNNGNGKYAVLESRGENKKFSRVYLPSEKGYVENQWRDRDLNTDTQQYNIDLTKSFKLKSVEHNATYGGLYSEVKKSMINRAGYEAYNRQWWANIFFGEENGKPNKCQPYNGNSFTTLCSHEDRLFSFLIPVKTKTGALYVTDKIKLNDKVNLDLAYRYDRIKHDPKYIPGTTPKLPTDLILGRFIELKPKNTYATQDEKNENAEKNAVYLASKKTKFSANSYSATFSFDPMDFLKIQAKYATGFRAPTSDEIYFVFQHPSFSIYPNLDLKAERSKNKEVAITLHKQQSFLTVNLFQTDYKDFLDLAYLKKGSLPYGNGGSQLETLLYQNVNRDKARVKGLEVNSRLHLGDVWGVLDGFNLSYKLSLQKGRMSSKVGEEGKQRDTNKLDTPMNVIQPQTHVVGLGYEHTQEKFGVDMYLTHASAKKEKDTFNMFYDGKDQKDQHIKWRSDSYTLVDLIAYIKPVKNVTLRAGVYNLTNREYGTWDSIRSIRPFGTTNLINQKTGKGIKRFNAPGRNFRVNAEITF

SEQ ID NO: 18381 - protein, 181 aa, Haemophilus ducreyi
ESGESIEIGIQGITGMVDWRLTAYKNKVQDLIKAKDDVNGVYTAYNIEGESVLQGVELEINAVTGIVDHQAVLEYLDPKDPDGETLVRRAKYKAKWQGVVQLGDTDLSLRYLYQGERDDFGTNGVETFAGYSLWDISAAYLVTEEFKVSARIDNLFDKEYATAQGYPAPERGYYINATYEF

SEQ ID NO: 18382 - protein, 116 aa, Wolbachia endosymbiont
  misc_feature (103)..(103): Xaa can be any naturally occurring amino acid
KKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDXKSKFGFAGQAKAG

SEQ ID NO: 18383 - protein, 825 aa, Synechocystis sp.
MKQYKIIPLILTFLTAGNVSAADLDTLKVVDVEEVLVIAAPKENRKLREQPTAVTLLSQQDMQAAQVNSIKNLTGLVPNMFIPDYGSRLTSAVYIRGIGSRINTPSVGLYVDNIPYIDKSAFDFDYSDIERIDVLRGPQGTLYGRNAMGGLIKIHTKSPFSYQGTDLRIGAGTHNAYNTSLTHYHRVSERFAFSTGGFYDYEGGFFRNAALENKKTDKSQSAGGRFRGIYLPSENWKADLNVSYEYSDQGGYPYYYTGSVNPAAQSEEMKSYIGTISNNRESSYYRNLLNTGLNLEYQAQRFTLSAVTGYQFLKDRMFIDQDFTAKDIYTLEQKQRIHTLSEEIVMKSKGSSRWQWATGVFGFYQWLKTDAPVTFREDGMGMLGQMLGSVIPSKIEVPMPMPGMGINILPSLRPGNSNLLINGNFDTPLLNGALFHQSTFRDLFGLTGLSFTAGLRLDYEKMKMTYDSGTAMDYTVGIKGEMVRGGQVIKEIPMMPETALTVQSRYHGSIDKDYLQLLPKFALQYDFKNNRGNVYATVSKGYRSGGYNIQMFSDLLQSSLKNDMMRQTKEEILKAVEGSPSASYKDLINEMFPDAGENPDARSATEYKPEQTWNYEIGTHLNLFNNRLRTDAALFWLETRDQQISRFAGASGLGRETVNAGKSRSLGAELSLTAAITADFTLNTSYGYTYATFKDYVTNARVNGQLQEISYNGNYVPFVPKHTLTVGGQYIFRINPGYWLERIQLNAGYTGAGRVYWTEENTVSQSFYGTLNGRISFQKGRGQIDFWVRNALDKDYAAFYFESMGNGFMQKGRPIQAGIELRCRF

SEQ ID NO: 18384 - protein, 394 aa, Ornithobacterium rhinotracheale
MIKKTVVLGLVSIGSVSAQAQSSVTLYGVVDAGIAYTNNQGGASNIQQTSGKLSGSRWGLKGAEDLGGGLQAVFTLESGFRPSDGGLGQGGRLFGRSAYVGLGQKGLGTLTFGRQYEPITDLVAQYSGAGFWSPATHVGDNDNLNQSFRLNNAVKFRSDTIAGFTADLLYAFSNQANGGAGTGFSNNNAWGASANYVNGPLSIGGGYVRFNHPNAASNTSGAVGGATSTTGNDYSGAFFYGLNGGVLKQQIGAVGANYALGPATLGFAWSHTQLNYLDGSSRKFNNYDVNARYQITPAATLIGVYTFTDGRASGLPGTSGQTLKPRWHQFTLGFDYALSKRTDIYVSGIYQLAAGDASTATSGGYRKIAAISNIGSASSTNRQLAFVSGLRVKF

SEQ ID NO: 18385 - protein, 856 aa, Vibrio vulnificus
MNTTLSLLTKNVRGVLAASAAFSVMATAPVYAQEAEESAKAEDYEQIAVVGSRAAPRSVADSAVPIDIISDEEFKQQGATDMVSMMQTVVPSFNVNDQPINDASTLVRPANLRGMASDHTLVLVNGKRRHRSAVITFLGGGLSDGAQGPDISVIPAAALKQVEVLRDGAAAQYGSDAIAGVINFVLNDASEGGSFEARYGSYYEGDGDMIQLSGNVGLPLSENGFINLSAEYRTADDTSRSIQRDDAAALIAAGNTFVADPAQIWGSPEIKHDIKLFANAGVELSDTSEAYIFGNFAEREVEGGFYYRNPHNRGGVNDGGTNEDGEQLLLVGDLTGDMSGNCPTDIVVGDNVLENPTYINQVANNPDCFAFNEMLPGGFTPRFGGTVTDMSLVFGTKGELENDITYDVSLNLGQNEVDFAISNTINPSLGPETPFEFSPGRYTQSEQTLDIDFTKPFDVGLYEPLFVATGFQYRNESYESFAGDTASYEIGPLATQGFGIGSNGFPGLAANSQGRVSRNNIALYIDAEAYITENFMLAGALRYEDFSDFGDTTKGKIAFRWQALENIAFRGAFSTGFKAPTLGQSNVRNVTTAFGTDGQLIDRATLPPTDPVSQLKGGEQLTPEESESITFGVVADFENGLFITADYYNIELTDRISTASGIALTEEDIATLLAQGINDASSFSEISFFTNDFDTTTEGVDVVANYAMEMMGGETKFSLAYNWTSTEVDRASENISDFRIRMLEDNLPAVRYSATANHTNGDWRFLARLNYYGSIFEDHLDSALPIDKVGSEFTVDLEVAYNFTEELTVTVGAKNAFDEYPDENTQYAGIAGSLYPTTSPIGINGGFYYLRGVYTF

SEQ ID NO: 18386 - protein, 192 aa, Wolbachia endosymbiont
DEETSYYIRLQYNGEILPLFTKVDGITYKKDNSDYSPLKASFLAGGGAFGYKMDDIRVDVEGVYSYLNKNNVTDARFTPDTIADSVTAISGLVNVYYDIAIEDMPITPYVGVGVGAAYISTPLKDAVNDQKSKFGFAGQVKAGVSYDVTPEVKLYAGARYFGSFGAHFDKDAAAGKDKGELKVLYSTVGAEA

SEQ ID NO: 18387 - protein, 282 aa, Anaplasma phagocytophilum
MNYRELLVGSLSAAAVCACSLLISGSSFAYSGNNDASDVSGVMNGSFYVSGSYSPSFPSISSFDISESDRGGSYVKGYNKNLSTLNVSDPISFTQNDPSFKFAKSLLTSFDGATGYAIGGARVEVEVGYKKFETLAESDYKHIESHNFVAVGRDATLTPDNFFVMKIDSVKDISVMLNACYDVMHTDLPVSPYMCAGLGASFINIADHVTSKLAYRGKVGVSYKLTPEISLIAGGFYHGIFDEQYAGIPASNRVNIAGGAAAKVKANIASYGFNIGARFAFN

SEQ ID NO: 18388 - protein, 282 aa, Anaplasma phagocytophilum
MNYRELLVGSLSAAAVCACSLLISGSSFAYSGNNDASDVSGVMNGSFYVSGSYSPSFPSISSFAISESDRGGSYVKGYNKNLSTLNVSDPASFTQHEPSFKFAKSLLTSFDGATGYAIGGARVEVEVGYKKFETLAESDYKHIESHNFVAVGRDATLTPDNFFVMKIDSVKDISVMLNACYDVMHTDLPVSPYMCAGLGASFINIADHVTSKLAYRGKVGVSYKLTPEISLIAGGFYHGIFDEQYAGIPASNRVNIAGGAAAKVKANIASYGFNIGARFAFN

SEQ ID NO: 18389 - protein, 282 aa, Anaplasma phagocytophilum
MNYRELLVGSLSAAAVCACSLLISGSSFAYSGNNDASDVSGVMNGSFYVSGSYSPSFPSISSFDISESDRGGSYVKGYNKNLSTLNVSDPISFTQNDPSFKFAKSLLTSFDGATGYAIGGARVEVEVGYKKFETLAESDYKHVESHNFVAVGRDATLTPDNFFVMKIDSVKDISVMLNACYDVMHTDLPVSPYMCAGLGASFINIADHVTSKLAYRGKVGVSYKLTPEISLIAGGFYHGIFDEQYAGIPASNRVNIAGGAAAKVKANIASYGFNIGARFAFN

SEQ ID NO: 18390 - protein, 427 aa, Haemophilus somnus
AASTHLATAAPSVSDQSEAKGFVEDAKLTETLKNYYFDRDNKNGGRDQKDWTQGFLGNFTSGYTQGTVGVGIDAYGYLALKLDGGDGPSGSGNMSRSDTVNPNNGARDVNDSQGKAGASVKFRVSETELIFGDMQPSTAPVFAVGGSRILPQTATGLQLQSSEVKDLDLEAGPFYSASSQDKNARNGGVFAKYAGVEADSIDYFGGKYSITENLSASLYGGKLEDIWNQYYANVNLTTPFSGDTSLNTDFNIYRTTDTGDKLAGDISNTAFSLATALSFLKAHTFNLAFQKVNGDTPFDYIGVGKNNRGGDSIFLANSIQYSDFNGPGEKSVQARYDLKMAEYGVPGLSFMVRYVRGWEIDGTSTPAGSPYTGLYGEDGKHDGSNFEAKYVVQSGPAKDQSFRIRQAWLFASADEGVGETKESRLIA

SEQ ID NO: 18391 - protein, 376 aa, Haemophilus somnus
MKKTLVALAVAAVAASANATTVYNQNGTKVDVGGRIDVMLGKFGDAQRTDLRNNSSRVEFKAEHEVQNGLKAIGAVRFGLGDASKADTSFNDIKLSKLWLGLKHNDIGKVTFGKQNTTADDVQLNDHTYIFGGNNNLVTSGDKVVSFRTADIQLAEGQTLGFGVDYGFGEAHKKDIKNGIGKKHIELKNTYGVSAFYAGNFGDVKVNTNAGYTVRNKNHVAGPTEYTKTDNQQQAWRLATQVEFGPASFGIEYGKTTSKDKVQKQNKGSMASIEVGAKYAVLPDVLNVYAQWQRNSIKSGDGQSDLELSLADVELKEFKVEAHKKSVQNVFIVGADYAFNKNLLAYAEFANSRVKAATKDKNVKESFYAAGLRVYF

SEQ ID NO: 18392 - protein, 380 aa, Haemophilus somnus
MKKTLVALAVAAVAASANATTVYNQNGTKVDVGGRIDVMLGKFGDAQRTDLRNNSSRVEFKAEHEVQNGLKAIGAVRFGLGDAEKEDTSFNDIKLSKLWLGLKHNDIGKVTFGKQNTTADDVQLNDHTYIFGGNNNLVTSGDKVVSFRTADIQLAEGQTLGFGADYGFGEAHKKDIQGRDSDKKHVKLKNTYGLSAFYTGNFGDVKVNANAGYTVRNENTKVGVIASKTDNQQQAWRLATQVEFGPASFGIEYGQTVYQSKVQHEFQGSARFVEVGAKYAVLPDVLNVYTQWQRNSLRSASGTEAKKFEQPFALSYVKVADLNLKEHEKAVQNVFIVGADYAFNKNLLAYAEFANSRVKAATKDKNVRESFYAAGLRVYF

SEQ ID NO: 18393 - protein, 380 aa, Haemophilus somnus
MKKTLVALAVAAVAASANATTVYNQNGTKVDVGGRIDVMLGKFGDAQRTDLRNNSSRVEFKAEHEVQNGLKAIGAVRFGLGDAEKEDTSFNDIKLSKLWLGLKHNDIGKVTFGKQNTTADDVQLNDHTYIFGGNNNLVTSGDKVVSFRTADIQLAEGQTLGFGADYGFGEAHKKDIQGKDSDKKHVKLKNTYGLSAFYTGNFGDVKVNANAGYTVRNENTKVGVIASKTDNQQQAWRLATQVEFGPASFGIEYGQTVYQSKVQHEFQGSARFVEVGAKYAVLPDVLNVYTQWQRNSLRSASGTEAKKFEQPFALSYVKVADLNLKEHEKAVQNVFIVGADYAFNKNLLAYAEFANSRVKAATKDKNVRESFYAAGLRVYF

SEQ ID NO: 18394 - protein, 380 aa, Haemophilus somnus
MKKTLVALAVAAVAASANATTVYNQNGTKVDVGGRIDVMLGKFGDAQRTDLRNNSSRVEFKAEHEVQNGLKAIGAVRFGLGDAEKEDTSFNDIKLSKLWLGLKHNDIGKVTFGKQNTTADDVQLNDHTYIFGGNNNLVTSGDKVVSFRTADIQLAEGQTLGFGADYGFGEAHKKDIQGKDSDKKHVKLKNTYGLSAFYTGNFGDVKVNANAGYTVRNENTKVGVIASKTDNQQQAWRLATQVEFGPASFGIEYGQTVYQSKVQHEFQGSARFVEVGAKYAVLPDVLNVYTQWQRNSLRSASGTEAKKFEQPFSLSYVKVADLNLKEHEKAVQNVFIVGADYAFNKNLLAYAEFANSRVKAATKDKNVRESFYAAGLRVYF

SEQ ID NO: 18395 - protein, 380 aa, Haemophilus somnus
MKKTLVALAVAAVAASANATTVYNQNGTKVDVGGRIDVMLGKFGDAQRTDLRNNSSRVEFKAEHEVQNGLKAIGAVRFGLGDAEKEDTSFNDIKLSKLWLGLKHNDIGKVTFGKQNTTADDVQLNDHTYIFGGNNNLVTSGDKVVSFRTADIQLAEGQTLGFGADYGFGEAHKKDIQGKDSDKKHVKLKNTYGLSAFYTGNFGDVKVNANAGYTVRNENTKVGVIASKTDNQQQAWRLATQVEFGPASFGIEYGQTVYQSKVQHEFQGSARFVEVGAKYAVLPDVLNVYTQWQRNSLRSASDTSAKKFEQPFALSYVKLADLELEEHQKAVQNVFIVGADYAFNKNLLAYAEFANSRVKAPTKDKNVRESFYAAGLRVYF

SEQ ID NO: 18396 - protein, 168 aa, Haemophilus influenzae
AKTIADGITSAEDKEYGVLNNSKYIPTNGNTVGYTFKGIDGLVLGANYLLAQERHKYTTAGGTRAVTVAGEVYPQKISNGVQVGAKYDANNIIAGIAYGRTNYREDIVDSDLGKKQQVNGALSTLGYRFSDLGLLVSLDSGYAKTKNYKDKHEKSYFVSPGFQYELME

SEQ ID NO: 18397 - protein, 249 aa, Haemophilus influenzae
EKKKTMRQLNKENPWQAGARTSGATRNPYWAWQLNSLRFASVALVFNMRMQPQRWILGPSLIRGLSNGVFSNSTRDGRFWYVRTLGLSRVSRQPSICFGLKPQIRLYAGLKAVENGVAKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRLTVCPWFRSDRPR

SEQ ID NO: 18398 - protein, 173 aa, Haemophilus influenzae
AKTIADEITTAEDKEYGLLNSKKYIPTNGNTIGYTFNAIDGLVLGANYLFAQERDVQNVPAIGLKAGEVTVGEVSNGIQVGAKYDANNIIVGIAYGRTNYKDTDKTTTTGGRATTYDYQGKKEEVNGALASLGYRFSDLGLLVSLDSGYAKTKKYKAKHEKSYFVSPGFQYEL

SEQ ID NO: 18399 - protein, 143 aa, Haemophilus influenzae
ADNSIHNERIALGANWHEALFENKHFEISGRWEVNVNRWHSSKSHPLNKSGYIVGLTPVFNYTWKTGSVKPFLELGGGPQYLSDVTIENEFKSTQFQFGSILGLGIQTDRFEIGYRYLHISNANIELPNPGTDFHNLHLGLKF

SEQ ID NO: 18400 - protein, 119 aa, Haemophilus influenzae
VIAGIVYDYKSNFRAVWSIKDFELGMNWRHLSAVDVEPGPVTWFKPYTSIDSYDYFDLTMAYELPWNARINFTVNNIADKKPPVVGSNIGSTGFNSGNTFPQFYDTLGRYYTMGITMRF

SEQ ID NO: 18401 - protein, 173 aa, Haemophilus influenzae
  misc_feature (106)..(106): Xaa can be any naturally occurring amino acid
AKTIADEITTAEDKEYGLLNSKKYIPTSGNTIGYTFNAIDGLVLGANYLFAQERTLNEYVATSGKIGEVRTGSISNAIQVGAKYDANNIIVAIAYGRTNYKDIDSXKRTPGGTGNYLYQGKKEKVNGALASLGYRFSDLGLLVSLDSGYAKTKNYKAKHTKSYFVSPGFQYEL

SEQ ID NO: 18402 - protein, 180 aa, Haemophilus influenzae
GIAYKKDTSDYSPLKPSFIAGGGAFGYKMDDIRVDVEGVYSYLNKNDVKDVTFDPANTIADSVTAISGLVNVYYDIAVEDMPITPYIGVGVGAAYISTPLEPAVNDQKSKFGFAGQVKAGVSYDATPEVKLYAGARYFGSYGANFDGKKTDPKNSTGQAADAGAYKVLYSTVGAESGVAF

SEQ ID NO: 18403 - protein, 180 aa, Haemophilus influenzae
RYYHYDLDRNNTLAHTDANRFVTAANGELLVKLRRGNVQRKEDGWFNQTELKQQAQIAGMQHNLLYGVELGRQNKDQAFFSQSDAARVPVFRDGLVRVPFQAAQQTGKGRNIQDTAGFYVQDLIELAPQWKALLGVRYDVFDQEYQDALSDSDIARTDRTWSPRVGLVYQPDQIQSYYVS

SEQ ID NO: 18404 - protein, 137 aa, Haemophilus influenzae
KDRNTTQYEVFGEYELPWSLRSKGGWGISTRLALTAGALKSQGQYGFVGSLGPAFSLGNPQLFPLELDLGVSVALLSRERFGTRDYNGIEQFSSHGGFIYHINRNLGLSYRYQHMSNAGFNGRQNPGLNMHLFGINW

SEQ ID NO: 18405 - protein, 241 aa, Haemophilus influenzae
HSDILPSSPLDRTDPNLEDAKGDNSELGIRGNWKNVFQWDINYFLLRYNNRIGILIETNPEETFFYKTNIGDMLSQGMEAYIEFHPFELLATHSRYLNIGLFTATAYNSAHYKKGTVNSGGNNVDITGNDVENVPSWISRNGINYHLKSFSSAFQFSYVSRSFSDALNTVSTSSGVNGIVPSYFLVDFNMSYNFGNRYNLKMSLNNLADKKYYTRRATGYPGPGILPSDGRSILISFGAKI

SEQ ID NO: 18406 - protein, 1613 aa, Haemophilus influenzae
AIQQNRTTNGAATTVDGAGFDQAAAPANVAVALNAVITANANNGINLNTPAGSFNGLFLETANHLAVTVSEDTTLGFITRAVNNVHSFNLTLNAGKTLTITGKGITNAQAAATQNAQNVVVQFNNGAAIDNNDLKGVGRIDFGAAASTLVFNLANPTTQKAPLILGDNAVIVNGVNGTLNVTNGFIQVSNKSFATVKAINIGDGQGIMFNTDANNANALNLQAGGTTINFNGTDGTGRLVLLSKNAAATDFNVTGSLGGNLKGIIEFNTVAVGGNLIANAGPANAVIGTNNGAGRAAGFVVSVDNGKVATIAGQVYAKDMIIQSANAAGQVNFGHIVDVGIDGTTAFKTAASKVAITQNSNFGTTDFGNLAAQINVPNTMTLTGNFTGDASNPGNTAGVITFDANGTLASASADANVAVTNNITAIEASGAGVVQLSGTHAAELRLGNAGSVFKLADGTVIKGQVNQTALVGGVLAAGAITLDGSATITGDIGNAGGAAALQGITLANDATKTLTLGGANIIGANGGTIDFQANGGTIKLTSTQNNIVVDFDLAITTDQTGVVDASSLTNAQTLTINGKIGTIGANNKTLGQFNIGSSKTALSDGDVAINELVIGNNGAVQFAHNTYLITRTTNAAGQGKIIFNPVVNNNTTLAAGTNLGSATNPLAEINFGSKGVNVDTVLNVGEGVNLYATNITTTDANVGSFVFNAGGTNIVSGTVGGQQGNKFNTVALDNGTTVKFLGNATFNGNTTIAANSTLQIGGNYTADFVASADGTGIVEFVNTGPITVTLNKQAAPVNALKQITVSGPGNVVINEIGNAGNSHGVVTDTIAFENSSLGAVVFLPRGIPFNDAGNTIPLTIKSTVGNKTATGFAVPSVIVLGVDSVIADGQVIGDQNNIVGLGLGSDNGIIVNATTLYAGIGTINNNQGTVTLSGGVPNIPGTVYGLGTGIGDSKFKQVTFTTDYNNLGNIIATNATINDGVTVTTGGIAGTGFDGKITLGSVNGNGNVRFADGILSNSTSMIGTTKANNGTVTYLGNAFVGNIGDSDTPVASVRFTGSDGDARLQGNIYSQVIDFGTYSLGILNSNVILGGGTTAINGKINLLTNTLTFASGTSTWGNNTSIETTLTLANGNIGHIVILEGAQVNATTTGTTTIKVQDNANANFSGTQTYTLIQGGARFNGTLGGPNFAVTGSNRFVNYSLIRAANQDYIITRTNNAENVVTNDIANSPFGGAPGVGQNVTTFVNATNTAAYNNLLLAKNSANSANFVGAIVTDTSAAITNAQLDVVKDIQAQLGNRLGALRYLGTPETAEMAGPEAGAIPDAVAAGDEAVDNVAYGIWAKPFYTDAHQSKKGGLAGYKAKTTGVVIGLDTLANDNLMIGAAIGITKTDIKHQDYKKGDKTDVNGFSFSLYGAQQLVKNFFAQGSAIFSLNQVKNKSQRYFFDTNGNMSKQIAAGHYDNMTFGGNLTVGYDYNAMQGVLVTPMAGLSYLKSSDENYKETGTTVANKQVNSKFSDRTDLIVGAKVAGSTMNITDLAVYPEVHAFVVHKVTGRLSKTQSVLDGQVTPCISQPDRTAKTSYNLGLSASIRSDAKMEYEIGYDAQISSKYTAHQGTL

SEQ ID NO: 18407 - protein, 754 aa, Haemophilus influenzae
QYVVDVLVNNERTGRANLVITEEDEKNNHLCLSHEWLDSAGVMMKKDAYDYAFDREKQCYVLTRNSHTKVDFDYGAQTLKFNIPQAYLLSKTDPARWDYGLNGGRLKYYTNFNKNVHDDVNVFGNLDATINLGRWVLSSNMNMSHDRDKTEITSSDLTLSTAISQVQGDLLLGKSQTRTELFSDFNFYGVALRSNSNMRPWESRGYAPGITGIASTPSRITVKQNGYTVYSKMVPAGPYRLDDLRPMGNGELVVTVEDESGNKTEQVYPVTTLPTLLRPGEFQYNVAVGKKNNNNELDKAFHSDTGLFWLGSLDYGFSTTTLNSAFILNDDYQAAGLGGTQMLGGLGALSLSANMSKASYDNGEVKTGESFSAKYAKSFTDRTDLQLLTYRYQSKGYVEFADFNPKDIWSYARYGGQRSRYEARLSHRFDGTYLSGSYWRQDYWMREGTDTGSTLSFSTSVFDSVSVFLNGAYSKYAWSDKADYAVSLSLSVPFDLKGTRHYSSNSVGYTRTGGTTFNTSVSAMPTERLNYSLSANAGSTGDRGASASASYAFDAIQTNLGVSRSYNKHGNSHTSFSGSVSGSVLGTSESGPLFTKESSDTVGIVSIPGVEGVSVNGSMPTNRDGNTVVWLSEYSENNININMDNVPDDMEFETTSFNVVPTEKAMVYRKFGFENVLRYILRVKNAQGNYLTGGDAKTEQGLNAGFISNNGVLLMNMLAEPKAVSVNIGNGKQCRFSTAGLKANTNKVQEVRCE

SEQ ID NO: 18408 - protein, 232 aa, Haemophilus influenzae
EYGVLNNSKYIPTDGNTVGYTFKGIDGLVLGANYLLAQERYKYTGAGAGAGAAAGAVAGEVYPQKISNGVQVGAKYDANNIIAGIAYGRTNYREDIITGSDSGKKQQVNGALSTLGYRFSDLGLLVSLDSGYAKTKNYKAKHEKSYFVSPGFQYELMEDTNFYGNFKYERNSVDQGKKEREQAVLFGIDHKLHKQVLTYIEGAYARTRTNDKGKAEKTEKEKSVGVGLRVYF

SEQ ID NO: 18409 - protein, 808 aa, Pseudomonas aeruginosa
MRNTLTLHPRLSTAALALALLTPLASQAEAQKIQFDIGAQPLPSALRQFGQQSQLQVLYSADEVRGLRSNPVRGQLSVEAALAELLRGSGASYSLQGSSVTISAQRSADSVDLGDITVTSQESAWGHVNGYVAKRSGTGTKTDTPLKEIPQTINVVTQDEIKARGSQTVTEALRYTPGITGGGFADRVKIFDEPTSRGFSPAPLYLDGLHMPYGGGSTGGALQIDPYTLERIEVLKGPASVLYGQNEPGGIVNMVSKRPTATPIREVVLGGGSQDRRYGAFDVGGALDEQGTYLYRLTGVGRDINSEIDYAEQKRFMLAPSFTWNPNEQTSLTFYGQYQKDNDVPEAQGLPAYGTVFSTPNGRIKRSTFIGEPGLNSYDRDQFVLGYEFSHEFNDVWTFKQNTRYAYLDDQYVAPLHGYNFVPNPNTGANDRRYATRYGVDWSQTNKAFGMDNMAQAKFKTGAIDHTALIGIDFYHFKTKFFGLYSNQEPTTIIDLYKPVYGSKFTFTNPYRWNRTTDQTGIYLQDQMKWNQWFLTLGGRYDWAKTDAKETNGKVDAKDEKFSGRAGFGYEFSNGIVPYVSYSESFQPVGGLNMDEGNKAFKPTTGKQYEAGIKYQPPGQNSFIQMSVYQIDKKNVLTTDLLNPNFSKQSGAMRSKGFELEGKASLTNNLDVIASFSRNDIKYTKDNDGRKGRHPAGTPPMTAAVWLDYTLGADTAFAGLGAGIGARYTRGSDGTETAVGHFTIPSYTLYDGKLSYDFEKSPLQVKGLKVQVNLENLEDKKYVSRCTSDLDCYYGQGRTLTTDLTYNW

SEQ ID NO: 18410 - protein, 794 aa, Pseudomonas aeruginosa
MSRLGLALLLASAQAVAQEYEFNVPAQRLDAALQALGRQAGLQVLYNPSDLSGLRSRSVSGKLELEQAISQLLDGANGIGFELQGKTLILRLQDSSSVISLDSMVVSGLALNPTTENSGSYASPAVSIGKGNKSIKEIPQSVTVVTQKRMQDQNMSTVSDVLANAPGVTSIPMFGTGEQYYSRGFFIENFQYDGVPLERQSYARGSDFSGQTAIFDRVEILRGAQGLLEGGGNPSGSVNFVRKRPTAENQVRLTAKAGSWDHYGTQADISGPIDEQGRLRGRLVLDYDTKNSFVDHVGDDRQTIYAALDYDLTEATRLGFGFSRERIDANIDVNGLPNYTDGSMPHFSRSTFLGGDWSYWDKIQETFYFDIAHQFNEDWSLNATVVNAREKNDYKYLLMAGSINPDNTSTLRGDAYVFDFFSEHWGGDVYVNGRTKVADRQLNLTFGANYSDLDSSDTFGWRQRYVPNWDIFNSPVNTNKPSDDDIYSVRRSDDGYASIQKGVYGMGQYYLTDDLSVVLGTRISSYQKAYTSNGPWGYSKAVAKESAKAIPYAGIIYDLNPEWSAYASFTKIFLPQSVRTASGSILGPKSGKSVETGLKGILNDGRLNATFALFRMEQDNIPIQDANLPDDVQEANCGGTCYHGGGKAISRGFETELSGELFDNVQVYAAYTLNLLRYQGEVPSEADDVGASVNTPKHIFRSWVDYRLPGNWSRVSVGGGVNAQSRSAGFGYYGREQSGFAVWNSRLAYRFTEELTGAMNVNNIFDRRYFKSVDYGHNYFGDPRNVLFTLTYSY

SEQ ID NO: 18411 - protein, 732 aa, Pseudomonas aeruginosa
MSRLFSCRLRWPFAVFFTTSTFTMKLHTSACHALLIATSLAGARTSFAQASDAAATLPAISVNAAAEHGSYDGGHSRAATKTDMSLMDVPQTVNVVPHAVIEDQNATSLQDALRNVPGVGFSVGDGQRDQITIRGFNSITDQYVDGIRDDALYYRDLSNVDRVEVLKGPAAVLYGRGSAGGIVNRVLKRPQANPVNDVGVTLGTRGERRGEFDLGWNPNDAARFRITGAAENSNSFRDRFQLNRQAIAPSAQFKLDRDTVLNVEFDYLHDRRTSDQGLPAYRGRPVDVPINTYYGSADGGNSSYNDISAKSATVSLDHRFNDSLSFHGAIRAYDFSLERKNYVTYEPIKTAAHPVVTLDQSTRQRTDHGIDGLFELTQKTSLFGMRHELLYGLELSQQQKFDTIYSVTKVATYDLFNPQPVVLPGVPGGTRAKTNASTVVGLAGVYAQDLISLTEHWKVLAGLRFDYLNQIRHDYTSSNVNLDRTDHAWSPRVGLIYEPLDWLTLYGSFSQSFSPLADTLISSGAFSNGAALAPQKTTAYEVGSRFDLGGKATASVALFDMRQTNQQIGDPANPGYALPIGTQHVRGMELGFTGEIAPKWSVYAGYAYLNGTVDGSAQSTAAGLAVSSNTPGLMPRHSANLWLKRELPYGFYAAAGMQFQSARYTSASDLVTLPSFTVFNLGAGYRSKKVDVTLTLDNLFDRRYFIAAHGNADLYNMPGDPRTLTATVKWHM

SEQ ID NO: 18412 - protein, 103 aa, Pseudomonas aeruginosa
MALSLGQARRGAGADVVVQRRAGLAQSSNYTLASSPNGQERVQQGAYGLVYLMARYQFNRQLSLQVNLNNAFDKKYCSQIGYYGASAWGAPPSVVATLNYRFQ

SEQ ID NO: 18413 - protein, 317 aa, Pseudomonas fluorescens
KNTLGLAIGTLIAATSFGALAQGQGAVEGQLFYKKQFNDSVKHIEDGYNPGASIGYFITDDVSVNLNYDTTNHTRSNDGTGNQKIKGDTGSVTAQYHFGQAGVDSLRPYVEGGFGHQSRTNVQADGHSGRDQSTLAIAGAGVKYYFTNNLFARAGVESDYNLDNGKWDYSALVGLGVNFGGNAGAAAPAPTPAPAPEPTPEPEAPVAQVVRVELDVKFDFDKSVVKPNSYGDVKNLADFMAQYPATNVEVAGHTDSIGPDAYNQKLSQRRADAVKQVLVKDGVAPSRITAVGYGESRPVADNATEAGRAVNRRVEAS

SEQ ID NO: 18414 - protein, 219 aa, Vibrio fischeri
MLIIKRSVAIIAILFSPLSTASNLTSQLHNFFSAQLAGVSDEVRVSIRTAPNLLPPCEQPLLSMSNNSRLWGNVNVLARCGNDKRYLQVNVQATGNYVVAAMPIARGGKLEAGNVKLKRGRLDTLPPRTVLDINQLVDAISLRDLSPDQPIQLTQFRQAWRVKAGQRVNVIASGDGFSANAEGQALNNAAVAQNARVRMVSGQVVSGVVDADGNILINL

SEQ ID NO: 18415 - protein, 471 aa, Vibrio fischeri
MKQSTIALALLPLLFTPVTKARTPEMPVLENRAAQGDITAPGGARRLTGDQTAALRDSLSDKPAKNIILLIGDGMGDSEITAARNYAEGAGGFFKGIDALPLTGQYTHYALNKKTGKPDYVTDSAASATAWSTGVKTYNGALGVDIHEKDHPTILEMAKAAGLATGNVSTAELQDATPAALVAHVTSRKCYGPSATSEKCPGNALEKGGKGSITEQLLNARADVTLGGGAKTFAETATAGEWQGKTLREQAQARGYQLVSDAASLNSVTEANQQKPLLGLFADGNMPVRWLGPKATYHGNIDKPAVTCTPNPQRNDSVPTLAQMTDKAIELLSKNEKGFFLQVEGASIDKQDHAANPCGQIGETVDLDEAVQRALEFAKKEGNTLVIVTADHAHASQIVAPDTKAPGLTQALNTKDGAVMVMSYGNSEEDSQEHTGSQLRIAAYGPHAANVVGLTDQTDLFYTMKAALGLK

SEQ ID NO: 18416 - protein, 187 aa, Vibrio fischeri
MKRLLLVIGSLLSVGAYAGDSNHIVGGSIGYGVQDFEFESGQETGGEDSFAIDAYYRYMFNEHFGIETGLFGGTGGVASVFTGLFGGVDNISYKGIRGAFYGQVPLSESNHLYAKLGASANRLSYDVSRAFSSDVIKSVESSGSDFYGAVGWGIRFQSGIGMNIEYQYVPVQELKVQNFNIGMSYRF

SEQ ID NO: 18417 - protein, 742 aa, Vibrio fischeri
MKPEHRAVPAAPIAPIAPIAGHVPPRAKKLASLLHLGVPGALAGFACLAGAQQAAPAAAEAVTLNPVVVTGAPTATESFDLPYSVDSVDMRANQAGNLGVNASEALAGVPGLVIQNRQNYAQDLQISVRGFGARAAFGVRGVKLIADGIPATNPDGQGQAATFNLDTAERIEVMRGPFSTVYGNHAGGVIQLFSRTGEGAPRVRASALGGSWGTTKFGIGAEGEKDGVGFVLDASRFDTDGYRDHSKTRRDQGFAKLTLNPDEDSTLTLVANGLRQPETQDPLGVTWETYERDPQSLTIDPLDPATPKRSYADRYNTRKSIHHLQGGATYERRLGEDRMQVSAYAGSRAVTQYQSFSRGFQSSPRHAGGVVDFDRDFHGMGLRWISQRALGSGELTLTAGIDYDRSEDDRRGYENFVGSTLGVKGALRRDELDTITSIDPYVQALWKSGPWQWSLGARHSRVSFKVEDRYIKTDNPDDSGSVRFSKTTPALGVSYALSPATNLYASVGAGYETPTLNELSYATPTTGFNFGLRPSTSRQAEIGIKTFVSDNARINAALFRIETDDEIVVLASEDGRTSYQNAGRTLRQGLELAAQAELTRTLTARASLTWMQAEYDEAFSSRGTTVAAGNRIPGVPRIAAFAELAWEATPGVTLAGEVLHRGEVEVSDLNNDHVAPAYTLVNLRLSAEQRQGPWTFGQLLRVDNVLDREYVGSVIVGDSNKRYYEPGPERSVYAGVSASYRF

SEQ ID NO: 18418 - protein, 716 aa, Vibrio fischeri
MNVSTEYSKFNITLLATAIASSFLFPISAMANDGSASDDVETISIFGQAYRNTATKTSLEPEETPQGITVLDGEVLEQRSVKSLNEALRYVPGVTTEQKGGAVTMYDTFNIRGFDVNQSYYDGLVLQYLNGWNLQPQIDPIAIQQIEVFKGPTSVLYGSMPPGGMVNMVAKTPQKEKSTDVKVATGTGNLVEASIDTTGQFGDSDFSYRFIALARQKDGQVDYTEEERYVIAPSVDWQVSDRTLINFNMYYQNDPSMGMNSAMPASGMIYDNPNGSTDPSTFVGDKNWSTFEREFFMAGYKINHEFNNNWSFLQNFRYMNASLYQENTYHIESNFDPSTGNLDRNIYSTDESSTGYTIDNQLSGRVMVGSVEHNLLFGIDYQKLDGDSLYQEFGTTSQFGNFNIFNPNNNMIDRGKLTQSYESKEKISVEQLGFYTQDQIRIDRLVLIAGGRFDQYKSSNTTSTTSKDADQSQFSYRVGALYELESGFSPFISYATSFEPAAGLDAKGNAYDPELGEQIEAGVKYESADYTKTASASVFKIVKSDALMSDPSDPWGPQLQIGEIRSQGLELQGQWMVNDSWDIAANYTYVDMEITKDSGNDLEGKTPIYVPTHAASLWSNYYIYDGILTGTRISGGLRYVGEMEMDAANTDKVPDYTLADVSIGYELDGISESLTGATAQLSATNLFNTEYYSCYDSANCWYGAEQTVELSINYNF

SEQ ID NO: 18419 - protein, 4368 aa, Vibrio fischeri
MTKTIQSYSICDARHLQNKADALNKRSLLTGTILSRLGQLGVAAVLSGAMMAAGSGDALGQAGGVIVHPDTNANLTIQATEGGQVLTSNYLIIYTTLTALTAASIGTTIADPTNQGEAVEVISVVVNPTTGLATSMVVRPVVGGANRTVTTYRDASADYEPVSAGSPAGTTLTAPNAAVGDSNLFYSVSRGRTGADGNNGGGIGFLSYPAGDGEPGGSVLVPHTAVAALSHGPVEVISDGVAGVVIGSQGGSGGDGGYTIGIGTVAGRGGAAGSSGNVTGTNFVDVVTGRDPESLAQPACAPRATVNACDPTGAYSHGVHVFSRSGTAGEGGAGIILGFGGAGGSNDTTAGTASGTNYGQVTTWGEGAIGFLVQSVGGSGGEGGGSYGLVSLPGGGSWAGNADNAIGTNYGNILTHGVGAHGMYVQSVGGSGGVGGLGVGLVTLGDSGGAGGDSGAATAINHADNITTHGDYAIGVGAQSVGGGGGDGSTAAGLVALGGDGSTGGEVTLGSLVFVHQGAGRIDTYGRGSHAIFAQSIGGGGGNGGIGGGLVGLGGDGSAAGDGRDVEVQTEAGAQIRTRGEFAYGIFAQSIGGGGGAGAVGAGLIGLGGDGAGGGSAGNVLVVNNAEITTVGREARGLFAQSIGGGGGAAHAAGGLIAVGGSGGGAGNAGANVDVENYSLISTHGIGADAVFAQSIGGGGGAGSPTGGLVAIGGDGGSGGDAGEVDVQNHGNLHTRGDRARGIFAQSIGGGGGSGGDTGGLIAIGGDAAPGGNAVISDGALVYVRNSGAIETEGNVSSAIHAASVGGGGGDGGTTGGVFFTIGGDGAAGGDGGDVRVDHANNLRTSGNDSHGIFAESVGGGGGSGGSTVSVSAFIGVALGGDGDVGGDGGDVRVNFQSRTITLAGAPVEVDPLIETSGDRSRGVFAQSVGGGGGAGGFSVQVALGYIGALSISLGGDGAGGGDGGEVLICEPGTASSVLCSDVNIRTSGEFSEGLLAQSVGGGGGAGGFAISFAGAAGETAAGAISIGLGGDGAGGGSAERVFVDLGGSIATLGDFSTGMIAQSVGGGGGAGGFSVAAGVAAAGVASGSITVGLGGDGGAGGAGRSVDATFDGTISTRGDHSLGAVIQSVGGGGGNAGFNLSVPIGLSSTVAGGIGVGLGGSGGNGGSGGLVTGTIGGLVTTSGDFASGALIQSVGGGGGNGGFNISGSITLAGVAAGGITVGLGGSGGLGGAGGEVIAAASSIATSGDFSNGFVAQSVGGGGGNGNFNVSGNIAIGGTVGGGIAVGLGGSGEAAGSGDVVNATLTGVAATRGDQSTAIFAQSLGGGGGNGGINVSGNLAFSGAVAGAIGVGLGGSGEGGGSSESVTLTVVGSAHTGYVDEFDVRHGDESTAIFVQSLGGGGGNGGINVTGGIVAASTGAGTLGFGLGGSGGDGGNGWTATLALNAGVADDDNTLIAATTAGDRSGAIVVQSLGGGGGNGGLNVAGSLAFGTSFAGNLGVGIGGTGGDGGHSNLAIVPGVPVTYMADAGINGDVVTLGNESRAIVIQSVGGGGGNGAVNVAGGISGTTSGLSGNILVGVGGFGSDGGDGGAVIGTINSDIQTGQFAPGTTTTISGDGASGLTIQSLGGSGGIGGVNVTGGISVGLGSGGTGTLGVGIGGFAGGGGSASTVDGTFTGSILTRGDDAYGALLQSVGGGGGAGGVNVTGAVALSAGTTGSIGFGLGGFGGDGGRSDRVTGHLSGNVTTFGNDAFGAMIQSLGGGGGVGAVNVTGTLAASLGGSSNSGALSIGVGGFGGDGSPSGDVVATVNGTYLTHGLRSSGVIAQSVGGGGGNGGVNVSGAIQFGLADGAAGTIGVGGFGGDAASSAGNVNLVRNGDTITRGADSIGVLAQSLGGGGGAGGVNASAGISVTLDDGASLGFGLGGFGGDGGSAGNVTANIQGSVISTGVLSDITTDDEPVLITDFGDSYGLLGEGGRRRLGGSHGIVVQSQGGGGGIGGVNVTGQLAIGGDNGRGVSIGIGGFGGDGGDAGSAHLTFGNADNTVFAQGVGDDRAAVIVQSVGGGGGVGGINVSAGITTTGNLIAGIGGFGGDGGLGGAVTADINANLRADGRRARGLLAQSVGGGGGFGAINVSGGINATGSASVSDDPSLVFGLGGFGGDGNRSGNVAVNYSGNVAVTGEDSIGMLVQSVAGGGGDGGINVLGNLALGDGEGFAASIGIGGTGGDGANAGDVTFNSTGNVSVATSEPIDDDTPEFDPRRTSHNAVGVLVQSVGGGGGAGGVNVTAALSRAGQPIAVGVGGSGGSGGDAGAVRVVRGYSDPGAAATSTTDEIAPSGATPGSIWTAGDDATGLIAQSVGGGGGNAGINVTVSGAKPGDNNPVTAQFVIGGSGAGAGAGSTVDVHHAGNILTTGTQSRGLVAQSIGGGGGNANINLGLGYVKGASALNLSVGGATGAAGGAGAVTVSHSGVIATEGDDSDGLTAQSIGGGGGNTAMNTAMGLGSSRQLDIAIGRSGGTGGLGGSVTVTSAGTILTQGDRSRGIIAQSIGGGGGISGSIAVGAASVSGAGTSQRSYGGKLIVGLEGGSGAEASDVEVTSSSTILTAGAGSHAIHAQSLGGGGGVGGVAVNTLIGRSGALNLGVGGSGGSGNFAGRVDVISTGNLQTGGVAADGILAQSIGGGGGTGGYAATIGLQFLGAAKNGSSTLGVNVGGRGGNASDGGIVTVLNQGLISTLERRSYGIRAQSIGGGGGDGGMVFNGRIQGSGDNMDATFNVGGEGAGGGIGQDVTVTNEGAIYTGGDQSAGISANSIGGGGGDGGLLLNGDVGSTGSNNMSGRFTVNIGGSGGMGGVSGNVVVNNTPTAAADSGLIVTRGREAYGILAQSIAGGGGNGSSIISLTALGGDNDSAQLGLNVGGSGADASSAGTVTVNNGGRIDTSGFGAHGILAQSIGGGGGNGGLVFSGNAVLNARSIANAYSPFISVGGSGGDGGDANTVSVINTGHIVTRGAGAHGILAQSIGGGGGSAQMGFGLSNNVASVAMSNSIAAIAGATGGGDGGLGGDVIVNHTGDITTLGEGSVGIKAESINGGGGSLGFDLTGITTLPGRPAVVDSVFGSDAFGGSPGGTAADPLIMVRLGSMDSGDMNPGSVTQTGNGTFGAAGDHSVAEMAQSIGGGGGTLTLAGVLGTEAVSAAPVAAQEQEGKLAAGPLPGIDLGLVLGSLNGTNNHGGSIESAHVGALLTNGVMSPALLLQSIGGGGGRGTIDVTAPSGASLNPIDLALGSVNGQGETGGDVTRTQTGSISTTGAFSAASLIQSIGGGGGVANVQIDAVDQSNLRARPNLGSLGGTDLGSGDIVSGLAGDVYTTGDAASGLVLQSIGAGGGDVRIAGVDRVGVTLGGQLDAHGDGGAVTLSHVGLVQTMGNRSHGVMLQSIGGGGGAVTTNASEIEYQLMSDNSGAGGNIRFTQTGNIITVGEGSFGIIAQSLGGGGGWVDGVFAGTAGGAGSGGEITLTVDGALLATGLGSTAVFAQSDGVDGAGNISIALLEFARGGSGLGQGAFIDGGANNTLLTTTSLSAVSTWAVRSTTGNDAVANTGLVVGNLDLGTGVNSFDNLAGSTFIAIDTIDLRDAPGETQLSTSDQIFDAAAELPVIPPADTAAEPVSVNGAEDRTNAADPIDGPLASEPSRPVVSDLSDAPAPALVSIDQVLGGAGPAALPAGPNSLGVARAAASRPESATLSAADVSGERHTLQAALTASPQTGTAAPSVAEHPGDTKRPVQADLSEVSQPAMVSLASVDVSGGSKRPVQERGLSLPPTGPEFEPAPGTELAGKPGGVQVMAVLDLDDIPAPSEREQSALLASADPMNAATFRNSGTFLMGLSASDAPIDLLNGELFGNLDDRDDPATNLFYGVRVINTVELDGHFEQTADGHMVFDVAFGPYASDRVNVTGLTTVDGTGDITLIWLENTDRVTLFAAGEGGVDNGLSFRDTLAIDYSVAADAAGVHLLIDTDFGLASLNGNGRALGGHMDSALQAGGSAGLGRLLGFLGNLQNDQLDTYEAVFAELNPEPHTAVMRGQLTAANSFADDLFNCGSPVANGGDDCVWSRLEMTASSSDATVESLPTETQAMRFTGGFERRLGNDWSVAAGVSFEDTSPIRVDGQRAMTESQGFSVGLGFERNQATGPYYGGSVSGGWSWHETERVVTVFEAGVGTSTPESGYARIGGHIGDSFRNGSFFARPQVSASLTALHHDGLIEDGLDGLGVEVLSETELVAAINPQLTVGHIFRETEDMMGVVSLAAGARLMSQDSLELPMRFLGANPLAEPALIGTVLDDVVYQIGARIEIVGDERGSLSIGYDVEFGEQTEHRRAGIDFRVRF

SEQ ID NO: 18420 - protein, 312 aa, Vibrio fischeri
MKKLLLSTAILSSLTSTTLFAATVYDQDNTQLKVGGRAEARANISDNNETTDNSSFKDKSRARINLKGKTKINESLGAFGTYEVEIGSGKDNTVNTRYLFAGLSTTVGNFSYGQQDSAQVMLTDYTDILATFGGDAADLTTGNKDKRENNFLYSGEFDALTVQANYIASNEKDDDSFGISGMYALPMGLDFGLGYTSGQQASTGLNSVDADQINLAIRYTVNAFMVSGLFTTGEIDNKDANGYELAAAYKLDQWVFQGVYNFQDVDSTDTENNVAIEAIYKLNKSFRTYAGYKFEQIDNKDDQLQFGLRYDF

SEQ ID NO: 18421 - protein, 948 aa, Vibrio fischeri
MKKIYILTLLLCFISFGNSFAQTLKGHIYDAKTNEPLVGAAVTYKLQGNQGVVSDINGAYEIKLPEGGVDLVFSYVGYEDVLMPIVIDRREVVTKDVYMRESTKLLEEVVVSAGRFEQKLSNVTVSMDVVKAGDIARQAPTDISSTLRTLPGVDIVDKQPSIRGGSGWTYGVGARSQILVDGMSTLNPKTGEINWNTVPLENIEQIEVIKGASSVLYGSSALNGIINIRTARPGLTPKTRFSAYVGIYGDAENDEYQWSDKSFWKEDKYSVKPILRGSLFSGVRNPIYEGFDLSHSRRIGNFDVSGSMNLFTDEGYRQQGYNKRFRMGGNLTYHQPDMGMKLLNYGFNIDFLSNQYGDFFIWRSPTEVYKPSPFTNMGREDNNFHIDPFINYVNPENGTSHKIKGRFYYSADNIVRPSQGASIGDILGNMGTDAQTIQNIAGGDYSSLYPALVGIGSGLINGNLEDAMNGVFTSLGNIFPNATTADYCDLISWVMDNGVPGDLGGLANGQLPSDLIPWVSGMLNPTRNTPKTQTDKSTNYYLDYQFNKKWDSGAQITTGATYEHVRYDSAIMDEVYKSDNIAAFFQYDQRFWDRLSVSAGVRAEYYRVNNHHREAETKIFGTKVPFRPVFRAGLNYQLADYSFIRASFGQGYRNPSINEKYLRKDIGGVGVYPNLDIKPEKGFNAELGIKQGYKIGNFQGFVDVAGFYTQYKDMVEFQFGLFNNADYTMINSIGDAVRMLTDGQGFGIGAQFHNVSKAQIYGVEISTNGVYNFNKNTKLFYNLGYVYTEPRDADYQERNAVEGLYTDPLQMKEKSNTGKYLKYRPKHSFKATVDFQWKRINLGANVAWKSKILAVDYLMMDERPKTQLDLMDYVRGVAFGYSKGESLASYWKKHNTDYATVDMRLGVKATKEVAFQFMVNNLLNKEYSYRPMAVAAPRTFVVKMDITF

SEQ ID NO: 18422 - protein, 687 aa, Vibrio fischeri
MKLSPALLYLFMLISPWVVAEESLSDLDLDLDSLMAMDVQVTSAMKRTQSAFETASSIYVLTKEQITRSGVTSVPEALKMVPGLAVRQLDNNQWAISSRGVASRFSSKLLVMIDGQSLYTPEFAAVYWETLNVPLYDIERIEIIRGQGGLLWGSNATNGVINIITKNSIDTRGLYADVSSGSQLNVDTNLRYGGDIGNNGSFRVYGHVKDGQTSDKGIKMAPADFTEQQSAGVRFDFTPNDQWSGLIQGDITQSTLGQNFNGVVDSSNRNISFTGSLDRTDARIMARLENRISPSANQMLQTSWLKQSGEQTYIQEEFESFDLDYQINFLYQDLQFDWGLNYRYNAISFAQSTFIQSGGGFDNLQQYGTLAQAQYNVIADKLDFIVGVKVDHNDLTGWESQPLARLVWKPQNNQVVWLSVSKSVLVPSLLMFNDNYIIDGQRVEEVSPITTGIPEIDRYYIRTYLNGNNKVKSEKSVSYEMGYRLSDTTWALDLSVYHTDTDNVAVIEIDPNIDQFIPVFTMLQAGQIDAAVQALTTTSINFNLVSNAGLTTEGGDVVLSWQPVDNFTAEVGYSYNTFNYDLVDNTFPAIGYDSTSRQLFTKADIHFFEQHNIFASLRVENSDAYRTDNYTALDITWNWAFQPNWAFAIMGKNLFAGTHLEYGNHGETYTQSTFIDESVTFKITAKF

SEQ ID NO: 18423 - protein, 700 aa, Vibrio fischeri
MFSKSQLALVISAVLSTPFAYAETDASTTDEHMVVTGRDYGYKADTNSSSMRMEATQLETPGQVSVIDEQLIDEQRASTLGEVLKNDASIGAGATTRNREQFTLRGFELSSSSGFLRDGKQHWSHYRQPIELLERVEILKGPSGLLYGQSAPGGLVNMVAKKPTYETQVSVSQDLGSNNDSRTTADVSGALNDDQTLRGRAIVSKQTYNSWRQYSDGTVPSTERFVGGLFLDYDINDDITVSFHYDRTIDEGSVDSGAYIKDGKTVVNDKYIWDAQWSKIENDVENIGIDVAANLTDVWRINASFNHQDFNRHDVESFPKEETYNPATGEYVQGGSDRKDNWVFKTASIDLIGEFDALGVSHQMLFGSNWLGYRYGRLEYSFNSSVGQVGEPAPAPERNPNKDPRDTTSKYDTWGFYAQDMITFNEQWQALVGVRLDRQVEEGLAEEAVSPKLAVIYHPMDIGSIYATYSESFEMQGEVSGSEYVNDGQKLDPLRGKLYELGTKWELMDNQLFVSGAVFDITQENSTIDVDLGGGKKEKTQSGERVHRGVELAMQGFITEQLSMSGSATYLDAEYAKDEKYEGNRPADVPEYTASVWTRYAFTNSTDANLGAIYVGERYGDAANTFKKDGYARFDLGLSHTIKYDQDLTFVARFNVENLFDTDYLAGGGSTGKNGYATDGASNVVIGEGRNYMATLQVKY

SEQ ID NO: 18424 - protein, 724 aa, Vibrio fischeri
MNVKKGNYPLTLVAMAVAVATTSVAMSVQAEEYTSTTEETMVVVSSRTPKAISEIPGTVWFVDSEQIEQEYRGGKTLGEILATTIPSLDVSSGARTNYGQNLRGRAMLVMIDGVSLQSSRPISRQLDAIDPFNIERIEVLSGATSIYGAGATGGVINIITKKADSDELQFESYVSGSSGFNSGDDFDYKLAQSISGGTEKVKARVSAVYTETQGYYDANGDIVTPDISQGSLQYNEIIDLQSTVDVAISDTKNINFLAQYYDSQQDSPYGLYIKNYKFIDVRKGFESDRQHGTERIMLSAAYSDSEVLGHQLVVEASYRKEDQTYTPYYQSASQQTTDVISLKTALAKSFGKVNLVYGVDAYMDKFDSNQALFDPTIANNSGNLVNQTYAKVGRYPGVEVGSVAGFIQADINITDDWSIEGGYRYQYMNNKIDDFVDYKIQKKIAAGNGVSADAVPGGETDYTVGLFNLGTIYKLTPESQIWANFSQGFDLADPAKYYGQGSYSAADANGHYTLQNSINVAGSKMSGIKTNSYEVGFRTDQSALSFQTAAYFSQSDNSVKYNKKTLLIEDVDNEKRVYGAEALVSYWVMDNLQVGASGHYVISELQTDGKWDDLSAGEASTSKANSWVGWYESDLALKVQSQTMFDYKDSSDNELSGYTVFDLVGSYELPVGSLGFGIQNLFNKDYTTAWGQRAQILYSSHYDAAAYDYKGRGRTYTLNYQVTY

SEQ ID NO: 18425 - protein, 432 aa, Vibrio fischeri
MSMLRYIHILLAVLCLASGDARAGNSGDAGATPQPPPFGGPWDTRLKLTGDWGGVREQLRDHGFTFDISATAYYQGIARGGLEQDSELGGRSDYWLNVDGQKAGLWPGLFLTLHGEAVYGDSVNSETGAIVPVNIGRAHPVFFGTAGALTAVKFTQALSENFLVYAGKINTIDNVQQPFMPGHGLDAGFMNAAFVWNPILGRTMNYATLGAGAAILSQSYPVLSLTVYDTHNAATETGFKDAFDNGAIIYPTASLPTKFFGMPGHQSLWGVYSSGRYAIVEQQSLNQIPTGLPPTTLERGSWWVTYLFDQALWVDPTDQTRNWGVFGNAGISDGKPNPIQWSAIFGVGGSSPIRDRRQDYFGLAYYYLGFSGDFKDVARVITPVRDERGVEIFYNVGVTPWCHITPDLQVITPILGRTETSVVLGLRMKVDF

SEQ ID NO: 18426 - protein, 615 aa, Vibrio fischeri
MKKTALATAVVSLLSHAYTSPVFAKNTTTETDETMVVTANRFEQSTEDVIAPMSVVTKEEIVQIQAKTMTDILRLQPGIEVASNGGIGQNASIFMRGTNSDHVLILIDGFRMNSSIKSGMNINKIPVNQVERIEIIRGSGAVMYGSDAVGGVINIITRTSSDNLSKSATIGAGSDKYKEGNFAANTKVGENGHLKMAAGFTQTEGYNVNPQPGFNDGDKHGFENSQFMLNYEHQLSSYVSLFTGVRWFNSTSEYNHYTNTKSRSESESTVYSSKLSFHKDTVSSNLSISYQDDQTLEYHENGDLDSEQKIDQLNMQWANQIKLTDGWLVNAGVDWTDAKVKADITDWSNKVIINEGESCTSTGIYLGTQYQLEQLKLEANTRFDKHDKYDEYTTWGVGASYQINDIYKVSTAYNTAFKAPSFYDLSTAPDLEPETSKNIDVSLAAVYSLVNVNLSMYKNRVDNLIVYYDAPNFAGYSANVDADIKGAELELLFDTGIISHTLIAEYKDHEDTEGQQLARRAKQNYKWMGHISLGDLDLNLSYIYTGKRSDLPSAPGVETAYLDPYSLWSVAAAYWVTSDLAVRGRVENLFDEEYETAGGYKPAERSYYVSLDYQF

SEQ ID NO: 18427 - protein, 206 aa, Vibrio fischeri
MKRIFLPLLISTASFYTLANDNMDISQPKISGFYAGVGFGSFGYSEEDSWGYNNNPISAEADGNSTKVYLGYQFNKIVGIEGTYTDYGTAKAKVGNYSMKPSSISLAANLGYTFKNGIRPFGLVGMSSLDLNQSEELLTDDSGAAFKFGFGVEYTPKALGGVQFRAAYEMDMYAVEYLDYQSGAGLTTETNLYALDSLYVGASYKF

SEQ ID NO: 18428 - protein, 212 aa, Vibrio fischeri
MKKYLFLLMAATSTATIAAPYVGLEYGLTNMSHDYSTTFSETTGDVTLTPDDSSSSFGGFVGYRFNDFGLELGYKKFESDDSQNKVLSYAYPVETEREWDADLDATQITLKPVYFYNINEKLQLKTGLGLTYTQYKYNSSAYTETENDLTDQETISDYVAGDSKSESVFGGIASVGIEYMVIPNLALGASASYQVDSIANSTSFMLSSAYYF

SEQ ID NO: 18429 - protein, 367 aa, Vibrio fischeri
MENKFFKTTLLGAAVALASAGVTAKEVGINSDFNVDVYGVAAISVVNYNVTDNRDEGKGFAVENESRIGFRAHKEMFENVLITMQIESGYVDSTDWSHGGVSGGVLGFRDTFIGASGDWGNVRVGRVLTPLYEIVDWPFSNPGLGSVFDWGGIAGHYDRQSNQVRYDSPKFGGFSFAASVGRDDDNNGGGNATRDASFVGANAKYSFEKITFMGGVESGTRVTPAKDAGFEFNPETGASDPVAATPEVQDDAFAYIVGFEASLPAGFGIAAAYKGEELDNSARKVTQDSYSVIGQYWNGPIGFKLGYAANLESETNGKTDKNSDSNTISGQLMAVHNGFVPYLRIAGRTVGDADTDIVTRIGLEYGF

SEQ ID NO: 18430 - protein, 430 aa, Vibrio fischeri
MNNNKNRLSIAVALGLLGSVASSNTMAAGFQLAEYSATGLGRAYAGEAAIADGADAQWRNVAMLTYLEDTQVSVGGIYVNPNIDVEGSSKFAGQTINTKSEDFAHDAFIPNLYVSHRVNQQLAIGFAVGTNYGMETNLGDDFSATNFGNEASVITKEINVNMAYQINQQFSVGGGVRYVIAEGSFGAIIPNQLGMLDPKLPGTTLKYMEGTDEAWGWQVGTAWQINDANRIGFSYKSEVALDLSGHAEGAAFGGRHNGSMALDLPATAELASFHQLNDKVAIHASFNWTDWSSFEKLEANIPALGGKDLIKQENWEDNYRLAIGGTYALNQKITLRTGIAYDTSAVSDENRTATIPETDRLWLSMGAGYAWSDNLTLDAGFTYIFAKDATMFEGKESATDPKDPANFGGEFTGETTGNVWLVGVQANYRF

SEQ ID NO: 18431 - protein, 346 aa, Vibrio fischeri
MNKKQSALAAGVVLAGLASAPVMAQSATTLYGVVDAYFSYGKMGDNRKTGIDPGGLTGSRVGFRGTEALGNGVAAVFALEYGLLNDANEGIGTTGLRARQQFVGLKGSFGFAGLGRQYAPGYYVFKYDAAIGTPWGPQAMLGIKAGATIVPASPARANNALNYISPNMGGLTVNTIYAFSEENQATNRRQGDRFSIGAEYANGPLGANVIYHLGRNMPAAVGRDDKKEWYAGGSYNFGVVTLLASYQQVEQDSDTNKVYQVGAIAPVSSAGKLHFAIGRLDHENSAMDATNLTVGYGHALSKRTTAYAFATRVNNDSAQDATFVASAVGQTGENSTSLMVGVNHTF

SEQ ID NO: 18432 - protein, 353 aa, Vibrio fischeri
MKKTLLALAVPALLMAGSASAATVYTAEDGSTIDVYSRLGFNITDRAGMGEDGDAVGNFDARIGLGGSQVVNDKVSVIGWAEYSVGAAEQRGTDNSFTPRYVWAGIDASEAGKVTFGRVASGIIMLSDVGDVFAASDVILGRQLELVDNSAAQTFRQDGTIQYQNSFGAFDMSVAYILGNSESNQDGSYNAAARYTFDMGDAGQLIPIAAYQANSTGDTGSNANRDYTFWGAGLQYKLNALTLGAMYNQDEIEGQGISGTSKDKSYELTAVYNINDDWTARAGYRALENTGGDETEYKDTTLEVQYHLTARSSIYTSYVMRNGENGTGLGAPAVMTWNNAEEDYYHLGLRYEF

SEQ ID NO: 18433 - protein, 427 aa, Vibrio fischeri
MNTSVSRRASLMLAALCCAWQSAQAAFVADGKGSLELRNFYFDRDFHGAAASQSRRGEWAQGFLLKWQSGYTEGVVGFGLDAAGMLGVKLDSSPDRSGSGLLPRGSDRRAVDGYGKAVATVKAKLSQTQLQLGGLSPQLPLLASNYSRLFPQWFKGTQLVSKDLDRFTFTLLQVDATKLRDSTDFESLTAMAQQGAYSATVTSDRLYYAGVDYQPAKSLTLSVHTSQLEDLFQRDFAGFKYRAGLGPGEAFTEWRWFNAHDQGRALLGEVDNRTLSTNIGYGLHGHTFSGGYQKASGNTAYAYVGGTDTYLFSEQQVSTFALANERAWMLRYDYNFAALGIPGLTFNVRYVKGDQIDPQRIASSKGRALAARGGEGEEWERTTDISYVVQSGVFRSLALRWRNATMRSNFADAADENRVIVGYTVEF

SEQ ID NO: 18434 - protein, 157 aa, Vibrio fischeri
MKKTLLALALASVSATAAADSLVYGGVQVGSADYRSESSTVYGAHIGTGLLPFIGLEMGAWNLGSYDYGSQTTDVTSVNFAVKPSIDFGPLHVYGKAGMHSWEAKGFRKDDGVDPFFGLGVEYNIIPMFTVGAGYNNFTVGDENIDFASLNLTVHFL

SEQ ID NO: 18435 - protein, 837 aa, Vibrio fischeri
MKQLFTLLLVFTSLITFAQRPQGQRPSPINITGIVLDQDTGQPLEYATLILQSLRNPDRVTGGITHASGKFNVQTMPGRYNVRVEFISYKTYVLEAQTFRSSTDLGTIRLAVDVAQLEGVEVTGERTTVELRLDKKIYNVGSDLTVKGGSVTDVLDNVPSVSVDVEGNISLRGNESVRILINGKPSALSGLSTEALQQLPAEAIEKVEVITNPSARYDAEGTAGILNIVLKQSKTAGVNGSMSLNVGHPESYGATVNLNLRRDKFNIFTNTSYSYRSGPGKALFEQENFNQDGSTASFQNEYRDYSRVRKGINTSFGFEYFIDSTSSITNSFVYRNSTGEDDTSIDFFNFDALNNPTIARNRSSFETEDDESIQYSVNYLKKFDKDGHELKMDYQYSTGNELESSKIDESIVGESTFFPTEQTLNDERQIRQLIQMDYTLPFGKENKSQFEFGYRGTFNNFNTDFDFGILENNILQSDPNFSNELNYQENVNAAYTQLGTKLNKWNFLGGLRMESSDIDVQLLETNDLTNKKYTDWFPSVFVGYEFTDKEQVTISYSRRLRRPRSRFINPFPSRTSNTNLFQGNPNLDPTYTNAFDLGYLKRWDKFTFNTSAYYNKSTGVFQFITQETGDFVEIENPNDPLNPILVPVQVRTPINLATESRTGMEVTTSYIPKRNWRLSWNLNLFQRNQKGSHSYTNSMNQVISQDFNTENFTWFTRFSAKLPLPGTIDFQTNMFYMGPSEGAQSKYKSMLSTNMAFSKDLIKDKATVSLNISDLFNTRKRRSETRTDNVLTYSEFQRRQRSIRLSFLYRFNQPQNQRNRSGQRNGGGGDDFEFEEG

SEQ ID NO: 18436 - protein, 732 aa, Vibrio fischeri
MSNKKTFLAASILVALSPTLHAETSSNKETTMFDEVVVSATRTEQSIKDTSSSISKVTSDDIEKTMATDIQDALKYTPGVSANGGGRFGLSGFTVRGMSDSRIKMLVDGVQQPTPYNPGSNEQRKYPSTIEIDTLKAIEVNKGPSSTLYGSDALGGTVLMETKNPEDILRTDGDENAFEVKTSYNSIDTSSKTTGTWAMRAAELETLIMLTYKKGNESQTHSNGADIEGPDRGAANPADAQIGNLLAKAFYQLNDSHRIGATVEYFTSQYDEDELSQNGYSMMSRGTPIITYYDNYNKDTNTRLRVGLEHEWQANNSLFDTLESKLNVQQTESLSENYDTSTGPYGSGRRMRERIATDDSIQFDAQFDKMAEFGEGFHQITYGVSFRQNKFATENTDYKYDKGTVGPGHTDMPDATMTQYGIFAQDQAFLFNEQLVLTAGLRYDSFKAEPETNEGFKTEYPDSQNDAFTAKLGSVYHINNNFSVLGQISQGFKAPTLQDMYYFYDSGAVIDANPDLKAESSISYEAGIRAQSNAAQLELIAFYNDYSDFINQKYIGKVVGGPNDGKEHYTKENIDSAEIYGIEFNSTYLLDEAFNAPQGTYSKLSIAYAEGRDKKTGAPIDSVAPLTSNLGLGYDSVGYTYGALLNINMVAGKDKWSNVGNENINVAGYTLVDLTAYYKPMKDLTLRGGLFNAFDKQYWLYNDMIGTEVGEEGIDRQAQAGRNWGIELDYKF

SEQ ID NO: 18437 - protein, 200 aa, Vibrio fischeri
MKKIALLLLMFVAFQVSAQDFHFLPKIGLNLANMTNSDGSMKPGLNVGVAAEFPINPQFSVEPGIYYSMQGVKESEGGISGKIKNDYINIPIYAKAYLYNGFYAFAGPQFGFLARSKASASYNGTDISVNSKDAFKTFDFALGIGVGYQFDLGLLVSMNYNIGFTNTLSDGDITLNGNSMNWDGEKSRNGVLQINLGWRF

SEQ ID NO: 18438 - protein, 238 aa, Vibrio fischeri
MRKSLLALSVLATTVAIPAQAENLYTWGNMNINYLDWSNSSNDGGKDDFAYLEFEGGAGFDWGELYGFLDLEGQKDSMAASSKGSITYKTGLGELRLYGQTYSTENLGWHVRNTVAGVSYNFSGEQWFFNPFIGAHYTNTNGFSDMNGGMAGWVTGYNFNLGEQSFSISNWNEMEFARDSAYTALSGETDDISFNGAVAFWWNATKHITTGIQYRYADNKLGQGDLDDAIIYTLKYNF

SEQ ID NO: 18439 - protein, 191 aa, Wolbachia pipientis wMel
FLPLFAKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTVGAEAGVAFNF

SEQ ID NO: 18440 - protein, 158 aa, Wolbachia pipientis wMel
EETSYYVRLQYNGEILPFYTKVDGITNATGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARY

SEQ ID NO: 18441 - protein, 1304 aa, Wolbachia pipientis wMel
GHMVIQSANAGGQVNFNHIVDVGVDGTTAFKTAASKVAITQNSNFGATDFCNLAVQITVPDNKTLTGNFTGDASNKGNTAGVITFAANGTLASGNADANVAVTNDIKAIEAAGVGVVQLSGIHTAELRLGNAGSVFKLADGTVISGQVNQTALIGGALAGGAIQLDGSATITGDIGNGGGNAALQGITLANDASKTLTLGGANIIGANAGRTIDFQANGGTIKLTSTQNDILVNFDLAITTDKTGVVDASSLTNTQTLTIAGRIGTIANNKTLGQLKIGSSATTLSIGDVAINELVIGNNGSVKLGHVNYLIAKTTNASGQGKIIADSNIVINVGGHNLNITNLMAGTNLGSAEAPLSEFNFAAPTGGAISTVLTMIGGSNIYANNITTTTPNTGGFGFIGGGTSIISGTVGTPANKIGHVYLDGNSTVQFAGNAIFNDHTTIISNSTLQIGGDYTASFIASDDNTGILEFVNTAPITVTLNKQAGHVNDLKQITVSGRGNVVINEIGNAGNNHAIETDTISFENASLGAGLFLASGTSLDGLTIKSKVGNGTPGNFNVPAVIVSGIDSVIADGQAIGDQKNIVGLGLGSDNGIIVNATTLYAGIGTTKNNQGTVTLSGGIPNTPGTIYGLGVEHGYPKLKQVTFTTDYNNLGSIIATNVTINDGVTVTTGGVVGTDFDGTITLGSVNGNANVRFVDRTFSDPTSMIVTTKANVGTVTYLGNAHVGNIGAADTNVASVKFTGNDNGAGLQGNIYSQVTDFGAYDLTVLNSNVILGGGTTAINGEIDLLTNTLTFASGTSTWGSNTSIDTTLTVANGKIGHIVIAENAQVNATTTGTTTINVQDNVNANFSGTKTYILIQGGARFNGTLGGPNFAVTGSNRFVNYGLMRDANQDYVITRTNDAANVVTNDIANSPFAGAPGVGQNVTTFVNATNTVAYNNLLLAKNSADSANFVGAITTDSSAAVTNAQLDVAKDIQAQLGNRLGALRYLGTPETAEMAGPEGGAIPAAVAAGDAAVDNVAYGIWAKPFYTDAHQSKKGGLAGYKAKTTGVVIGLDTLASDNLMIGAAIGITKTDIKHQDYKKGDKTDIKGFSFSLYGAQQLVNNFFAQGSAIFSLNQVKNKSQRYFFDPNGKMNKQIAAGNYDNMTFGGNLMVGYDYNAVQGVLVTPMAGLSYLKSSDENYKETGTTVANKQVNSKFSDRIDLIVGAKVAGGTMNITDLAVYPEAHAFVVHKVNGRLSKTQSQLDGQVTPFISQPDKTAKTSYNLGLSASIRPDAKMEYGVGYDAQIASKYVAHQGTLKVRVNF

SEQ ID NO: 18442 - protein, 249 aa, Yersinia pseudotuberculosis
KYLPGYDEKTPVPGGLITGIFVPFGKEDVVYGTSIPNGYKDCRYNTECYKKNFKDNLALLLRKTDYKHHSYNLGLNLDPTNWLRVQLKYANAFRAPTSDEIYMTFKHPDFSIGPNTNLKAETAKTKEVAFTFYKENSYLTLSAFQSDYRNFIDLVFEKNKQIDKGSAIEYPFYQNQNRDRARVRGIEIASRLEMGDLFEKLQGFHLGYKLTYQKGRIKDNKLRSGYAEFLKLNPQYTAIASQDQPMNAL

SEQ ID NO: 18443 - protein, 223 aa, Salmonella sp. CDC 156-87
GYPITDDLDVYTRLGGMVWRADSSNNISGDNHDTGVSPVFAGGVEWAMTRDIATRLEYQWVNNIGDGNTVGVRPDNGMLSVGVSYRFGQQEEAAPVVAPAPAPAPEVQTKHFTLKSDVLFNFNKATLKPEGQQALDQLYTQLSNLDPKDGSVVVLGFTDRIGSDAYNQKLSEKRAQSVVDYLISKGIPANKISPRGMGESNPVTGNTCDNVKARAALIDCLAP

SEQ ID NO: 18444 - protein, 188 aa, Serratia sp. MF 416
SYNVRLQYNGEFLPLFTKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYSTVGAEA

SEQ ID NO: 18445 - protein, 222 aa, Enterobacter cloacae
GYPITDDLDVYTRLGGMVWRADAKNNDGFKDHDTGVSPVFAGGVEYAITPEIATRLEYQWTNNIGDANTVGGRPDNGLLSVGVSYRFGQQEEAAPVVVAPAPAPEVQTKHFTLKSDVLFNFNKATLKPEGQQALDQMYSQLSNLDPKDGSVVVLGFTDRIGSDAYNQGLSEKRAQSVVDYLISKGIPSDKISARGMGESNPVTGNTCDNVKARAALIDCLAP

SEQ ID NO: 18446 - protein, 225 aa, Serratia sp. MF 426
SYPIMNDLDIYTRLGGMVWRADSDGVGSNGGNHDTGVSPLAAVGVEYALNRDWATRLDYQWVNNIGDAGTVGARPDNGMLSVGVSYRFGQEVAAPVVAPAPAPAPVVETKKFTLTSDVLFAFNKATLKPEGQHALDQLYTQLSSLDPKDGSVVVLGFTDAVGSAEYNLRLSEQRAQSVVDYLISKGIPSDKISARGMGKANPITGDTCGYRSGRATAAQIACLAP

SEQ ID NO: 18447 - protein, 78 aa, Citrobacter freundii
GYGVAYLTENYRKFRNRKNTYVGSQFNYSFELMLSYNYYLTPRLQLSAEAGIIHYSNAALQMPNGGINALSLGLGIKY

SEQ ID NO: 18448 - protein, 196 aa, Wolbachia endosymbiont
SYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKNSTGQAADAGAYKVLYSTVGAEA

SEQ ID NO: 18449 - protein, 191 aa, Wolbachia endosymbiont
SYYVRLQYNGEFLPLFTKVDGITNATGKEKDSPLKASFIAGGGAFGYKMDDIRVDVEGLYSWLNKDADVVGDTVADNLTAISGLVNVYYDVAIEDMPITPYIGVGVGAAYISTPLKTPINDQKSKFGFAGQVKAGVSYDVTPEIKLYAGARYFGSYGANFDGKKTDPKDSTKQVTDAGAYKVLYSTVGAEA

SEQ ID NO: 18450 - protein, 186 aa, Wolbachia endosymbiont
SYYVRLQYNGEDLPSKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAEA

SEQ ID NO: 18451 - protein, 186 aa, Wolbachia endosymbiont
SYYVRLQYNGEFLPLFTKVDGITYKKDKSDYSPLKPSFIAGGGAFGYKMDDIRVDVEGVYSYLNKNDVTDAEFTPDTIADSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAE

SEQ ID NO: 18452 - protein, 193 aa, Wolbachia endosymbiont
SYYVRLQYNGEFLPLFTKVDGITNATGKEKDSPLKASFIAGGGAFGYKMDDIRVDVEGLYSWLNKDADVVGDTVADNLTAISGLVNVYYDVAIEDMPITPYIGVGVGAAYISTPLKTPINDQKSKFGFAGQVKAGVSYDVTPEIKLYAGARYFGSFGAHFDKSEEVDKAGGGKETKVTKDAYKVLYSTVGAEA

SEQ ID NO: 18453 - protein, 187 aa, Wolbachia endosymbiont
SYYVRLQYNGEILPLFTKIEGIEYKKATDIHNPLKASFIAGGGAFGYKMDDIRVDVEGVYSYLNKNDVTDAKFTPDTIAGSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEA

SEQ ID NO: 18454 - protein, 188 aa, Wolbachia endosymbiont
  misc_feature (25)..(25): Xaa can be any naturally occurring amino acid
SYYVRLQYNGEILPLFTKVDGITYXKDNGDYSPLKAPFIVGGGAFGYKMDDIRVDVEGAYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYSTVGAEA

SEQ ID NO: 18455 - protein, 187 aa, Wolbachia endosymbiont
SYYVRLQYNGEVLPLFTKVDNMKIKKGTDDVDPFKASFIGGGAAFGYKMDDIRVDIEGLYSQLNKNVNNNEVLTPDTVADSLTAISGLVNVYYDIAIEDMPITPYVGVGVGAAYISTPLKDAVNGQKSKFGFAGQVKASVSYDVTPEVKLYAGARYFGSYGANFDKSGGEKDKGGHTVLYSTVGAEA

SEQ ID NO: 18456 - protein, 191 aa, Wolbachia endosymbiont
SYYVRLQYNGEFLPLFTKVDGITNATGKEKDSPLKASFIAGGGAFGYKMDDIRVDVEGLYSWLNKDADVVGDTVADNLTAISGLVNVYYDVAIEDMPITPYIGVGVGAAYISTPLKTPINDQKSKFGFAGQVKAGVSYDVTPEIKLYAGARYFGSYGANFDGKKTDPKDSTRQVTDAGAYKVLYSTVGAEA

SEQ ID NO: 18457 - protein, 163 aa, Wolbachia endosymbiont
SYYVRLQYNGEFLPLFTKVDGITYKKDKSDYSPLKPSFIAGGGAFGYKMDDIRVDVEGVYSYLNKNDVKDVTFDPANTIAESVTAISGLVNVYYDIAIEDMPITPYIGVGVGAAYISTPLEPAVNDQKSKFGFAGQVKAGVSYDVTPEVKLYAGARYFGSYGA

SEQ ID NO: 18458 - protein, 187 aa, Wolbachia endosymbiont
SYYVRLQYNGEVLPLFTKVDNMKIKKGTDDVDPFKASFIGGGAAFGYKMDDIRVDIEGLYSQLNKNVNNNEVLTPDTVADSLTAISGLVNVYYDIAIEDMPITPYVGVGVGAAYISTPLKDAVNGQKSKFGFAGQVKAGVSYDVTPEVKLYAGARYFGSYGANFDKSGGEKDKGGHTVLYSTVGAEA

SEQ ID NO: 18459 - protein, 163 aa, Wolbachia endosymbiont
SYYVRLQYNGEFLPLFTKVDGITYKKDKSDYSPLKPSFIAGGGAFGYKMDDIRVDVEGVYSYLNKNDVKDVTFDPANTIADSVTAFSGLVNVYYDIAIEDMPIIPYIGGGVGAAYISTPLKTAVNGQNSKFGFAGQVKAGVSYDVTPEVKLYAGARYFGSYGA

SEQ ID NO: 18460 - protein, 187 aa, Wolbachia endosymbiont
SYYVRLQYNGEVLPLFTKVDNMKIKKGTDDVDPFKASFIGGGAAFGYKMDDIRVDIEGLYSQLNKSVNNDEVLTSDTVAGSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEA

SEQ ID NO: 18461 - protein, 187 aa, Wolbachia endosymbiont
SYYVRLQYNGEVLPLFTKVDNMKIKKGTDDVDPFKASFIGGGAAFGYKMDDIRVDIEGLYSQLNKNVNNNEVLTPDTVADSLTAISGLVNVYYDIAIEDMPITPYVGVGVGAAYISTPLKDAVNGQKSKFGFAGQVKAGVSYDITPEVKLYAGARYFGSYGANFDKSGGEKDKGGHTVLYSTVGAEA

SEQ ID NO: 18462 - protein, 187 aa, Wolbachia endosymbiont
SYYVRLQYNGEVLPLFTKVDNMKIKKGTDDVDPFKASFIGGGAAFGYKMDDIRVDIEGLYSQLNKNVNNDEVLTPDTVAGSLTAISGLVSVYYDIAIEDMPITPYVGVGVGAAYISTPLKDAVNDQKSKFGFAGQVKAGVSYDVTPEVKLYAGARYFGSYGANFDKSGGEKDKGGHAVLYSTVGAEA

SEQ ID NO: 18463 - protein, 187 aa, Wolbachia endosymbiont
SYYVRLQYNGEVLPLFTKVDNMKIKKGTDDVDPFKASFIGGGAAFGYKMDDIRVDIEGLYSQLNKNVNNNEVLIPDTVADSLTAISGLVNVYYDIAIEDMPITPYVGVGVGAAYISTPLKDAVNGQKSKFGFAGQVKAGVSYDVTPEVKLYAGARYFGSYGANFDKSGGEKDKGGHTVLYSTVGAEA

SEQ ID NO: 18464 - protein, 186 aa, Wolbachia endosymbiont
SYYVRLQYNGEVLPLFTKVDNMKIKKGTDDVDPFKASFIGGGAAFGYKMDDIRVDIEGLYSQLNKNVNNNEVLTPDTVADSLTAISGLVNVYYDIAIEDMPITPYVGVGVGAAYISTPLKDAVNGQKSKFGFAGQVKAGVSYDVTPEVKLYAGARYFGSYGANFDKSGGEKDKGGHTVLYSTVGAE

SEQ ID NO: 18465 - protein, 180 aa, Wolbachia endosymbiont
SYYVRLQYNGEVLPLFTKVDNMKIKKGTDDVDPSKASFIGGGAAFGYKMDDIRVDIEGLYSQLNKNVNNNEVLTPDTVADSLTAISGLVNVYYDIAIEDMPITPYVGVGVGAAYISTPLKDAVNGQKSKFGFAGQVKAGVSYDVTPEVKLYAGARYFGSYGANFDKSGGEKDKGGHTVLY

SEQ ID NO: 18466 - protein, 187 aa, Wolbachia endosymbiont
SYYVRLQYNGEVLPLFTKVDNMKIKKGTDDVDPFKASFIGGGAAFGYKMDDIRVDIEGLYSQLNKNVNNNEVLTPDTVADSLTAISGLVNVYYDIAIEDMPITPYVGVGVGVAYISTPLKDAVNGQKSKFGFAGQVKAGVSYDVTPEVKLYAGARYFGSYGANFDKSGGEKDKGGHTVLYSTVGAEA

SEQ ID NO: 18467 - protein, 163 aa, Wolbachia endosymbiont
SYYVRLQYNGEVLPLFTKVDGITYKKDKSDYSPLKPSFIAGGGAFGYKMDDIRVDVEGVYSYLNKNDVKDVTFDPANAIADSVTAISGLVNVYYDIAIEDMPITPYIGVGVGAAYISTPLEPAVNDQKSKFGFAGQVKAGVSYDVTPEVKLYAGARYFGSYGA

SEQ ID NO: 18468 - protein, 195 aa, Wolbachia endosymbiont
SYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGATYISTPLEPAVNDQKSKFGFAGQVKAGVSYDVTPEVKLYAGARYFGSYGANFDGKKTDPKDSTRQVTDAGAYKVLYSTVGAE

SEQ ID NO: 18469 - protein, 188 aa, Wolbachia endosymbiont
SYYVRLQYNGEFLPLFTKVDGITNATGKEKDSPLKASFIAGGGAFGYKMDDIRVDVEGLYSWLNKDADVVGDTVADNLTAISGLVNVYYDVAIEDMPITPYIGVGVGAAYISTPLKTPINDQKSKFGFAGQVKAGVSYDVTPEIKLYAGARYFGSYGANFDGKKTDPKDSTKQVTDAGAYKVLYSTVG

SEQ ID NO: 18470 - protein, 191 aa, Wolbachia endosymbiont
SYYVRLQYNGEFLPLFTKVDGITNATGKEKDSPLKASFIAGGGAFGYKMDDIRVDVEGLYSWLNKDADVVGDTVADNLTAISGLVNVYYDVAIEDMPITPYIGVGVGAAYISTPLKTPINDQKSKFGFAGQVKAGVSYDVTPEIKLYAGARYFGSYGANFDGKKTDPKDLTKQVTDAGAYKVLYSTVGAEA

SEQ ID NO: 18471 - protein, 428 aa, Neisseria gonorrhoeae
MPILRPLASAGKRACWLLMGLCLGLPALANEAPVSFNGTSISLEQALERALRSNPELAAVGRETEIASGARQQAGLIPNPDLSWSVEDTRQGNRQTSVSIAQPLELGGKRGARVEVAKRGSEIAWTQLEVRRAELRAQVRGAYYAALTAQERVRLAKTSLDLARRALQAADRRVKAGSISSVERVRAQVLADNAQLDLSQAELEQQRTYVQLSSTWDEPQPGFARVGGALDAVPASITRGALLRHLDESPTLRLAAQEVARGEAQVDLEKRQRIPNLTVSIGSKYDQTARDGRGERVNLIGLSMPLPLFDRNQGNIYAAQSRADQARDLQRATLLRLRSEAVQAYDQLRTSEQELALVRRDLLPGAQSALDSMTRGFEMGKFNFLDVLDAQRTLVGVRAQYVRALDAAAQARVSMERLLGEDIGHLGQ

SEQ ID NO: 18472 - protein, 1450 aa, Neisseria gonorrhoeae
MKTTDKRTTETHRKAPKTGRIRFSPAYLAICLSFGIFPQAWAGHTYFGINYQYYRDFAENKGKFAVGAKDIEVYNKKGELVGKSMTKAPMIDFSVVSRNGVAALVGDQYIVSVAHNGGYNNVDFGAEGSNPDQHRFTYKIVKRNNYKAGTNGHPYGGDYHMPRLHKFVTDAEPVEMTSYMDGRKYIDQNNYPDRVRIGAGRQYWRSDEDEPNNRESSYHIASAYSWLVGGNTFAQNGSGGGTVNLGSEKIKHSPYGFLPTGGSFGDSGSPMFIYDAQKQKWLINGVLQTGNPYIGKSNGFQLVRKDWFYDEIFAGDTHSVFYEPRQNGKYSFHDNNNGTGKIDAKHEHNSLPNRLKTRTVQLFNVSLSETAQEPVYHAAGGVNSYRPRLNNGENISFIDEGKGELILTSNINQGAGGLYFQGDFTVSPENNETWQGAGVHISEDSTVTWKVNGVANDRLSKIGKGTLHVQAKGENQGSISVGDGKVILDQQADENNKKQAFSEIGLVSGRGTVQLNADNQFNPDKLYFGFRGGRLDLNGHSLSFHRIQNTDEGAMIVNHNQDKESTVTITGNKDIATTGNNNSLDSKKEIAYNGWFGEKDTTKTNGRLNLVYQPAAEDRTLLLSGGTNLNGNITQTNGKLFFSGRPTPHAYNHLNDHWSQKEGIPRGEIVWDNDWINRTFKAENFQIKGGQAVVSRNVAKVKGDWHLSNHAQAVFGVAPHQSHTICTRSDWTGLTNCVEKTITDDKVIASLTNTDISGNVSLADHAHLNLTGLATLNGNLSANGDTRYTVSHNATQNGDLSLVGNAQATFNQATLNGNTSASGNASFNLSDHAVQNGSLTLSGNAKANVSHSALNGNVSLADKAVFHFESSRFTGQISGSKDTALHLKDSEWTLPSGTELGNLNLDNATITLNSAYRHDAAGAQTGSATDAPRRRSRRSLLSVTPPASAESHFNTLTVNGKLNGQGTFRFMSELFGYRSDKLKLAESSEGTYTLAVNNTGNEPASLEQLTVVEGKDNKPLSENLNFTLQNEHVDAGAWRYQLIRKDGEFRLHNPVKEQELSDKLGKAEAKKQAEKDNAQSLDALIAAGRDAVEKTESVAEPARQAGGENVGIMQAEEEKKRVQADKDTALAKQREAETRPATTAFPRARRARRDLPQPQPQPQRDLISRYTNSGLSEFSATLNSVFAVQDELDRVFAEDRRNAVWTSGIRDTKHYRSQDFRAYRQQTDLRQIGMQKNLGSGRVGILFSHNRTENTFDDGIGNSARLAHGAVFGQYGIDRFDIGISAGAGFSSGNLSDGIGGKIRRRVLHYGIQARYRAGFGGFGIEPHIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 18473 - protein, 713 aa, Neisseria gonorrhoeae
MNAPFFRLSLLSLTLAAGFAHAAENNANVALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFAGNNGASYGASVFGKEGNFDGLFSYNRNDEKDYEAGKGFRNDNGGKTVPYSALDKRSYLAKIGTTFGDGDHRIVLSHMKDQHRGIRTVREEFAVSEKNSRITIKRQAPSYRETTQSNTNLAYTGKDLGFVEKLDANAYVLEKKRYSADDKDNGYAGNVKGPNHTRIATRSMNFNFDSRLAEQTLLKYGINYRHQEIKPQAFLNSEFEIKDKEKATNEEKKKNRENEKIAKAYRLTNPTKTDTGAYIEAIHEIDGFTLTGGLRYDRFKVKTHDGKTVSSSSLNPSFGVIWQPREHWSFSASHNYAGRSPRLYDALQTHGKRGIISIADGTKAERARNTEIGFNYNDGTFAANGSYFRQTIKDALANPQNRHDSVAVREAVNAGYIKNHGYELGASYRTGGLTAKVGVSHSKPRFYDTHKDKLLSANPEFGAQVGRTWTASLAYRFKNPNLEIGWRGRYVQKAVGSILAAGQKDRDGKLENVVRQGFGVNDVFANWKPLGKDTLNVNLSVNNVFDKFYYPHSQRWTNTLPGVGRDVRLGVNYKF

SEQ ID NO: 18474 - protein, 348 aa, Neisseria gonorrhoeae
MKKSLIALTLAALPVAAMADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQVYSIPSLFVEKLQVHRLVGGYDNNALYVSVAAQQQDAKLYGAMSGNSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 18475 - protein, 265 aa, Neisseria gonorrhoeae
MNPARKKPSLLFSSLLFSSLLFSSAAQAASEGNGRGPYVQADLAYAAERITHDYPEPTAPGKNKISTVSDYFRNIRTHSIHPRVSVGYDFGGWRIAADYARYRKWNDNKYSVDIKELENKNQNKRDLKTENQENGSFHAVSSLGLSAVYDFKLNDKFKPYIGARVAYGHVRHSIDSTKKITGTLTAYPSDADAAVTVYPDGHPQKNTYQKSNSSRRLGFGAMAGVGIDVAPGLTLDAGYRYHNWGRLENTRFKTHEASLGMRYRF

SEQ ID NO: 18476 - protein, 912 aa, Neisseria gonorrhoeae
MQQQHLFRFNILCLSLMTALPAYAENVQAGQAQEKQLDTIQVKAKKQKTRRDNEVTGLGKLVKTADTLSKEQVLDIRDLTRYDPGIAVVEQGRGASSGYSIRGMDKNRVALTVDGLAQIQSYTAQAALGGTRTAGSSGAINEIEYENVKAVEISKGSNSVEQGSGALAGSVAFQTKTADDVIGEGRQWGIQSKTAYSGKNRGLTQSIALAGRIGGAEALLIRTGRHAGEIRAHEAAGRGVQSFNRLAPVDDGSKYAYFIVEEECKNEGYEKCKAKKDVDGKDERQTVSTRDYTGPNRFLADPLSYESRSWLFRPGFRFENKRHYIGGILERTQQTFDTRDMTVPAFLTKAVFDENKKYGSIRGHGKYAGDHRYGGLITKGENGAQVGAEYGTGVFYDETHTKSRYGLEYVYTNADKDTWADYARLSYDRQGIGLDNHFQQTHCSADGSDKYCRPSADKPSSYYKSDRVIYGESHRLLQAAFKKSFDTAKIRHNLSVNLGYDRFGSDLRHQDYYYQHANRAYSPKTPPQNGDKKTILNGGKDKPYWVSIGGGNVVTGQICLFGNNTYTDCTPRSINGKSYYAAVRDNVRLGRWADVGAGLRYDYRSTHSDDGSVSTGTHRTLSWNAGIVLKPADWLDLTYRTSTGFRLPSFAEMYGWRSGDKIKAVKIDPEKSFNKEAGIVFKGDFGNLEASWFNNAYRDLIVRGYEVQIKDGKEGVKGDPAYLNAQSARITGINILGKIDWNGVWDKLPEGWYSTFAYNRVRVRDIKKRADRTDIQSHLFDAIQPSRYVVGSGYDQPEGKWGVNGMLTYSKAKEITELLGSRALLNGNSRNTKATARRTRPWYIVDVSGYYTVKKHFTLRAGVYNLLNHRYVTWENVRQTAAGAVNQHKNVGVYNRYAAPGRNYTFSLEMKF

SEQ ID NO: 18477 - protein, 344 aa, Neisseria gonorrhoeae
MRRDVRGRWSKALAALSLCISAGAVHAQSSVSLYGLADAFAGVVRTPGSAGNAWQVGSGGLSTSYWGMSGAEDLGGGMKAIFTLESFYRINGGQSGAYDGQSFFGRRAFVGLSGQFGQVTLGRNDSLLFVSTLLFNPFGNSFVFSPMVAHTFLGSAMGAASVQSDTAIDDSIVYQTPEVGGLTGSVLYSNAGIAGHAGQANYSANVLYFAGPFSATAAIQSLHTASLFLNGATEQTAWLAGAAYRLQAVKLYLQYERVTNNNDLTDDTVQVGASAQVGTGSILLSWAGTLRRPAQGADVRWSTVVLGYDYPLSKRTDVYAAWRYDTMTSVSSGNSLGAGIRMKF

SEQ ID NO: 18478 - protein, 922 aa, Neisseria gonorrhoeae
MRSSFRLKPICFYLMGVMLYHHSYAEDAGRAGSEAQIQVLEDVHVKAKRVPKDKKVFTDARAVSTRQDIFKSSENLDNIVRSIPGAFTQQDKSSGIVSLNIRGDSGFGRVNTMVDGITQTFYSTSTDAGRAGGSSQFGASVDSNFIAGLDVVKGSFSGSAGINSLAGSANLRTLGVDDVVQGNNTYGLLLKGLTGTNSTKGNAMAAIGARKWLESGASVGVLYGHSRRSVAQNYRVGGGGQHIGNFGAEYLERRKQRYFEQEGGLKFNSNSGKWERDFQKSYWKTKWYQKYDAPQELQKYIEGHDKSWRENLAPQYDITPIDPSSLKQQSAGNLFKLEYDGVFNKYTAQFRDLNTKIGSRKIINRNYQFNYGLSLNPYTNLNLTAAYNSGRQKYPKGSKFTGWGLLKDFETYNNAKILDLNNTSTFRLPRETELQTTLGFNYFHNEYGKNRFPEELGLFFDGPDQDNGLYSYLGRFKGDKGLLPQKSTIVQPAGSQYFNTFYFDAALKKDIYRLNYSTNTVGYRFGGEYTGYYGSDDEFKRAFGENSPTYKKHCNQSCGIYEPVLKKYGKKRANNHSVSISADFGDYFMPFASYSRTHRMPNIQEMYFSQIGDSGVHTALKPERANTWQFGFNTYKKGLLKQDDILGLKLVGYRSRIDNYIHNVYGKWWDLNGNIPSWVSSTGLAYTIQHRNFKDKVHKHGFELELNYDYGRFFTNLSYAYQKSTQPTNFSDASESPNNASKEDQLKQGYGLSRVSALPRDYGRLEVGTRWLGNKLTLGGAMRYFGKSIRATAEERYIDGTNGGNTSNFRQLGKRSIKQTETLARQPLIFDFYAAYEPKKNLIFRAEVKNLFDRRYIDPLDAGNDAATQRYYSSFDPKDKDEEVTCNDDNTLCNGKYGGTSKSVLTNFARGRTFLITMSYKF

SEQ ID NO: 18479 - protein, 113 aa, Neisseria gonorrhoeae
MNQDKVKMLYVRADYTIPLRNGLDIELSSDFSWQDEVQFTLDQNPDTKQGAYGIWNASIALADYNDGWRVAFLGKNLNDKSYAQSLASGGNYIYRFVPRDDERYFGVQLRKEL

SEQ ID NO: 18480 - protein, 1142 aa, Neisseria gonorrhoeae
MMSGFSPKPKTIILSLAGAFGALAFADTPNNTEQQKELNTIVVHGKRSADQKGADDVYYKNVSNAYVGKEYLERYRVQSAGDVLKGLNGVYNMNTRTAGGAITPNIRGITGKGRIPVTIDGTEQTIDVWMNNYGVGDRNYLDPALFRSIAVEKSPALTRGVKSGVGGAMSIRTIEAGDIVPEGQKFGFQLKTEFANNRTRPANNLNQWLGWEDYRTLPLGATADGAGGGSDPITGQQSPQALVVDNFTPPQHKSGRDNWRFGGDRSYMAAAAFKTELSDGLAAYSYRNKGNYFAGRKGAEGYLNNPVYDLQKCYDEGGSDFNCKNSATFIPNMARIYHPGVEVLNSNTETKTLLLKNNWHLPGSHRLGWQYMRTDVRFGEINPFHTTYVMNMEEHNETNRPKELSPQAQSIDSTIRTDTYKLGWAWKPENSRWVDLQANLWRIKTNSTRHQSGGMDLSSARPDPFYDVWYWCTQRGRIPPEHVDNYSSCNDLMNDFGVNGLTKEQVLAMTPNDNGQFRVISGAEQKTRVSRTGFDISNRFRLRDRLSMTLAADYQKEKLAEEVEIVNSQDLFNLAGMVTGLTKLAGPRGGERREWGTNLVFDWQAADRLKISAGIRYHNFRGFDTALAEGRARRDPRYQAGDGTQHYADGAYLPYFELAGDQERRDWNVVAEQLRQAYQSGDAAAIAAAVQAEQAHGARYHLLKYYDGSYRTDGYVYIGNDGRAYFDGRFGGVNEAQNQPLYRVRPVYVPFVNGKLDSGALPQHFHDFVSNYQEKVTNPQGLHGTHYRYWAGVGNPIDCIRSDAASCLAHNLSGKVTNFQVGYPEYGDDTGLGLKIIGRHYTEEQYWAQPKPIRAHAWAPTIAVSYDLTDNSRLFVRYAQMSRFPSVYEVGSFYNDVAYAGMPKAPNFRFKPERSRSWEIGYSFNFAPYWSRLRAGDMRLTYYRNRIQNVIETTDYFRTVQYDRKDTAGLEWQSRIDTGRFFAALGATYRLKQQMCDRDTAFDYDPYGAKGVPICIEGGYGSTRGYQALQPKYSINLDAGVRLLGEKLELGLRGIYHSRVNTKQYDQLLQKDLGIIFDTTGKPHHWRSSLTWDVYGRYRLHKNLNVNLGITNLTNRYYLDPMSNVAAPGPGRTVTFGLTAKF

SEQ ID NO: 18481 - protein, 1532 aa, Neisseria gonorrhoeae
MKAKRFKINAISLSIFLAYALTPYSEAALVRDDVDYQIFRDFAENKGKFFVGATDLSVKNKRGQNIGNALSNVPMIDFSVADVNKRIATVVDPQYAVSVKHAKAEVHTFYYGQYNGHNDVADKENEYRVVEQNNYEPHKAWGASNLGRLEDYNMARFNKFVTEVAPIAPTDAGGGLDTYKDKNRFSSFVRIGAGRQLVYEKGVYHQEGNEKGYDLRDLSQAYRYAIAGTPYKDINIDQTMNTEGLIGFGNHNKQYSAEELKQALSQDALTNYGVLGDSGSPLFAFDKQKNQWVFLGTYDYWAGYGKKSWQEWNIYKKEFADKIKQHDNAGTVKGNGEHHWKTTGTNSHIGSTAVRLANNEGDANNGQNVTFEDNGTLVLNQNINQGAGGLFFKGDYTVKGANNDITWLGAGIDVADGKKVVWQVKNPNGDRLAKIGKGTLEINGTGVNQGQLKVGDGTVILNQKADADKKVQAFSQVGIVSGRGTLVLNSSNQINPDNLYFGFRGGRLDANGNDLTFEHIRNVDEGARIVNHNTDHASTITLTGKSLITNPNSLSVHSIQNDYDEDDYSYYYRPRRPIPQGKDLYYKNYRYYALKSGGRLNAPMPENGVAENNDWIFMGYTQEEARKNAMNHKNNRRIGDFGGFFDEENGKGHNGALNLNFNGKSAQKRFLLTGGANLNGKISVTQGNVLLSGRPTPHARDFVNKSSARKDAHFSKNNEVVFEDDWINRTFKAAEIAVNQSASFSSGRNVSDITANITATDNAKVNLGYKNGDEVCVRSDYTGYVTCNTGNLSDKALNSFDATRINGNVNLNQNAALVLGKAALWGKIQGQGNSRVSLNQHSKWHLTGDSQVHNLSLADSHIHLNNASDAQSANKYHTIKINHLSGNGHFHYLTDLAKNLGDKVLVKESASGHYQLHVQNKTGEPNQEGLDLFDASSVQDRSRLFVSLANHYVDLGALRYTIKTENGITRLYNPYAGNGRPVKPAPSPAANTASQAQKATQTDGAQIAKPQNIVVAPPSPQANQAEEALRQQAKAEQVKRQQAAEAEKVARQKDEEAKRKAAEIARQQEEARKAAELAAKQKAEAERKARELARQKAEEASHQANAKPKRRRRRAILPRPPAPVFSLDDYDAKDNSESSIGNLARVIPRMGRELINDYEEIPLEELEDEAEEERRQATQFHSKSRNRRAISSEPSSDEDASESVSTSDKHPQDNTELHEKVETAGLQPRAAQPRTQAAAQADAVSTNTNSALSDAMASTQSILLDTGAYLTRHIAQKSRADAEKNSVWMSNTGYGRDYASAQYRRFSSKRTQTQIGIDRSLSENMQIGGVLTYSDSQHTFDQAGGKNTFVQANLYGKYYLNDAWYVAGDIGAGSLRSRLQTQQKANFNRTSIQTGLTLGNTLKINQFEIVPSAGIRYSRLSSADYKLGDDSVKVSSMAVKTLTAGLDFAYRFKVGNLTVKPLLSAAYFANYGKGGVNVGGKSFAYKADNQQQYSAGVALLYRNVTLNVNGSITKGKQLEKQKSGQIKIQIRF

SEQ ID NO: 18482 - protein, 175 aa, Neisseria gonorrhoeae
MKKALAALIALALPAAALAEGASGFYVQADAAHAKASSSLGSAKGFSPRISAGYRINDLRFAVDYTRYKNYKQAPSTDFKLYSIGASVIYDFDTQSPVKPYFGARLSLNRASAHLGGSDSFSKTSAGLGVLAGVSYAVTPNVDLDAGYRYNYIGKVNTVKNVRSGELSAGVRVKF

SEQ ID NO: 18483 - protein, 758 aa, Neisseria gonorrhoeae
MNPAPTRAPRSFLCLSPYARELPPWPCRVALVVLGALSVVPAHAQQTLPAVEVSAQAETPPAVLFQLGTATPATEYVISPAGIERFGGKGGTNPYSMIAELPGVQMYSIDAYGLVNQQGGNKGLRVRGETASHGANGTVDGVPLNGPGPGPGYLFLLDAENIESVSLAQGPIPPDRFSLYDAVGQLDTRILWPRAQRGGVVSLGVGENRYRRLFARVDSGELASGTAFFVSGSTTAAEKWRGSGDSPERRETFAAGLSQQLGALDFKLLLAHNEMAADNYKSLSYAQSKDESLFDDIDYAAAKGGATAAARADWQGYNRQSFKTTAVLAELAYRLGDDTRIVAKPFYSEEEGTYWYANGNFVRKWLIDHSTYGITTELQAQAADTALRFGYGFVSMAPPGPPTLWKQYTPTAAGTLNFANWAMLADVTRRHDLHNVFAVADRDFGALHVKAGLRYVKDILPSIDYYNTTGVGDVSPGAARDQSSGIVAARSVKSAAIEEWAPYLGLRYTVSPALELKASIGRNLGTPAFDAFQSAPVAGLSKQEIWDNNELEIADTVDLGATVRFGSAYLAPVLYYTRYDNKGVNIYDPALNAAYNQNVGKARQYGLLLAGGWEVQRGFNLFGSASWMRSEFTEDLRTAAATIRGTDGKQLPDVPRLAASLGAAWTWGRFTLSPVVHYMGKRYANVEHTQTMNAYTVTNVDLSWRDTTPWGAVKATLAVINLFDARYIAYNNANETSDGSSFYPGAPRTLMGKLSFEF

SEQ ID NO: 18484 - protein, 586 aa, Neisseria gonorrhoeae
MTREDIDHWQSNTVIDVLRRLPGVDVAQNGGIGQQSSLFIRGTESRHVLVLIDGVRLNQAGISGSSDMSQIPISLVQRIEYIRGARSAVYGSDAVGGVINIITRRDNDGTTLNAGIGSYGYQNYNGSTQQKIGENTTVTGAAAYTYTKGFDVEARGSTGNYPNGYPQSDKDGFLNKTLWLGIEHQFSPNVSAYARGYGYDNRTDYDGSYDTDYTNMQHYLVDTRKFSSRTYETGLKYHQGNYSTSLLGSYSHSKDYNYDPRYGQYGLYSNLDESKQYNLQWGNNYQFGKGSLSTGVDYQRQSVEPGGYTNTSKKETVNNTGIYLTGQYALIDSVIAEAAIRSDHHSEFDWHTTWQSGLSWEFYDGYKLVGSYATAYKAPNLNQLYVDNPSWKMKGNPDLKPEESQQWEIGLEGTTGPLFWQLNAYHNDIDNLIAYKSGAQFNSYENIGKAEIKGVEWVGEFDTWMFHHQFTYQYIDPRNKDTNKVLERRAQQQVKYQLDWNIEKLDMGLTYQYIGSRHDTAYYENGKSESLKLGGVSLWDITAAYPITSHLTIRGKIANMFDKDYETAYGYRTAGREYFLTGSYNF

SEQ ID NO: 18485 - protein, 476 aa, Ehrlichia ruminantium
MLFFSMLQYVWVAVRPLVWVRLQARRHAMLVALVGLLAVFTQGARAEDVPATDALPIAGGELDDRFGFHGQTTWVWQRKSAFNAPYSGDNSLSPERAKSYSFSATLDLGMRLWKGAEVHLNPEVAMGDAFSDLHGLGGPTNGELAKVTGSDPTLYRARAFLRQTWGLGGETEKIDADFNQFADVVDKRRIVLTAGNMPVLDIFDAVEYAHDPRTQFLNWSFMTHPSFDYPADARGYDWGVALEYIDSENGWAARAGRFLLPIESNGLALDTRLLMHYGDMLELEKRYTLFGQEGKVRLLGWRNRARMGSFQDAIALGQATGTAPDVGQVRKEHAKVGVGLSFEQKLGENLGLFTRLSWSDDKTETYAFTEAGRNVSFGGLLKGTAWGRPNDVLGAAFSLNMLGPDHRAYLAAGGSGAFLGDGALNYAHERVLELFYSMQLVKGVTLSPDIQLIQNPGYNRDRGPAKFVGLRVHAEF

SEQ ID NO: 18486 - protein, 939 aa, Ehrlichia ruminantium
MVKKYAVFLILWSFNLAFAQQEITVTGIVIDARTQNPLENVVVTIQNTAVMQLTSKKGKFELHVFPTKEKLLLLRSQGYKDLLLKLQYNSGENINLGILQLEDTYTDEVPAALITLSDNDFSDDNSSSEMTSGLLQSSRDAFMQASAFNWGQARFRMRGLDSENGTMMLNGMTMNKIYDGRPQWNNWGGLNNVLRNQEFSVGNAASNYTFGGVLGTQQIFTQASLYRKGTQLTFSGSNASYTLRAIGTYASGMSTSGWAYVVSAGKRWADEGYFEGTNFDADSFFMTVEKKLNSKHSINFTGFYTPNSRGKNSPNTNEVTALMGEKYNSYWGFQNGKRRNARVKKVEEPLFMLNHYFKIDEKTKLNSGVMYQFGKVGNSNIDYQNADSPDPVYYRKMPSYFSSLYGKDKGEFSGDFTPDYENADKSRTTFLANSQIDWNAMYLANQKSGQNGYEPSQSHYVLYEDRTDDKTFAVNSNLNTQLTPNISFDGGVMYRNLKSHNFQYLLDLLGGKYFEDIDPFYKGDLSQSDLQNPNRQVKEGDIYGYNYNFSANTIDVFTQFKFSYNKTEFYLAQSYSMSNYQREGLYQNGLYPTASLGKSEKVNFENFGFKGGFVYKVSGKQWLFFNAAHLTRAPSLRNTFANSRLNNNVVNGIESENVTSAEANYVYSSPKLKLRLTAYYTLIKNSSKTSFFYAEGIFDNGAGYDPTDAFVSQTLTKLDKKNTGAELSFEYQITSTLKSTLSAAYGNYIYNSNPNVSITNDANASKDGVQTTFDFGKAYLKNYKQSGTPQNALSLGLEYRDPKFWWIGTNINYLTDNYIDVSPISRTSQFYINPANGFPFPEASSERGNELLKQEKFDPVTLLNINGGKSWRVHKKYIGLFASVNNVLNAIYKTGGFEQARNANFRALNQDVSSGTPSFGPKYYYGYGRTYFLNLTIGL

SEQ ID NO: 18487 - protein, 297 aa, Ehrlichia ruminantium
MVKLEQDLYSNINIMGKFMNYKNTLLGIMLALSLLPTKSFSESISNNDNSQNFKLYISGQYKPGVPKFNNFSAKETNVKTQKLLGLLSGTSRKIDKYKDFSNTYIPDFQDSSTGFGAAVGYISYKGIRFEIESSYEEFQVNIHDNCEGTIEPCRYFALARSVGRRGWPDQNNYTVMKNTGLSMTSVMFNGCYNIMSNKLEISPYICIGIGGDFIDFFDSTHIKLAYQGKLGISYSLLPDVTLFVDGYYHRIANNQFKNLNVLQPVELKYEPKITSATATMNVTYFGGEVGIRFIFNS

SEQ ID NO: 18488 - protein, 736 aa, Gluconobacter oxydans
MGQIMHTTHYSSFPLRKTLLALAIGAASQTAMAADAAAAKQPGEETLIVEANETSDFKSGGDLVVPAFLDGQIAHGGRLGMLGEQKAMDVPFNVIGYTSKLIQDQQAKTIADVVSNDAGVQAVQGYGNFAETYRIRGFKLDGDDMTMGGLAGVVPRQVMDTQMLERVEIFKGANSLLNGAASSGVGGMINLEPKRAEDLPTARVGVDYTSDSQVGGTLDLGRRFGDNNQFGARVNLVHREGEGAIDNDKRRTTLASLGLDYRGDRFRSSLDFGYQKKTFHGGTMGVNISGVDFVPALPDNSKNYSQKWGYSDIESEFGMAKAEYDLTDSWTVYSALGGQHSHEIGTYSAPKLLNKNGDATVGRLDTNRIIDAISGMGGVRGDFNTGAISHKVNLGYAAQVHTDATAWRMSAKNPTTNIYDNRDVAMPDNAYFGGNYHDPLVTSRSRTQGWLLSDTLGFFNDKVLFTAAARHQKVVVRNYSNATGLEDTSSRYTQSRWMPTFGLVYKPWEQLSLYANHTEALQPGSVAPTTAANAGQSTGIAHSKQDEVGVKIDYGTIGGSLALFEIKKPNAISDTAGNYGLDGEQRNRGVEMNVFGEPMLGLRLNASTVWLDAKQTKTAKGATDGKDAIGVANFYAVLGAEYDIKPVEGLTATARVNHSGSQYADAANTKKLDSYTTLDLGLRYRMRLNADQNEMTWRVGVTNVTNEKYWSGIDDTGTYLFEGDPRTVRVSMSYDF

SEQ ID NO: 18489 - protein, 984 aa, Gluconobacter oxydans
MHRSQASLQWNATPAMPASPGDLMNCRSHRLALSISLSLALGAAVQPASAQQTDADSPRATSTLDAVSVTGSRIKRAQVEGAQPVVTISAQQIQQEGFATVYDVLNSMNQQGSVEADTQWGSHTPNASPINLRDLGPGRTLLLVNGRRVADYPLPYGGESNFSNYSNIPSAAVERIEILTGGASAIYGSDAVAGVVNVILKRDYQGDQVRLRGGTATEGGRDSFDVSWAGGRTGENWSLTYALQATRRDPLSGRDRAQMDDSDDMSYSNWTGQNRLYGFNPFTGLSLVDANTNERLAPPAGTCARFGGEFVDASRLSYNQNNGALTNAGDYCGMARDYADWGLVTGSEDYSAYLYGTWRFGEHTEAWATFSANRSIGRWTYNPPYAYLGPFQDADTGRSLYAIRQMTRREAGGWDRLANYNKEQSWDLSAGLRGVWADRFDWELSVGRSRYTVDEYVRTVDTARATDYFLGSPLGTAADGSAIYAVNTARWYAPLSSEQYDSLVVKSHNSAYSWVNQAAFSLSGDLFQGWAGPIRFATVAEVAKQGYQLSPDPCANACYPVDVVDSGGGERLRSSAGLELQIPLLSTLSANIAGRYDRYGNYRSSAVQTEVGTQSDTTWSAGLEWRPIDSLLFRSTLATSFRAPDMHYVLGEPSSTNQTVIDQYRCISSGAYLTGSCNDENSNIYYTVDVNRRGTPDLRSETGRSFTGGVVWDIAQGLSLSVDYYRIQLEEMIKDLDRDEILSAEAGCRTGTTVSGGAWNNPGGAGYCDTITSRVLRNADGTIASIERGPINLAQMETSGIDASLKYRLSTAGWGNFQLSLDYNTLIAYREQIYRTDSDENRRDERVRSRVRGSVHWDNGGAWDWTVYFRRLGSMRAVNWGTCARFDDGYQPSAADECLVTDTANVHLGETSKRYFGRVGPAIYWNLSTGYKITDHAKVNFYVNNVFNEVGYENKERFYGYGFYNTTLFNPIGREVAAEYVFTF

SEQ ID NO: 18490 - protein, 197 aa, Gluconobacter oxydans
MMFFKRTILACTVALLFPALPSYAEVGAENGNSAQAEKPGLWKRFTSNVAETWNNSPNKDLYVPAITWHNRLTYSQEKIDSYNERPWGGGYGISRYDSDGDWHGLYMMVFKDSFNKWEPIGGYAYEKIWRPLEDKDFRLGLGFTASITARDNWNYIPIPAPLPLASIGYKQLTFQATYIPGTYNNGNVFFGWFRWQF

SEQ ID NO: 18491 - protein, 324 aa, Gluconobacter oxydans
MKSAKGLLGAMTLVIAGAATAADDWYLGVTAGHYDLDGERAIVEDHNSVTAGVQVGKYVSDTLALELGYGANAGHDNFDVLSLNGLLWLNNSDATNWSPYVLFGLNQYDFQDASNLVLDHDDRSTQIMVGVGMGTRFDYGLEFRADLRGMAGHDEDGEDVGVQFSLNKVFGSKSAAPARVAAPVVSQAIAEPEVEVEQEPEQEVRTITVRLNVEFEFNKDTVLAVYGDQLDAIAAAMKAQDDIDLVLEGHTDSRGADQYNMSLSDRRAKAVKAKLVEDYGIPAARISAVGYGETQPIATNETDEGRARNRRVVGEMSFSEVYNF

SEQ ID NO: 18492 - protein, 660 aa, Gluconobacter oxydans
MPADPALAAATDLRDVGPLISTRYKYSLYASQIERYGGNLSLDWQGDTSALYARAIYGSYGVTGTQDQSSARLETYRNQPTAVRGGYFNTHDIDETLATVQLGGQTTLDRLHLDYGTSFGRGTRSRPDYVSASLYGFTPGSFAFDLSDPTYPSIGPSSPALKDFFYNLDSSLLWKVQGHDAGSHDNRFNAHTDIAYQVDGAVLDSVKLGLSADHSERDAYDHPFFHKDGNFVTNGPYFGGPNYAFPTAGGPPLSAIPGRITYNAFDGHYAGPFKLLDRGWMRAQALPYKYIDDPNGAGIYTANDYNANTTSSTEAIYSGYAMAALHLGKVSILPGVRYELTQYSADSWQSSGDGSTGSFVGSGSTYGKVLPGISVNYRPDDLTVYRASLRRSFSRPAFGLISGETVYSIDDTQKVVGISKPNPNLQASTADNADLSAEFYDHQGGVLSASTYYKRINGFIYTSQSATNNDSTLGGLVPTGTTFENGVPVTMPQNGGTAKLYGLELAASKRLQQLPGLWSNFGVTANLTLQHSQADSKRSDQPEKTWLPRAPERIYNLDLFYDDTHLRTDLSYNYTGLQLLGLTTDRLNYYLQPVKSLDFNATYHLPHHLDVGVSAKNLLNAATFYETQGKSKRYMAYDPGADGAYVQTGRTYMLTLGYTY

SEQ ID NO: 18493 - protein, 634 aa, Gluconobacter oxydans
MIVSMKKQFFLFVAVGLLATGVVRGDDVSEGKALKRYNSDELVVSATKTLNSISDAGGSSVTVITAEEIENSGQQSVEEVLKGNPGIDIASNGGPGTNTSIFLRGADSKYTLVLIDGVPANDPAEGSRSPNLSHLTTDNIERIEIVRGPASLLFGSGASAGLINIITKKGSSTPEAYAGIEGGSYSTYKYYAGANGRKGIFDYSFSASRLKSDGFSATDEENSCVNPAGESFEDDGYENTSLSGNIGLHLNEHVTFETVMRYTNANSQYDGPGVDVVGNEQDAEQLNGRVALTMDYEPLVSTMYYNFNRQDRDYLTDGALSSTYHGYLYELGWQGDLAVADNNTISAGLNYQHESMQNESFGMYASAIDQDISSNSIFIQDQWRSDGVQLIGGIRYEDNEQFGGETTFRFAPSWTVDHTVFKCSYGTAFRAPSLYQLYSPYGNEDLSAETSKGWDAGFEHSFSDDVKVGVTYFRIDYEDRIDFDMNTWTYAQVDGKTKTFGVESFAEWAASNDFFLTFNYTYTLTEDPDGSQLLRRPKNKVALSGTYDLSEKTKLSTSLRWVGSRKDSGAKDENCIVTNKLDSYFLVNLSGSCQLTDSIALYGRVDNLFDEDYEDAWRYATPGRSAYAGIKLIY

SEQ ID NO: 18494 - protein, 738 aa, Gluconobacter oxydans
MGPSCSDAGHEGVCVACLRREAMRGCAAGCIALSFGLAIAAARAEQALPQVTIDAPAEARPKPPRRHAPEATARHGQAIPAPTPGASSSAAAPSASATSDAMSAPQNQAASSRVITGAEINALPFMRPGEALEAAPGLVVTQHSGEGKANQYFLRGFNLDHGTDLAITIDGMPVNMPTHGHGQGYADVNFLIPELISTMTVRKGPYFADVGDFGSAGALGIEYLRAMPKNLAEVTVGSFGYRRLLGAGSTRVGDGTWLAAFEANTYNGPWDVPDNVRKLNGVLRYSQGTATDGFSLTGMAYSNRWSSTDQVAQRAIDQNLIGRYGSLDPTDGGTSSRYSLSGRFAKSSDLGQTDINAYVIRSSLQLYNNFTYFLDDPVNGDQFNQHDRRTVLGLNGTQRFDYRFAGLPVETRVGLQTRSDTINVGLNKTYQRDWLSTVRADDVSEQSLGLWTDTTVRWTDWLRTTAGVRQDFFTGRVISDTPANSGNASAAMTSPKAGIVLGPWVGTEFYGNAGTGLHSNDIRGATITVDPNSGDPVNRVPLLVRSKGAELGIRNKSIPGLTTSLAVFVLDFDSELLFVGDAGTTEPSRPSRRVGVEWTNQYRPLSWLGVDLDVAYTRARFTDIDPAGDFIPGAPAWVASAGITLGEQRGWFGALKGRYFGPRPLIEDDSVHSLSSLIFNARAGYRFDNGVRVQLDVLNLFNAKTNQIEYYYLSRLPGEPLGGVNDRHVIRWNRWQCG

SEQ ID NO: 18495 - protein, 628 aa, Gluconobacter oxydans
MPRNISHAIVNPTTLKTLTKSMLAISLSMAGLAHAELYSSVTFFGDSLTDGGYFSPITQGKLGIKESGQFTTNPDNVWATSFAEQLGTTAVPIVYLGNQAGNNYAIGGARAGKDIVNTDFGVNVPVASVNTQVNGYLANKKVDSNGMYVVWGGANDLLAAAANPANAINTISSAAGSQVAAIKALKDNGANYILVPNIPDIGLTPTAIAAGAGFQSSGTMLANLYNQTMYSGAVATGANIIPLDTFSLLQQVAANPKAYGFTNMTQKACNTSSSLLCGSSNLVVPDANESYFFADGIHPSGRAHQMIADYASAVVTAPSLIGVLPHIATTAGLATSERLQSHINQIQSSEQKPARKLWATGDFENQDIAGFEGDSNTQVLLGVDFAHPNSAHAVTGLYGNITQKDFENSGVRTGLSNIDLEEVGFGVYHSNTLDKLGGVQLNGAVGFGNLDVDVTRAVTLGGNKQEFNSNADGKRYYANLQAGYPMQLSSLAITPYIGATASRVRLDALKEQEMSGIAMQFDEQKYTTTYGKLGVKANHNLADSLNVFGDVHYQKQLSDNREAASARLNTIANISFDTPMVQTDDDNFGMTLGVSKSFGQLNANAGVTHSQGDDDKSTSLFVGLSSTY

SEQ ID NO: 18496 - protein, 498 aa, Gluconobacter oxydans
MAVLAAQWTLNKLSHFAIAGIRPPLISESLGEAEPMALSSRFSLALLALSLSWLPAPVGAEPADQPKPAKQPKVMETPRGLLEAATFGEMLGLPDWMAMSLSLVNQPMGNITGSKQRTFRSIDMQAIDWSLGSGLSKEDSDKDEFDRWSFRSSLATYIGVPPYFSEDIGAAFPLQALEDTEGLQQGFWLQGLWLQRDSENLSLKFGNNLSLDPLVESPVYNAYVNSTINSTLNLSLPGYPTVPFSSLGASLQWRANDRLTVNYGGYQLSNQRTGFPAGRWKGWRFNLDRDDGLVQALRLDWALSETSGEPLLICMSQEHPDVVVRHHQGCKRPMRLENKLPDPVLQLGAVSGSWRFPQINNPSRWENRANSIFASATLPVPFALGHGSRLWGSAVIGTEPAINPVPLFLEGGWITQGVIRQRPFDSVVLGLTRSSFSPSLGRASGQRMTYEGMIELGYILQLSQELALQPGVQVIVNPEGTGDNETLVVPGLQVSFNW

SEQ ID NO: 18497 - protein, 831 aa, Gluconobacter oxydans
MRASLPLVLVASAFALIPRPVSALSSDRTWLAAPISNNWNDGNNWQPNTPPDSPFAGAVFGQSNILNPAFTAFSFVGSNTKGTSIYFQPNASAYTIEINGQTVTLFAGIRNDSQFTQVISNGVANGSLTFSGGSIVGNVTIVNGGAGTRTTFTNAFNGGTVRLINASTTSTLDFSGVFSPGTTVGSIEGFGTIILGSNELRIGTNNLNTVFAGSITDGSGTGGSLVKVGFGSLTLSGVNTYTGNTTVLGGALFVNGSIASPQTFVEPGALLGGSGLIGGNVFSHGVVSPGNSPGKLTLAGNYTQYSDGTLRIEIGGNQAGQFDQLAVGGRASLDGTLEILSNGRGKLKRGDRLSIVTATAGVSGTFRDIENRFDNGTILTVGIAYEPNAVIAMIKQGSFAKFAESTGLSSNQISVARALDSAANTSRANRLFDYLDSRNRRNLSGDFDRIAPEELTSAFAIGMALANVQSANIQRRTDDIRSGSGGFSAAGLAINGMGPSYSGGFDAGVAGPNGDDGKDVKETRQVVPAENRWGAFLSGTGEWVSVGNTDNARGYHLDSGGFTLGVDYKVTPNFAIGLAAGYTGTTADLSDRGRLWVNGGKLGLYATLFQNVEPAAAPKMSKDSSKDSKEVRPPATGLGRSFYADVAVFGGYNSYDSRRSALQGDARGDTDGGELNVLFGTGYDFKKGHFTFGPTASFNYTYLGTSAFTEHGSLAPLDIHGGKGESLRTAFGLKASYDWKVGGVLIKPEIRAAWQHEYGDSAYDLTSSFANSAGESFLVAGPQLGRDSALLGAGVAIQCSERCSTFFYYDGELGRRNFQATNVTGGFRLAF

SEQ ID NO: 18498 - protein, 366 aa, Gluconobacter oxydans
MGTFFASSSSLALAQSSVTIFGVVDVGVTIAKSGSNRLNALNSSQGKTSLLGLRGTEDLGGGNRAQLWLEGGLNPDVGTGGSSGSLGFERRSTIGLSNNSWGEIRLGRDYTPSYNIFTAFAGPDTTTGVQANLFQTIRQTAYNAASQSGVVDRTRISNAVGYFLPSDLGGIYGQFSVSFGDENASGSGASKARRYIGGNLGYRSGPLNVGIGYGRIDGTAAVASPSAIAATSDLEDLVLGASYNFGSFLLNGGYNSLKWEPVNGATSGKVDGFYLGATIPMGPGSLRVKYASAKFSGNASALTRSGGKADKYSIGYVYEFSKRTSLYAGLARVNNKNGASVGLIGGPAGVANAGSTGVDLGISHSF

SEQ ID NO: 18499 - protein, 906 aa, Gluconobacter oxydans
MAHRLDRRLCAVAAACPDRRTDAGQRPCLARRRNPHLWHVFHFRCRRGCTRRPARRGALSALPRTRRCGDPAVPPVRGAGRAAHAGAALSVGFEALAVRASGAQALSTPRASTPGLSFAAPAARPRHPFLPRHRCRPAPARRHGRASSGHAQIPGFLPMNAHSLLRFRDQLRHSSAMTSPALIALFGGLMMASASAQSAGKPVSNSLPTVVVTASQPDWGANEGAGENLFLPLDTSTITSIMARTAALSTSDSGALLTGVPGGAAWGAGGVSSLPAINGMGADRVQIDINGMTYGVACPNEMNPPLSFVNPAMISNMTVFTATSPVSVGGDYTGAKVKVEVAQPKFTPGQQITTSGSVSGYYRSNGNGYGTDVTATMSNEDTNVTYTGGWARASDYTSGNGTTIKSTMYETQNHAVSISKRDASNLFTLQLGGQFIPYESYVNQYMDLVDNRSFFINGNYEGRFEWGRLEASAFFSRVRHTMGFIQPDKTGDMPMDTRTSNLGYNIRATIDVSPHDLVRVGNELVYNTLDDWWPPVAGSSMMGPDTFININNGQRTRIGTYAEWERHFNDQWTGIIGVRNDIVWMNTGDVQGYNAMMYGANAAAFNALDHARTDINFDGSAILRYTPNAMSSYELGLARKTRSPNFYERYAWSTNAMAMQMIGWFGDGNGYLGNIDLVPEKAHTVSFTASWHDAAQKVWEVRVSPYYSYVQDYIDVDRCALAGCLSNLASNLTTTNNFVFLQFANHDAWLYGINIDGKLALWDGPVYGRGVLRGNVNFVRGQRTDGVDLYHIMPVNGTVGLDHTIGNWTNSLEVQMVGAKTQVSEVRNETETSAYALLNFRTAYEWNAVRIQFGIDNILDTEYDLPLGGANLVNYQQVSMMGSSSVWGYGVAGPGRSVNTRVTVKF

SEQ ID NO: 18500 - protein, 784 aa, Gluconobacter oxydans
MKAYTKTIKGLCPLTRPTKLVIAIQYALLSLAVAGHVHAQDASPESARKSQMNVLPAGGNAETSATDSSGSGDKASKGNAPSTQENAQQGKNPESVKPSETVLPTLVIREKGVQEGYGTKSSIVGTKTRTPITEIPQSMSVISRNELDMRAVNLNFTEALRYIPGVVPDQFGFNGTGFEYVSMRGFNSLSTANFRDNLSQQGRGLYFADFITDPYSLERVEVLRGPTSVIFGRGDAGGIINRVTKLPTSTPIREVELQYGSFDRKRIAGDFGLANEDGTLMFRLVTTALDTDTQVRFPNTGGDRAQIRRFYISPSLTWRPTDRTSVTLFGDILNNRSEASAFYVATQGGSPTNTLLGEPTFTRYSTDQASFSYKLEHHFNDTFTVRQNFRFMGLDGRFRDLNPAGFDADGRTLFRSALSTRERVNQTVLDTHVEARTRTGPLNHTVLAGIDWNRVESTLKSFTGSAPSIDIFNPVYFQPVPTPDSPFIDGNQKIDQVGFYVQDQIKLNQWLLTLSGRHDRVSNVTNVNVFDPQHTASKDSAYTGRAGLTYLFSNGIAPYFSYSQSFLPQYGIDFGNNSPFKPARASQYEVGIKYQPPGTRNLFTAALFELTKTNVLIPDPRTPLGVSQAGEIRSRGAELEARTEVFRGLNAIGAFSYVDVKVTESASGFTGNMPVRVPNLTTSGWLDYNLGTLNVDWLKGFFIGGGVRYVGRVFNDEANTSTTPSFTLFDAVLRYDHGPWQFLINANNIFDEKYYTANNVVPGSGGQFFLGTRRTVIGTLKLRF

SEQ ID NO: 18501 - protein, 750 aa, Gluconobacter oxydans
MPGSCRASRADCHCLTPRAMSKNRYTAPTSAPRLTPLAALAASLTATMATAFVAPAALAQATAPAADSAPATATATATATAPAGAMLREVVVTANPLGSDLNDMVAPVSTLGGDALAVRQGSTLGDTLDKLPGVSSSYFGPNASRPVIRGLDGDRIKVLQNGGTTVDASTLSYDHAVPVDPLVAERIEVVRGPAALMYGGNAIGGVVNVIDNRIPKEPIEGIGGAVDASATAGGDQARNASALIEAGNGKFAVHADAFARKTSDLRIPGYARSDRLRSADPLPEGETEAYGRLPNTSAQQEGGAMGGSYTWADGFVGANYSAYRNEYGTPAEDDVRLKMRQDRFALEGEARNLAGNTAGWLESVKGKFGYTDYEHKEIEGGETGTIFKNRGWDARLEARHAKIGNMTGVIGTQFGHTDFSALGEEAFVPSTNTDNAALFVFEELPLTASGDLKLNLGGRLDHSSIKASANGNDRFTDASRSFNATSASAGLLYKVNPLWSLTSNLSYTERAPTFYELYANGPHVATGAWELGDPNANKERATSIDLGVRFKSGAHSAAVSGYYSRFANYLALNATGRTRDEAGDVVAAGSPDALPEFQYLGVPATLYGFEVEGKTRLLQKMLTTSDTLDFEARADYVRGENRDTGEPLPRLAPLRLGGALVYGAGPWGARVDVTYAAKQTRVPTNDTPTDAYTLLSLALTYKFKVSGTQTLVYLRGDNLTNQDARNSASILRDIAPLAGRSVKVGFRTSF

SEQ ID NO: 18502 - protein, 773 aa, Gluconobacter oxydans
MLPCLLFSPLITDAQANAGQVGSISGAVTDSEGQPLKYATVRLTGGKSSQTNEQGRFLFNDVPAGKYQVSIRLVGYLPMTKDVDVVANQQAEVSFALQAENDLSEVVVTAGRKPESLKDVPSSVTILTEREVKEQLNVNPSVSAILGNTVPGLGTSSNKATNSGQTLRGRQVLVLIDGIPQSTPLMNGSRDIRTLDPAAIERIEVIKGATSIYGNGSAGGIINFITKKPSADRTFSGSTSLGLNGNLANPSNTTGYRLSQSFSGTVNKFSYIFNGTYNYTGVLKDAKGMVNAQPDGLGENSLYNTFVKLAYRPNDKSEIVASYNLFRSVQSSDYVNVTGRYGIKPSVGQKGDDPGEAAGTPYNHNALLSYHNTALPFGSTLDVSAYYNSFVSMNRYVAQATAWYGPGQTKIQSYKKGLRLTLNTPWEMGSLGEGELTYGLDLLNDRTNQVLTDGRVYIPDMNMLNLAPYAQMKIDLLTNFVLKAGLRYENARVKVKDFNTIARGPDGEGSIPVTGGKIPYNSTTFNAGLRYNKYELFNPFISFSQGFAINELGRILRSATSNTLESIATDPIITDNYEAGFSSKLGIVNLTASYYISKSKLGANLVDVNGFLVPQREPERIHGYEIAADVFLSNAWTAGGSYSYVEGKAEQASGTKVYMNGLRIAPPKATAYLGYRPLSSLDMKIYWVNTGSRDRFDLRANGLYANSEGPVSSVNVFNFTAAYRYNSKWSAGLGVENLFNTSYYPVVSQYRAIDAEYVRGNGVTMSLNLSYNF

SEQ ID NO: 18503 - protein, 382 aa, Gluconobacter oxydans
MSSRSSRTGNGFSWRQTIGWGLLSLAMCAPVASQAQSSVTLYGIIDTGVEYVTNNGPTKSSAVRVPSFTASIPSRWGFRGKEDLGGGLSAVFVLESGFAPSTGALNQGGRLFGRQAYVGLSGRWGTFTLGRQYSQIYWALPGDTMGPNIYAAGDLDPYLSQARVDNAVAYTFTTSGLTVAATYSFGRDAVDPAAAGGCAGQSPTDWRACKSMSAMVKYEAATWGVAAAFDRNYGGGGTGSPLPTSSLTDTRAVIDGYVKFGTATIGAGYLHRINHGAQTATLFDAVSNYWWLGGTYLPAPQIALDAQFGHISVNSSSAGASVIAARAAYLLSKRSSVYITVGHMFNERNATFTIDGGVLPPASTPLPGVDQTGVMVGARHQF

SEQ ID NO: 18504 - protein, 724 aa, Gluconobacter oxydans
MWTETGTGRCARAIAAGGAMCVAAAGGAYAQATAPGAAAVALPPIDVRGPADASSVGLVARRTVTGTKTDTPIDEIPQTINIVTAQQIEMTGAADLNQALRYVPGFATFGADSRTDWYAALRGFTPTLYVDGLPAPNTAVIANWRVDPYTIDSIAVLRGPTSVLYGAGEPGAIVDAHTKLADGERVREAGVQIGNDARKQAMLDVGDRLDPDGRYAYRFVGVARDGNAVTGPNGDRRVALAPSFRWRPNADTSLTFSATFLQDSGDISSNFLPASGTVLPNPNGRLSQDLYMGDPSFNDYRKKQWSLGYALEHRVNAIWTLRQDVRWSHLSLDDATVFGNGLAPRSTTNMMRFAGLFQLNYSRLDIDNHAQARFGTGPLEHTLLFGAQFDRQTTTNSVWLALAPSLDLYHPVYRPVTAAIFSGPTSLGHVDQYTAMNAFGVYAQDQIRWRRWTLTLGGREDVVNARFDDRSAGTHVQQDVSAFSGRVGLTYRGDAGWSPYVSYSTSFDPVIGVRMFGGGLPKPTRGAQTEVGLRWQPPGRNLMLNAAVYQIDQTNVVTPTPVNLDPTATTSVQTGKVRSRGIELSAVGKVTRELSIVASYLYQDVKNVQANDASLNHWPVSVPLPRQMASMWADWTWHTGALAGVGVGGGVRYQSASAGAPDNSLTVPSATLYDLAIHYDLPRWRFAVNVANLFDRRYVSGCQSYAVCVFGNERTVLASAKYSW

SEQ ID NO: 18505 - protein, 755 aa, Gluconobacter oxydans
MMSKAVQGAGRFQLKCLAVVIAATCHGMVQAQDDQVTLPSQTVTGELDRPQGPDYGYKAEKSLTASKTSTPLSETPRSVSVVTRKRIEDQKSQSLTDVLGYVPGIFAPPFAAGDGLAGDLFFIRGFNATDYGYGLLRDGLRVQGNRYDTTSEPYGLERVEVFRGPTSILYGENAPGGLVNLVSKRPTAATQGEVQLSYGSNDRRQLNLDVSGPLNDSGNVLGRVVMVGREADTQVDHVQDDRIYIAPSLTLNFDDYNSLTLLSTYQKDRTKLELGLPAAGTLLRNPNGKIDKDTFLGNKDWNTFEREVWTLGYEFTHRFNDDWQFRQNSRYMQSRIQRNEIWPGALNNAGFGTNVSTQAYDRHNKSITYSLDNQLEGKFDTGALQHTLLVGASFDRTSFNQDWSAGFGPSINVFNPVWTSEPTTPFTIQNSQLDQQMAGLYSQLQSKYENWIFLLGGRFDRVDSQYRNKFDATSPVSNAASDLDYTDRDFTWQAGVMYQFENGLSPYVSYSTSFFPVQQTTSASGPLDPITAEQYEVGLKYEPKGWNTMFTAAVFDLRKENDVYFEAGINDYRQVGESRSKGVELEINSDISANLNVTAAYTYTDARITKDAPGSLLEGNQMTGVPRNQASIWANYRFLDGALRGLRLGGGVRHFHSTFAYTAESLYGKLDTGDVTLVDAAIGYDIDENWSVDLNAKNFFDQGVRGRLQQCRALLLGRRAHLLRYRVAALVSGNRVSKPRRGGDPSPFCIGKDNG

SEQ ID NO: 18506 - protein, 420 aa, Gluconobacter oxydans
MTFKKRYIAIAITTSMLSAHANSAGFQVSEQSATGLGRAFAGEAAIADNPGVLARNPASMTKFDKMAISAQGSLVLPNIDVTAHDAPTGEQTAEDVAPLAFVPSTYFVQPLNNRLSWGMALFSNYGVTTDYPDDFYDGTSAGKTSLLTINLNPSVAYKLNDQWSIGVGISAVYAQAELYRHYGKNALPFYPAIKPSDKTINMEGDTWAFGWNIGTLFEIDENNRFGLAYRSQVDLDFDGDFTDYSGQVLGANRRGSTIDAKLVAPLPATAEFSGFHQLNNQFALHYSIFWTQWSKFTELKATSSECNFGGQLPGVCLLKEEKYDDAFRWAIGSTYNLNQQVTLRAGFAYDEQGGKATLSIPDTDRFWYSAGASYKYSDQLSFDLGVSYVYGKDGTFTEAGDSFTATSDAFIGAAQVNYIF

SEQ ID NO: 18507 - protein, 318 aa, Gluconobacter oxydans
MRLAPLYRNALLLTGLLLSGIAAVQAADWPRQITDSRGTHTLESQPQRIVSTSVTLTGSLLAIDAPVIASGATTPNNRVADDQGFLRQWSKVAKERKLQRLYIGEPSAEAVAAQMPDLILISATGGDSALALYDQLSTIAPTLIINYDDKSWQSLLTQLGEITGHEKQAAERIAQFDKQLAAAKEQIKLPPQPVTAIVYTAAAHSANLWTPESAQGQMLEQLGFTLAKLPAGLNASQSQGKRHDIIQLGGENLAAGLNGESLFLFAGDQKDADAIYANPLLAHLPAVQNKQVYALGTETFRLDYYSAMQVLDRLKALF

SEQ ID NO: 18508 - protein, 715 aa, Gluconobacter oxydans
MLVAQFLCRSGWILNIGIQACKNILENERSGFHLVRFAALVLCLPALLHAGQPDNSQQDLKQMSLEQLSQIEVTTPTKQPESAFNTPAAIYVITSEDIRRSGVTNIPEALRLAPGVEVARIDGDKWSIGIRGFGSRLCRDVLVVIDGRTVYTTLLAGTYWEVQDYPLEDIERIEVIRGPGGTIWGPNAVNGVINIITKRAKDTQGGMVSAATGSFDHGTVNGRYGNHHGDNLQYRFYGRGFDRGPQFHWDGRNFDDWSSLQGGFRVDWNDKAQVNAFTLSGDIYDQRAGESVVATSYTPPFSQVLDQDARLSGGNVNFHWHHDQGEGKSFDLQAYYDRTNRREPNFGDLRDTYDVDFVQHWRLFDRHKVTWGLGARFSHGDNIEVVSGLTFSPADRTDRLLTAFIQDEFTLVNKRLVLTYGSKFLNTNFTDYAPEPSARLLWTPTDTTSVWAAATHAVRTPSDAERDFFLSGLVAVLPDGTPYFARFNANRNFRPEQMNGYELGARHLFGKNVYVDIAGFYNHFHNLFSEDITGAPYVEDSPGVPHILLPAQFGNGLIGNTKGFEITSEWRPTESWRLRGYYSYLHMNIEPGPGSLDIGSAPGIMGSSPEHQVFAQSEYDLTKALQFDADIRYVSELPGQTAGPAGATYPIRAYTTADARFGWQIGHQFDVSVVGRNLLQPHHPEFGSDPSADSNIAFVGIKRSVYIKLTWTSAR

SEQ ID NO: 18509 - protein, 1770 aa, Gluconobacter oxydans
MKFMSATAVFAAALSSVTEASSIQDQIKNTDCNVSKVGYSTSQAFTDMMLADNTEYRAADSVSFYDFSTSSRLPRKHLSSSSEASPTTEGVSSSSSGETDEKTEEELDNGGIIYAREKLTISESQDSLSNQSIELHDNSIFFGEGEVIFDHRVALKNGGAIYGEKEVVFENIKSLLVEVNIAVEKGGSVYAKERVSLENVTEATFSSNGGEQGGGGIYSEQDMLISDCNNVHFQGNAAGATAVKQCLDEEMIVLLAECVDSLSEDTLDSTPETEQTESNGNQDGSSETEDTQVSESPESTPSPDDVLGKGGGIYTEKSLTITGITGTIDFVSNIATDSGAGVFTKENLSCTNTNSLQVLKNSAGQHGGGAYVTQTMSVTNTTSESITTPPLVGEVIFSENTAKGHGGGICTNKLSLSNLKTVTLTRNSAKESGGAIFTDLTSIPITDTPESSTPSSSSPASTPEVVASAKINRFFASTAEPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGAIHSKTVTLSNLKSTFTFADNTVKAIVESTPEAPEEIPPVEGEESTATEDPNSNTEGSSANTNLEGSQGDTADTGTGDVNNESQDTSDTGNAESGEQLQDSTQSNEENALPNSNIDQSNENTDESSDSYTEEITDKSVSSSSESGSSTPQDGGAASSGAPSGDQSISANACLAKSYAASTDSSPVSNSSGSEEPVTSSSDSDVTASSDNPDSSSSGDSAGNSEEPTEPEAGSTTETPTLIGGGAIYGETVKIENFSGQGIFSGNKAIDNTTEGSSSKSDVLGGAVYAKTLFNLDSGSSRRTVTFSGNTVSSQSTTGQVAGGAIYSPTVTIATPVVFSKNSATNNANNATDTQRKDTFGGAIGATSTVSLSGGAHFLENVADLGSAIGLVPGTQNTETVKLESGSYYFEKNKALKRATIYAPVVSIKAYTATFNQNRSLEEGSAIYFTKEASIESLGSVLFTGNLVTLTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTSGSGGTPSTDSESNQNSDDTEEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISVLWKFDSYRQWAYVPRDNHFYANSILGSQMSMVTVKQGLLNDKMNLARFEEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNKGEWEDLGWLTALRVSSVLKTPAQGDTKRITVYGELEYSSIRQKQFTETEYDPRYFDNCTYRNLAIPMGLAFEGELSGNDILMYNRFSVAYMPSIYRNSPTCKYQVLSSGEGGEIICGVPTRNSARGEYSTQLYLGPLWTLYGSYTIEADAHTLAHMMNCGARMTF

SEQ ID NO: 18510 - protein, 419 aa, Gluconobacter oxydans
MTPSTAQYVFPGLIAIALTGAALPATAEESGFVEGAKVNLNLRNFYINRNFTNPTKAQGKAEEWTQSFILDAKSGFTQGTVGFGMDVLGLYSVKLDGGKGTGGTQLLPLDHDGRPADSFGRTNVAFKAKLSQTEVKVGEWMPVLPILRSDDGRSLPQTFRGGQITSKEINGLTLYGGQFRQNGPRDDSSMSDMSMTGKAAFTSDRFNFQGGEYLFNEKRTQIGLWNAELKDIYSQQYLNLIHTQPIGDWTLGANLGFFYGKDDGSARAGDLDNKTWSGMFSARYGGNTFYVGLQKLTGDSAWMRVNGTSGGTLANDSYNASYDNAQEKSWQVRHDYNFVALGIPGLTLMNRYISGDNVHTGTVTDGKEWGRESELGYTVQSGVLKDLNVKWRNSIIRRDYSNNEFDENRLIVSYPISLL

SEQ ID NO: 18511 - protein, 616 aa, Gluconobacter oxydans
MVFRPIAACAAMSLCAWPLLAYAESSPLDAAVLRVSMLDPVVVTPTLASRTTEASLASVTVLDEKQLRERQPQDITEMLRGQPGVDITGNGAFGKATSVYLRGTGSSSTLLMVDGVRLRSATGGSPSWQFLPPTLIDRIEIVRGPRGSLYGADAVGGVVQVFTPGARDLSNEQTGWVELGAGSFNSRRVAAGAQGEQDGTRYNLAVDRFDTDGTEIREGSDDRGYDNTSAVARVTHRFDNDAEIGVFGFRAAGSTEFEGSSPSQKKVTDYAMQTAGVKGQLWVTERWLSKLILSDSRDENENFTDGNRDSIFNTRSRAANWQNVFALGDHQLVVGADYLQDLVDSTTLYLEDERDNSAGFAQLLLNFGAFDVQASGRYDDNEAYGSETTGGLALGYKLDNHHRLRASYGTAFRAPTFNDLYFPGFGNDQLDPESSASTELGVRGQYQRWYWDIAAYQTDVDDLIAYALQGGRYAPFNVNRARIRGVELATGVEINQWRAGAAFTAQDPEDRDTGLVLQRQSKRSFRFDLDRAMGNVSLGGSVVLQGHRYNDAQNDVRLSGFGLLDLRVGWNFARNWSTRLAVKNVLDKEYATAQNFAGWNYMNAGRSVMLSLRYDR

SEQ ID NO: 18512 - protein, 1173 aa, Gluconobacter oxydans
MKDMRLCFSVCNRRFLTGVIMFMLLYPMSVFAVQGQIAVQGKAMSIKQAIQVIEKNSKYTFFYKAADLSNAKIRDIHCEGSIEEVLNVLFKDSGISYVIKDNEVILKSTPVVVATPQQSNKIVVKGNIRDTLGESVIGATIMEKNNAQNGSISDINGDFSLSVSPGAVIVISYIGYVTQELKAIAGAPLKVVLKDDSRTLDEVVVVGFGSQKKANLTGAVSSIKMDEIIGDRPIMTASDALQGTVPGLLVSNSGNAPGSGKSFQLRGAYSVGIKNSDGSYGANVAPLILIDNVEGSLDMLNPEDIETVTVLKDAASAAIYGARAAGGVVLVTTKRPKEATAFRLNYNNNFGFATATNLPKQASLMDYLQAYQDGGYSDAYWSYGSPSVSKWKEYLTQYRQDPSSIKTVGDGIFADTDGALYYLNEHDPYKNFMETSFQMNHNLSVSGGTDKLRYRMSAGYVSTDGVLITDKDTYERLNINSYISADITKWFTQELTMSYARTNQSQPNSGLGSMFGSNQVSYQPEGNMPSDVCSTISQDLPFNTPRNQVLLANKWKKSYDNPRVFVKSILKPFKGFEAVFEYTFDKNMYDYNFYTGKTQYTDIQGGNNIWNAAKDYLQKEKQFTDYNAFNIYGTYKFDLNKDHHFSVMAGFNQESKYTEGVNVLSYNQAVVEVPALGSGTGDLKATDSYNEYSVRGGFFRVNYNYMDKYLLEVNGRYDGSSKFPKDSRFGFFPSVSLGWNVAQEKFMEVTRNYIDGLKIRASYGVIGNQNVVNYAYFPTMSVSNKYNGWLSGGDYVTAINSLPNLVSTSFTWEKVATTDIGLDLNMFGNRMNVVFDWYQRDTKGMLAPGMQLPAVVGASSPFQNTADMRTRGWELAVNWRDRIGKFNYRVGFNLSDSYSEITKYDDNAASKLLSNFYPGQRLGEIWGYEVDGFYTVDDFVDTNSWKLKDGVASIKGVSPRPGDLKFKNLRDDDKSTNQIDSGDGTLDNPGDQKVIGNSLPKYLYGITLGANYKGFDLNIMMQGTGQRDAWIANNLVFPMYIYSVNDIKYQPLFDGLTDYWRPVDAANGDYTAVNPNAKYPRMYGQNPTVGSNYGRKTDKYLSNAAYFRIKNVTLSYTVPKTWISRIGLNQLKGFVSVENLATFSSLPSGIDPETLSWNYPAFRTVSFGINFTL

SEQ ID NO: 18513 - protein, 1171 aa, Gluconobacter oxydans
MKSRHHLNTRLLPLSILISALIPAAVLAAPSVAIPPPVQDLINQVQSYANAHVISPEQAETLIKRLTVTPEKLKEEEARVKQELAAVEKKQKEANTEIITTSIEKDQFNKALNNKQKAKLVAEAVLINTNNRQNEAIKAVNENWSLSTDNLSTKLITMVNRESEIQTALDERTKRLETANAQQQEQEKKLQQLGDDIQEKQSKIADATTNKTSGTIALQNKLSQAQKKLTTDQKNPKSALKLAETEHNKTQKDLNSPIKKTQSQAIQNENTYKAALKALQDPIDEAEKQLTAAHKRIDTLGNEQADLYEQQSASYALIDNLKNEVKQAKKAQQQAEKAVKIIQNAKLAQQAMAETTAAEKLLQEVEQKITTIAVIAQEAEAKLTAAQRAKADAELQLADKMEQLANINLDLTALNNLDPKVISQQTLAKGEAQPVADGELAMAIKVAGGEQNVTTGGVVLASVVTEDGVVNLSDNALAHDSQLINGTLNNTRAHDVNTQVGAQGKLLINGTQEAAATSEGATVAAGGSVTAGTNALVTKMVSAGTVTGNDGALFTETTLNDGQFSLNNGAIAKNTKVNGGQFNVNEGATAKDTEVSAGAVTGNDGALFTETTLNDGQFSLNNGAIAQNTKVNGGQFNVNEGAIAEGVTVKGGEFNLRARAQAMKLTIEHGEAQIAGTLTDVTLRGGNTTLASTADVAGTIHSISGSALKVYQGAHTAQADLNLAGRVVLFADDVAPMAALPSRAVRAADNRLSAPFTFRRVNMSGGTLDLRNVKNAQLVMDSLAGNGTFKLGSMLQQDTSAPVNVTGNADGDFTLQIDGSGIDPTNLNVISTGGGDARFTLTDGPIGLGNRVYNLVKDASGKVTLVANESTVTPGTASILAVANTTPVIFNAELSSVQQRLDKQSTEANESGIWGTYLHNNFAVKGRAANFDQTLNGITLGGDKATALTDGVLSVGGVASASTSSIKTDYQSKGNVDSHSFGAYAQYLANNGGYVNGVVKANKFNQDIHVTSADNSASGNTNFSGMGVAVKAGKHINHNHLYVSPYVAMSAFSSGKSAVKLSNGMVAQSSSTRSMIGTLGVNAGYRFVLKNGVEMKPYVSASVDHEFAANNKFRVNQEMFDNNLNGTRVNTGAGLNVNITPNLSVGSEVKLSSGKNIKTPVTVNLNVGYRF

SEQ ID NO: 18514 - protein, 467 aa, Gluconobacter oxydans
MDTTLKTTLTSVAAAFALSACTMIPQYEQPKVEVAETFKNDTADSGIRAVDLGWHDYFADPRLQKLIDIALERNTSLRTAVLNSEIYRKQYMIERNNLLPTLAANANDSRQGSLSGGNVSSSYKVGLGAASYELDLFGRVRSSSEAALQGYFASTANRDAAHLSLIATVAKAYFNERYAEEAMSLAQRVLKTREETYKLSELRYKAGVISAVALRQQEALIESAKADYAHAARSREQARNALATLINQPIPEDLPAGLPLDKQFFVEKLPAGLSSEVLLDRPDIRAAEHALKQANANIGAARAAFFPSIRLTGTVGTGSAELGGLFKSGTGVWSFAPSITLPIFTWGTNKANLDVAKLRQQVQIVAYESAVQSAFQDVANALAAREQLDKAYDALSKQSRASKEALRLVGLRYKHGVSGALDLLDAERSSYAAEGAALSAQLTRAENLADLYKALGGGLKRDTQTDK

SEQ ID NO: 18515 - protein, 435 aa, Gluconobacter oxydans
MTPPSKTASSALAIGLGMVLASPAHAGGFYIQEQSTKEAGRAYSGNAVAADSPATIFFNPAGMTELEGIQVEANAQALFVTARQSDAGTTRSVPGLPATLPVTGSDGGSPFAQPLVVPSIYASAQVTDSLWVGLGVNSPFGVVVDYDEDFFGRYDSVTSDLFTLNAQPSVAYKISDNFSIGAGVDIQYIKVELANAVPNPDPADPDAELRITGDDISVGWNAGFTATFDPVRIGAHYRSAIDHDLEGEFDLSGLTGLLAENNVTTPAAAPLSTPDIATVSVLFGTDTPWRVYGTWRWYNWSNFDEIRVEPEGVEPQVNEQFYRDTYSMALGAEYDVNERLTLRAGTMFDASPITDEFRSTRVPDGDRTWLSVGASYDINDRFSASLAYAHVFVKSEPIDRTDTFFEGTPAAIDARIRSNSSGDADVLAFSLGARF

SEQ ID NO: 18516 - protein, 751 aa, Gluconobacter oxydans
MAPAATRAPSRRIDALPHGPSCALILIRYIVSCSSRDSARDSVHPDHTTPITAMDDHRRIAPPFARRLHPLSLLLAASLAHGETGAPPAERRSDAPPATALAPIFVTANPLGASALSSPTASLSGDALTLRRTDSLGDTLNGLPGVSTTTYGPLVGRPIIRGMDGDRIRLLQNGVAAYDASSLSYDHAVPQDPLSVERIEIVRGPAALLYGGNAVGGVVNTIDNRIPREAITGVSGALDASYGGANNARAGAALVEGGNGRFAFHLDAFGRETDALRIPGHAHSARQRALDGEDASEPYGRLPNSDGRRYGGAAGGSYTWADGYVGASYSGYESNYGSVAETDARLQMRQERVALASEVRNLRGPFSQLKFDFGYTNYQHKEIEDGVTGTTFRNHGYEARVEARHRKLGPFEGALGVQVGQNTFSALGGEALAPTTRTTSVALFGLEQWQATDALKLSAGARIEHVRLDPSANGDDKFGFARSRDFNAGSVSAGALYQLAPAWSLAGNVSYTERAPTFYELYANGPHGATGQYLIGRPDAQKEKAVSTDLALRYASGPNRGSIGVFYSRLRNYLAEYDTGRLVDDDGVPVAPGADDALREAVYRGVRAEFYGVELEGRWRAFERRGHRVDLELSADYTHARNADTGEPLPRIAPLRATLAADYGYGPFGARAQLTHAWAQHRVPEHDLATDGYTSLGVVLTYKLRVGATNWLAYLRGDNLTNQDIRYASSVVRNIAPQGGRSVSIGMRTTF

SEQ ID NO: 18517 - protein, 801 aa, Gluconobacter oxydans
MKANSMKSIGRRLTFLFLMLCVAVSISAQSYQLSGCVQDENNQPMEVANILLKQAKDSTYITGMLTDAQGCFTFTQPKGKYLLHITLIGCEDIYLPVSLQENKNVGMLTLKSSSTFLNEVTVTAARPVIKRLVDRVVFDTHNSIASAGGNALDLLREVPGLRVGQNSIDIIGKGGVKVYINDRETKLSGDELIDYLRSYDASQIQKVEVITTPPSKYDAAGNAGIINIRLKSRPKDYLGGTVSTSYNVGEKDNYGYGGVNLNISKGRVSSFVNAGTTQGNYETREANRRYFAKNTWDGRTDYKKYMQSYYGQAGVDVALEHNWTVGLQAVYNYGNPKDAKAVSVTEVYDVATTRLDSLLFSDSKEGGKSDRLNLNFHTDKTWGDKGKKMTWDVDYLRDNRDSHMGFLSETQTPDGVAIPGTNFDYSYLQDRKVDVFSSALDFTLPFEKYKVTAGAKVSFTDTRNRINYDTSDPTLVQDDYFHYKEQIYALYADYNRAFSKQFSMQLGVRMEHTRTTGISESANKTDKHDYTRLFPTLYFLYSPNELNALNLSLSNRISRPSQNMVNPFPFYQNKYTYACGKEDLKPSYTYNAELGYTFKNNLNFSAFYSYSDDVFFQVVGLDPETNVSSFLWDNFMETHSFGLNNSYTFRTGWMQAYVQHGVNYSRTTSSAASTSAEEKGWAYNASLRNTFFFNSKKTFIGTLSGWFTSRQYSGVYLIKPNYGISAGLLYRMLDNKLSLSLNVNNILISHSKLETVSNGVRMTTDNQFAFTGFRIGVSYTFGGDIRSKGQRNSNSDIQNRL

SEQ ID NO: 18518 - protein, 853 aa, Gluconobacter oxydans
MRVGYVLALSFLVFGLNNGLAVGQDGPTGRVEGRVVAAETGGALADATVGVNGSNRPQGTVTDADGRFVLTNLPPGRTTLHVRHVGYVTTTRTVQVRAGQAARLTIELASATVELSGLEITGATRGTRTALPGAATKVDAAALDQMDPIGTQAALKHVPGVYGLADDGMSQTRMSVGIRGLQPRRTQRVLVMEDGMPIQPAPYVFSPLYYNPPIERIEEIEVIKGSSTIRHGPQTMAGVINYVTSRPQRRSPGGTVELTPGTNGYVSAFGEVGGFGTDDVRPQVQLLFKRGSGFRQHNDFRQFNGTAKLQADLGANRSLYVKTNANYERLNATYTGLTPYSFRTDPDFNPKDDDLYQIYRASLGTIYNRRYSDAVQGTTRLYANVFHRPWWREKDVFVDAEAYQAPDRDAEPVAPNEPGPLMRVGISDVRTQENITLDDKPYFGNVRTFYVTGVEHSLGIQHSLLGQEADLEVGGRLHWERFKDNRKISDEVGVREGVFYQGDVSDSDPVTIIGGSSVYETRALSLYALEDVQWGPLRLSPGFRLEAFKQSQINRLNGSQYRDQTSVVPLPRLGFNWNLGTADLGPLLGPGNARLFGGVHRGYTPPSSATFAIVGFDPPSATGAGDGGFDLKAEKSWNTELGVRGRSDAGQFEVTGFYLYVEDLVGGRTSFQQNLGVVESYGLEARTRVKGGLFAAPLPTLDVSYTYLQSSVVQGVISSAIDGLPEDITGNELPAAPRHTATVGLSKAFSDIGLTLSTDLSYTGRFYTDLENLEATNNRGERGPVPAHTVIDAGATYEYSDALSIQLTAKNVTDNVYIGSRLHSNPSQPSANLSTGIIPGARRQVNLSIQYDF

SEQ ID NO: 18519 - protein, 369 aa, Gluconobacter oxydans
MTLRHKHLGWLIAAAAPVAAFAQTSVTLYGRIDGGVEYLNHIATPNGSSTRWSAEGGDWGTSMFGLKGFEDLGGGMSTVFNLETAFQVMNGTTGGGRLWSRRAYVGLKSDTWGQLQAGRNLFIDSDGVWEFDPFVQQAFSSASLVRGRNWQQSSNNIEYHSPVIGGFDVQAQYAFGNQSRGFNYGAADDFGRSDGIMISYHSPVLDVRGIYDELRDNNGKFSNIFTASREYFVGANVKVSKFKIQGAYTHYQAPDSPAGVADRADHYWLGATYTATPQWAVTGGGYYVKVGDGGGDASHDPSGHAIMYVLGTTYNLSKRTFLYGTVAYVRNGGNSNFSLIASPRDATSGTSPMTGESQTGAYVGMMHTF

SEQ ID NO: 18520 - protein, 957 aa, Gluconobacter oxydans
MPSHVSRVSLLKMALLAGGAFAAPSLAFAQDATAAPEPQAVAEDAAPPTDAIVVTGFRQSLQAAINVKKNAVGAVDAIVAEDIAKFPDQNLAESLQRIPGISISRDAGEGRAITVRGLSSQFTRVRVNGMETVATSTDGASANRDRAFDFNVFASELFSSIVVHKTAEASLDEGSLGAVVDLNTGNPLGGKAGFTGVASVVGTYNDLSDYVGPRLAGLLSWRNDAGTFGISLSAAYQKTRVLELGNNSVRWAQARFDSVDGTPCFTRPNSGGTYVESDACDEAALAFHPRIPRYGEVKHDRERLGITGSVQFAPTDATKFSIDGLFSRFDAKREEQWGEVLLRSNERSIDVVDPVYDDNGNMVSATLNDAWVRTEHYLRKSRTEFYQVGGTWDQDIGDSLRFTLLGGFSKSNAEIPVETTMIFDDRDAQGYSFDYTDMKHPKLTFGTSVTDPANFQLAEIRDRPSSVVNRFKTVQLRTEWDVAEGFTIKAGGMWRRFNFDTEAFTRDTAVCGNGGVDRIFGTINCSASSVFGPTAVYGIPVTAALGQVFNLGNAGQPAGNTNSWLVPNLDATTALTKLYERPLALDAGNNRGVQETTKGGYLQFDAKGELLGLRYALNAGMRYVKTDQSSYGLVGSVQTTVKRSYEDWLPSANLALYPTENVIVRAAIADVMTRPTLGSLTPGGSADGFNYRVSTGNPYLEPYRATNYDLGVEWYFAPQAVLSAAWFKKAVHTFTRSASITGLTYAQTGAPISSLSPNSPAALNPSQLLEDRWTLATTVNGEGATLKGWEFAAQVPFKIFAEGFLGNFGVIANATFISSSAEYELQGPITVARLPNGNLGPLNNVTLTSTLANVSKRAYNGTLYYDDGRFSARVMGTYRSAYHEGASGTGNLLEGYGSMWNVDASVRYKVNDWLEVSVEGNNLLDTYRYRYTDIETQRNYENNHFGRNILVGARLKY

SEQ ID NO: 18521 - protein, 423 aa, Gluconobacter oxydans
MHTTMIARAVPAALLTMASGLASAAGFQLMEQNASGLGNAYAGSAAVAENAATIFFNPAGMTQLQAREASFGVTAVRPSFEFSDKGSQSGVLRGEGDDAGGWEALPNAYLSWALNKDLYVGVGLGAPFGLVTDYDESWVGGAQSLNFEIKTYNINPSIAYRVNDKLSLGAGLNWQRAEAEYERIAAVAPGLATTFATLDVDSDAWGWNIGVLFTPSPSMKIGVSYRSRIEHELEGDLKLKGTLAGRVPQTSNGKARADVDLPDTLIMSVAQKIDERWEMLGDLSWTGWSSIRKVDIDRRSGPLSGVTVQTLDTDYRDSWRVALGANYKLNDAWKLKFGVAYDQAPVRSRDRRLVALPDNDRTWYALGAQWKATKTTTLDVGGAYLYVRDTKIDNDQSAAGRGRVTGEYETDVWLFGAQYSMAF

SEQ ID NO: 18522 - protein, 1086 aa, Gluconobacter oxydans
MFRECDSGSYWHRLFVALPRVQDLGESMNRSIQKRGLALALALAMGSVHAQSTTGSIVGSVGQGSGTSVLVENNSGLSREVPVDARGRYTAGNLPLGTYKVTVKRDGAVVETRENVAITVGANTDVSFAANAAGSGVQTLDSVTVNAASLTTIDVSSVDTRTVVTAEQLQQLPLGRTAEAIALLAPGVVVNSGGFDNGPLGGSLPSFGGSAASENAYYLNGFNTTTISNNLGGLTLPYGAIDQQEIFTGGYGAQYGRANGGVINQIGKRGTNGWTFGATVIWEPNGLKANQRDIYWRPDSQGSTINNAAYRYARAANGLYQPASEAEASQTTYSAYVGGPIIQDKLFFFLAAEQVNSDGVRVGTNRDTDNGRTGGLTDDDYKQKRWYAKVDWNITDNHLIEVTGASDVAETNGSIYRYDYLARRRGAYFTDESTWKTGPTLFTGKYTGYLGDNLTVTALYGKMRTPDELTPFNYDAAGGPVINSAALQNPAYTGGTPRIGNQLVASVSSPDREYKKDNQRLNLEWRIGHHTLNVGIDNQTSEGIDVGSILSGPGYAWTYGQTNDPYGLATGGLVSQSANEAGGVGAPSPGLVDPVNGASGYYVVRNINTRLYSYEAKQRAYYIEDKWQVTDNVLLSLGLRKDEFTNYTPFGDPYIEIDNAWAPRLGFSWDVNGDSSLKVFGNLGRYYLDLPLSAVGLFTPAATTDTYFTYSGINADGTPILAQQLGSAVSVNSRFGRIADVRTAVAKDIEGENQDELILGFTRQLDSGWVLGVRGTHRRLNAGIDDQNYDVSNTALIDAAAAQGVTIDFSKVAGAALINPGQTNTWGVIGTDGQFHEVSVSREAAGFPKFKRNYSAVEFNLERPFDGKWYAKVNYVWSHSYGTTEGQVRSDLWRTGGALGSYQGQASVSTTQSWDHAALMEHFNGDQSNDHRHQLKLFGFYQFTPQWGASANVSLISGAPHNCLGNYYGTEYSGRDPAGYGGSAITGGPYHYCYNPETGTGVASPPGSQGRLGWIAQLDMGVTYKPAFADGKLALRFDVFNITNEQTATNIYPFSQLPDNTTNPLWNQVVAYQAPRSGRVTLSYDF

SEQ ID NO: 18523 - protein, 851 aa, Gluconobacter oxydans
MSDRRKHFVSLVRVAPALFSFQGIQMPFKHAAFASAAVSVMMVAGAAQAQAQYAFDLPAQSLERSLTAVGRQTQVNVVFRPEQVSGKTAEALKGRFTADAALRRLLAGSGLDVRTTPGGSYLLVEAPTQLVQTESAVVDDVVVLGRGRTRQMQTLSKAELDKLAPGTSPLAALNKLPGVNFTSSDPFGAYEWAQQVTIRSFTTDQMGYTLDGLPLGNMQYRNNNGLSIGRALLTENNGATSLSQGGGALGTASTNNIGGTIDFTSIDPTGEFGVDMAGTYGSGGTWRGFTRLNTGRLPGGGSLYAAYARQDTKKWKAAGEQNIEQINVKFVQPLGEAVRSTTFLDYADRREDDYADLSFALVNRLGWNVDTISDNFPLAEALATALQTGGAVPAPYLNADDVYYNGGGVRQDTLVYERLDYDLTPSLSGSTTAYYHRDHGIGTYASPYDATPEAYGGSPVSVSALRYDIDRAGLISRLSYTLGDHKLDAGVWYEDNDFHQAAYLYGLTKGVAPTNFQRFYDNPFRTRWDYQFTTKTYQFHVGDTWSVTDNLKVNAGFKALNVTNEAETITSNTPINGVIKARDYFLPSAGILYRLDERNEMFASFTRNMAAFVASASSGPFSTTQAGFDYIRKDLKPEKTRTLEAGYRYSRDGLLASVTAYDVAFENRLLATSISATIVGNQNVLQNVGGVTSRGVETAISWRFAPAWSLFGSFAYNDAKYDDDVTPLGGATIATKGKRVVAAPKTVGGAELAYDNGTVWSKVTAHYQGERFYTYLNDSPVKSSTVFDLAAGYRVPQTSVEVLLNVTNLFDKRYYSSVGTSGFVNADPTGSYTTLQQGAPRQVFATVRVSF

SEQ ID NO: 18524 - protein, 774 aa, Gluconobacter oxydans
MPSDRRHKRYRFRRLPSLSILAVLCGSASAQEMLPTIDVRSDAAQTADVTPDYKVNRVELGPLGKKPLIDTPFSVNTVSEALAENQQLQSVREAFRFIPSVQGENVRPQTRGLQASVVQNTRIDGLNIAATTDYPIEEFQRIDVLNGIAGALFGPAQPGGTFNYIMKRPTADPLQRFTGGYLSTGQWLAHMDLGGFADPERRLGYRLNLLDQDGASYVGNSRLQRQLASFGGDIHFSPDTVLETNASIYHYKTEGLPGTFAVAKGVLFPAAVDPTRVGYGQPWGGDDNTTTILSGRIKHDFNENWSFSAGVSRNTSDRASTVPTNTLINNAGGYVTTAATTTYSLDTVTSNQAILNGRFETGALKHDLFLANNGFSWDRYRPFTIGALTAGSASLDNPLTFPEPNFPDFKDRYRSVNTLQQSITLGDTIALNDQWSVLGAISDSWIDTNNYNTSGGVTGGYNANGWSPLGSVMFKPRENMTTYFTYANSLQQGDSAPAGTANQGDTLAPYRSNQYELGAKFDFGRFNLNAALYRIERPYAFTGSDNVFSVKGTQINRGIELMASGAISDEWTVHGGMTFIDPRLYNTGSPQTDGQRILGLSQFVTNCLLEYHVPTVQGLTFSGNVTYATNRPTDYANISFVSGYAVLDLGMRYAQLVADKRVTFRLDVFNVTDLHYWANVTPAAQNGYNATGSATGTLGAPRTVRASLQVNCEDPIYRSRLRKRRRSGDDCRLTGLSRGSRGADSAPAGLRGRKHARSPHCDCRRLYQGDGPEI

SEQ ID NO: 18525 - protein, 702 aa, Gluconobacter oxydans
MSSRHPPASRRRALFATSFLVPVLTFAGAPAQAEPETVLPTISVNATRVPKGIVGASTTVISAEDIARSPAATVQEIIAQAPGVQLQSVSGGVNGAGTTVDLRGFGAFASANTLVLINGRRLNDLDLAGVDLSTLPRDSIERIEITRGNSGAVLYGDNAIGGVINIVTKTAAGGPPVAMRMEAGVGSFNQRTAAVSVATNAGPWSTSFFGNAVKSDGYRVNNALDQRNGVGELRYATPDFTAFVNLSADDQKLGLAGVRRVYPNGLNELVSDRRGANTPFDYANKQGVNVTSGFTKFLANGVELIVDGGVRDKQQQSGFFGEVPLQSWAAKYIDTELRTWSITPRLSIKNPVFGLPSDILTGIDYYDATYQSDRSQYLGTAPIHSYDLTQRTLSAYWQQTVGILPTTDLSYGARVQNTRVTAADRLDINAPGYWNIGDRQAAPLNSDQTNHALHVGLEHRLNDTFTVFARAASAYRTPNVDERVAAGPSFDPLTFLALPRVFDLKTQTSHDFEGGVRFASGPLQMQSSIYDMELTNELHFNPVLYANYNLDPTRRYGGETSGSFRVNDSLLLRGSAAYTRATFRDGVFAGNDVPLVSRYTASAGVTWNIWQKYAVLDATVRYWSSRRMDNDQANFQPLIPANATVDLKLSGEVDRFFWSLTANNLFNAEYYDYAIASAATAGRFNAYPLPGRTYMVKMGATF

SEQ ID NO: 18526 - protein, 785 aa, Gluconobacter oxydans
MVKTSLGTTSDANGNYSLENIPVGNYTLMVTKVGFGKQRLPVSVKANEKTRVDISLQEATYNLDEIAVYGQRKKIVSATRTNLELLDIPMAVQVIDKQIIQQQQIINLREVFRNISGIQNTAAWGNGSRRLAVSSRGFLLTDANYRRNGLLIMNEGNHFSDHIEEVQILKGPASVLYGDVSPGGVINFVTKKPQLTDFTNLRLTMGSWGLVRPSLDFNKKLDTDGKMAMRLNATYEKANSYRDRVTNEYIMLNPSFLYRPNNKVNWTVEGIFRQDKSVEDPGIFVPGVTLEEARSIPYNRFYGNPAARNEFTETSLVSTLELKPLANLQIRLTNQYQSVPRLNRGIWQNWVHSVGDTVALSSFGINSNDPANHPSLQALDVTLVNNNQDIVLNEPIIEFGNSATFNALNNYANLLELNYSFKTGSINHSVFVGFDYTYSTDRITYERFPNSIGSFNNPDPSIMNNILELNATPSPYKDVLTRTGLNIQEQLMLFNDKLHFLLGVRFNWFKRDRDYDNESERPDDYLNVTDNPVIPRLGMVFKIKSNISIYASYAESFEVNGRHRYKPTEFLDPTLGRQFEAGVKANLLNEKLGITLAAFSLRKENQPSFILATLADERGVSYDPAEVSIDGHILYISNAQRSQGVELDFNGKITNELNVSGNYTYLQTSLLDDVIFKKGNELENAPNHSLGLWANYKFSRILKGLSLGYGVFYQAQYFGDKDNSEGQTHFANTKMSLMVGYQYKKLLLRFNIENLTDERTYFNSFGYFWLPQPPRRTLFSIHYSF

SEQ ID NO: 18527 - protein, 705 aa, Gluconobacter oxydans
MSKQKLIEFTLVTGLMAPFAAIGSEGPAERVSTEHAKDNLERITVTASRQRTLDTDLAMSLQGVSTEELALDSGQHVAESLNSISGVLIDQLSGGQGHKAAIRMPMNTSGYYLYLQDNIPLQSPAFFNHNALWWSSFNSNIATMEVLKGAGTALYGSGAVAATVNILSKEVAGSDQTDMGLILGQDDYAKVQFSHSSILSGTQGIRVSASYLTNDGWRDHTGSERAELTLRHELELENNERLVTSLVISDLEQEMAGNLTQALYDNDKTNSGLSDEVLASDPLRKTKYMRLSSHWDKTTDSSYFSLIPYYRYRTNDYTATWNKNMPKVESEVHTLGLLALANFEHDGDSDTSVGLDIELTEGDQLSYQPLDYTSTGYRADTFIKGERFYDDTTQYLSLSPYIQHKRELTENLDLTLGARYDYGQYDFNNHLGVYGDIGHGKRSVEDRTDNFNHISPKASLNYHLSQDSSLYLRYANSFRLPTASSLYHLTIKDDGNAEAVDPEISDTYELGFKANWQSISLDTAVYYMDVDDGIVRAYNDAGQRYLTNAARVIHQGVEVSVAWKINEQLNLSTAYSRSHHEFDQHEAYSGNEMAAAPEHIANVRLRYKPEFIQGLTSMLEIQSVGEYWLDDANSQDDEGIDRIEDGYTIANIKALYQFSKQLSFNARVLNITDEEYAQEASYRYNKTFYSPGAPRTAYIGVNYQW

SEQ ID NO: 18528 - protein, 344 aa, Haemophilus gallinarum
MKKTAIALAIAGLTAASVAQAAPQANTFYAGAKAGWASFHDGLNQFENSQNADGTLRNSVTYGVFGGYQITDNFAVELGYDDFGRAKLRQGGETVIKYTNHGAHLSLKASYPVLEGLDVYARVGAALIRSDYKPTKRAAPNQTHEHSLKVSPVFAGGLEYNLPSLPELALRVEYQWVNKVGRVEKDGSRVDYTPSIGSVTAGLSYRFGQSAPVVEPKVVAKTFALNSDVTFAFGKANLRPEAQNVLDGIYGEIAQLKSVQVDVAGYTDRIGSEAANLKLSQRRADTVANYLVSKGVAQEVISSTGYGEANPVTGAKCDTVKGRKALIACLADDRRVEISVKGEE

SEQ ID NO: 18529 - protein, 1384 aa, Salmonella bongori
MNKIYALKYSVRQGALVPVSELATHAKKSSRTGLIKRLIPSVIINTLLLGYSVTSLASVVRYDIPYQTIRDFAENKGQFTPGSMNIPVYSKTGTVIGYLNNAPMPDFSSANHQSAVATLVSPQYIMSVKHNGGYQSVSFGDGENGYRLVDRNNQPGRDFHAPRLNKLVTEVEPSLMTQSGMVSGAYSDKNRYPAFYRVGSGTQEIKETDGHIISISGAYSYLTGGTAGAPGSYNQGQMISTNTNKELYSLAQGPMGTHPRVGDSGSPLFAYDSVLQKWVIVGVDSSGGGGGTNWAVVDANFVNQAIQDDTDALVTFMADQGPLRWAFNSTDGTGTLIQQETVYQMHGQKGTDLNEGKNLVFNGADGQIALEDAVNQGAGALAFNGNYTVFTTNGSTWRGAGLDITQDAEVSWQVNGVQGDNLHKIGEGVLKVNGTGINPGGLKVGDGTVILAQRPDEDGKVQAFSSVNIASGRPTVILTDSRQVNSDNISWGFRGGRLDINGNDVTFHKINAADNGANIINTSDTFATVSIKPLTDMTVTINDWDKNKPSGGAAGLLYKYNNIYTHTVDYFIQKRKGYGYYPVNQSDNDSWEYVGHNEMQAIERVKSRRPIDDRIYHGNIVGNIHLNIDTSHSNGGVIFDGNIDTPDGELMQSGGQLTFQGHPVIHAYNGKWLTDKLKSLGDDSVRNQPTSFDQPDWENRTFHLKTLVLKNTYFGLARNASLNGNIEAVHSSVTLGTPNLYIDLNDGNGTKVTPQKGISVAGQESDMSRYAGKVTLSEQSTLDVREIFTGSIQSQDSDVTVSSRHAKLDDYSRFGNTSLTLQEGARLTATGGWWSDSDVIVGPAATLSLTGTPAASLPGQMSPAFYSTNYGAGYQLGAASELQFSPYTFVTGDIRAAGDARIAIGSSDNVVLADNLPLEEQMMYGLFNGFRNVYSGNVSAPQGRMAMTDTQWQMPGDSRIGALRMTRSLAGFTGRGFHTLATDTLQANQSAFALRTDLKDSDKIVVNQNAEGRDNTLFVNFLKKPSGKESLNIPLVSAPAGTSPTMFKAAERVTGFSLVTPTLHTTEQDGKIQWILDGFKTAPDKGTATSANSFMGMGYKNFMTEVNNLTKRMGDLRDTQGEDGMWVRIMNGAGTGDAGYSDRYTHLQTGFDKKHRLPGADLFTGVLMSYTDSSASGRAYSGDTHSLGGGLYASVMFDSGAYMDVIGKYIHHDNDYNAGFAGLGKRNYGTHSWYAGLEGGYRYHLTESLYIEPQAELVYGTVSGTTLKWNDNGMDVSMRSKTYNPLIGRTGVALGKTFSGKDWSVTAHTGVDYQFDLVTNGEKALRDASGEKRFTGDKDSRMLYNVGLNAQVKDNVRFGLELEQSAFGKYNVDHAINANFRYMF

SEQ ID NO: 18530 - protein, 357 aa, Pasteurella multocida
MKKTIVALAVAAVAATSANAATVYNQDGTKVDVNGSVRLILKKEKNERGDLVDNGSRVSFKASHDLGEGLSALAYTELRFSKNVTKQKKTKAGKDKNYDVERLGNNVHVKRLYAGFAYEGLGTLTFGNQLTIGDNVGVSDYTYFLGGINNLLSSGEKAINGFTFGGAYVFSDDADKQALRFKSAEFNNGRGFVVAGLYNRKMGDVGFALEAGYSQKYVKQKVEQPQPLPPGQVERFKDEKEKAFMVGTELSYAGLALGVDYAHTVTNKEKVEGKKRALEVGLNYDINDKAKVYTDLIWAKESSKGVTTRDSSILLGAGYKLHKKVETFVEGGWSRKKAAVGVTTKDNKVGVGLRVHF

SEQ ID NO: 18531 - protein, 184 aa, Wolbachia endosymbiont
RLQYNGEILPFYTKVDGITNATGKEKDSPLTRSFIAGGGAFGYKMDDIRVDVEGLYSQLAKDTAVVNTSETNVADSLTAFSGLVNVYYDIAIEDMPITPYVGVGVGAAYISNPSKASAVKDQKGFGFAYQAKAGVSYDVTPEIKLYAGARYFGSYGASFNKETVSATKEINVLYSAVGAEAGVA

SEQ ID NO: 18532 - protein, 179 aa, Neisseria gonorrhoeae
GLKGGFGTIRAGSLNSPLKNTGANVNAWESSKFTGNVLEISGMAQREHRYLSVRYDSPEFAGFSGSVQYAPKDNSGSNGESYHVGLNYRNSGFFAQYAGLFQRYGEGTKKIEYNDQAYSIPSLFVEKLQVHRLVGGYDNNALYVSVAAQQQDAKLYGAMSGNSHNSQTEVAATAAYRFG

SEQ ID NO: 18533 - protein, 179 aa, Neisseria gonorrhoeae
GLKGGFGTIRAGSLNSPLKNTGANVNAWESSKFTGNVLEISGMAQREHRYLSVRYDSPEFAGFSGSVQYAPKDNSGLNGESYHVGLNYRNSGFFAQYAGLFQRYGEGTKKIEYNDQAYSIPSLFVEKLQVHRLVGGYDNNALYVSVAAQQQDAKLYGAMSGNSHNSQTEVAATAAYRFG

SEQ ID NO: 18534 - protein, 179 aa, Neisseria gonorrhoeae
GLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYGDQAYSMPSLFVEKLQVHRLVGGYDNNALYVSVAAQQQDAKLYGAKRANSHNSQTEVAATAAYRFG

SEQ ID NO: 18535 - protein, 179 aa, Neisseria gonorrhoeae
GLKGGFGTIRAGSLNSPLKNTDANVNAWESGKFTGNVLEISGMAQREHRYLSVRYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYQNQIVRDNSHNSQTEVAATVAYRFG

SEQ ID NO: 18536 - protein, 179 aa, Neisseria gonorrhoeae
GLKGGFGTIRAGSLNSPLKNTDANVNAWESGKFTGNVLKISGMAQREHRYLSARYDSPEFAGFSGSVQYAPKDNSGSNGESYHVGLNYRNNGFFAQYAGLFQRYGEGTKKMEGYTYNIPSLFVEKLQVHRLVGGYDNNALYASVAAQQQDAKLYQNQIVRDNSHNSQTEVAATVAYRFG

SEQ ID NO: 18537 - protein, 179 aa, Neisseria gonorrhoeae
GLKGGFGTIRAGSLNSPLKNTGANVNAWESGKYTGEFLEISKMAQREHRYLSVRYDSPEFAGFSGSVQYAPKDNSGSNGESYHVGLNYRNNGFFAQYAGLFQRYGEGTKKIEYEYQFYSIPSLLVEKLQVHRLVGGYDNNALYVSVAAQQQDAKLYGAKKANSHNSQTEVAATAAYRFG

SEQ ID NO: 18538 - protein, 179 aa, Neisseria gonorrhoeae
GLKGGFGTIRAGSLNSPLKNTDANVNAWESGKFTGNVLEISGMAQREHRYLSVRYDSPEFAGFSGSVQYAPKDNSGSNGESYHVGLNYRNNGFFAQYAGLFQRYGEGTKKMEGYTYNIPSLLVEKLQVHRLVGGYDNNALYASVAAQQQDAKLYQNQIVRDNSHNSQTEVAATVAYRFG

SEQ ID NO: 18539 - protein, 177 aa, Neisseria gonorrhoeae
GLKGGFGTIRAGSLNSPLKNTNANVNAWESGKFTGNVLEISGMAKREHRYLSVRYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYGAWRANSHNSQTEVAATAAYRFG

SEQ ID NO: 18540 - protein, 179 aa, Neisseria gonorrhoeae
GLKGGFGTIRAGSLNSPLKNTKDNVNAWESGKFTGNVLEISGMAQREHRYLSARYDSPEFAGFSGSVQYAPKDNSGSNGESYHVGLNYRNNGFFAQYAGLFQRYGEGTKKMERYAYNIPSLFVEKLQVHRLVGGYDNNALYASVAAQQQDAKLYQNQIVRDNSHNSQTEVAATVAYRFG

SEQ ID NO: 18541 - protein, 179 aa, Neisseria gonorrhoeae
GLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYDSQYYSIPSLFVEKLQVHRLVGGYDNNALYASVAAQQQDAKLYGTWRANSHNSQTEVAATAAYRFG

SEQ ID NO: 18542 - protein, 179 aa, Neisseria gonorrhoeae
GLKGGFGTIRAGSLNSPLKNTNDNVNAWESGKFTGNVLEISGMAKREHRYLSVRYDSPEFAGFSGSVQYAPKDNSGSNGESYHVGLNYQNSGFFAQYAGLFQRYGEGTKKIEYDGQAYSMPSLFVEKLQVHRLVGGYDNNALYVSVAAQQQDAKLYGATRVNSHNSQTEVAATAAYRFG

SEQ ID NO: 18543 - protein, 179 aa, Neisseria gonorrhoeae
GLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYDGQAYSMPSLFVEKLQVHRLVGGYDNNALYVSVAAQQQDAKLYGATRVNSHNSQTEVAATAAYRFG

SEQ ID NO: 18544 - protein, 179 aa, Neisseria gonorrhoeae
GLKGGFGTIRAGSLNSPLKNTGANVGAWESGKFTGNVLKISGMAQREHRYLSARYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYQNQIVRDNSHNSQTEVAATVAYRFG

SEQ ID NO: 18545 - protein, 179 aa, Neisseria gonorrhoeae
GLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGFFQRYGEGTKKIEYDNQTYSIPSLFVEKLQVHRLVGGYDNNALYASVAAQQQDAKLYGTWRANSHNSQTEVAATAAYRFG

SEQ ID NO: 18546 - protein, 179 aa, Neisseria gonorrhoeae
GLKGGFGTIRAGSLNSPLKNTKDNVNAWESGKFTGNVLEISGMAQREHRYLSVRYDSPEFAGFSGSVQYAPKDNSGSNGESYHVGLNYQNSGFFAQYAGLFQRYGEGTKKIEYDGHAYSMPSLFVEKLQVHRLVGGYDNNALYVSVAAQQQDAKLYGATRVNSHNSQTEVAATAAYRFG

SEQ ID NO: 18547 - protein, 179 aa, Neisseria gonorrhoeae
GLKGGFGTIRVGSLNSPLKNTGANVNAWESGKYTGEFLEISKMARREHRYLSARYDSPEFAGFSGSVQYAPKDNSGSNGESYHVGLNYRNGGFFAQYAGLFQRYGEGTKKIEYDSQYYSVPSLLVEKLQVHRLVGGYDNNALYASVAAQQQDAKLYGTWRANSHNSQTEVAATAAYRFG

SEQ ID NO: 18548 - protein, 179 aa, Neisseria gonorrhoeae
GLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYSDQAYSMPSLFVEKLQVHRLVGGYDNNALYVSVAAQQQDAKLYGARRANSHNSQTEVAATAAYRFG

SEQ ID NO: 18549 - protein, 179 aa, Neisseria gonorrhoeae
GLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYSDQAYSMPSLFVEKLQVHRLVGGYDNNALYVSVAAQQQDAKLYGAKRANSHNSQTEVAATAAYRFG

SEQ ID NO: 18550 - protein, 181 aa, Neisseria gonorrhoeae
GLKGGFGTIRVGSLNSPLKNTGANVNAWESGKYTGEFLEISKMAEREHRYLSARYDSPEFAGFSGSVQYAPKDNSGSNGESYHVGLNYRNGGFFAQYAGLFQRYGEGTKKIEYDNQFYSIPSLFVEKLQVHRLVGGYDNNALYASVAAQQQDAKLYQNQIVRDNSHNSQTEVAATVAYRFG

SEQ ID NO: 18551 - protein, 179 aa, Neisseria gonorrhoeae
GLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQTYSMPSLFVEKLQVHRLVGGYDNNALYVSVAAQQQDAKLYGAKRANSHNSQTEVAATAAYRFG

SEQ ID NO: 18552 - protein, 179 aa, Neisseria gonorrhoeae
GLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYDSLYYSIPSLFVEKLQVHRLVGGYDNNALYASVAAQQQDAKLYGTWRANSHNSQTEVAATAAYRFG

SEQ ID NO: 18553 - protein, 179 aa, Neisseria gonorrhoeae
GLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQAYSIPTLFVEKLQVHRLVGGYDNNALYVSVAAQQQDAKLYGAMSGNSHNSQTEVAATAAYRFG

SEQ ID NO: 18554 - protein, 179 aa, Neisseria gonorrhoeae
GLKGGFGTIRVGSLNSPLKNTGANVNAWESGKYTGEFLEISKMAEREHRYLSARYDSPEFAGFSGSVQYAPKDNSGSNGESYHVGLNYRNGGFFAQYAGLFQRYGEGTKKIEYDNQFYSIPSLFVEKLQVHRLVGGYDNNALYASVAAQQQDAKLYGTWRANSHNSQTEVAATAAYRFG

SEQ ID NO: 18555 - protein, 185 aa, Neisseria gonorrhoeae
GLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQAYSMPRAYSMPSLFVEKLQVHRLVGGYDNNALYVSVAAQQQDAKLYGAKRANSHNSQTEVAATAAYRFG

SEQ ID NO: 18556 - protein, 179 aa, Neisseria gonorrhoeae
GLKGGFGTIRVGSLNSPLKNTGANVNAWESGKYTGEFLEISKMARREHRYLSARYDSPEFAGFSGSVQYAPKDNSGSNGESYHVGLNYRNGGFFAQYAGLFQRYGEGTKKIEYDSQYYSIPSLFVEKLQVHRLVGGYDNNALYASVAAQQQDAKLYGTWGANSHNSQTEVAATAAYRFG

SEQ ID NO: 18557 - protein, 179 aa, Neisseria gonorrhoeae
GLKGGFGTIRAGSLNSPLKNTGSKVNAWESGKFTGNVLEISGMAEREHRYLSARYDSPEFAGFSGSVQYAPKDNSGSNGESYHVGLNYQNSGFFAQYAGLFQRYGEGTKKMEGYAYNIPSLFVEKLQVHRLVGGYDNNALYASVAAQQQDAKLYQNQIVRDNSHNSQTEVAATVAYRFG

SEQ ID NO: 18558 - protein, 179 aa, Neisseria gonorrhoeae
GLKGGFGTIRAGSLNSPLKNTKDNVNAWESGKFTGNVLEISGMAQREHRYLSVRYDSPEFAGFSGSVQYAPKDNSGSNGESYHVGLNYRNGGFFAQYAGLFQRYGEGTKKIEYDNLFYSVPSLFVEKLQVHRLVGGYDNNALYASVAAQQQDAKLYGTWRANSHNSQTEVAATAAYRFG

SEQ ID NO: 18559 - protein, 179 aa, Neisseria gonorrhoeae
GLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYDSQYYSVPSLFVEKLQVHRLVGGYDNNALYASVAAQQQDAKLYGTWRANSHNSQTEVAATAAYRFG

SEQ ID NO: 18560 - protein, 179 aa, Neisseria gonorrhoeae
GLKGGFGTIRVGSLNSPLKNTGANVNAWESGKYTGEFLEISKMARREHRYLSARYDSPEFAGFSGSVQYAPKDNSGSNGESYHVGLNYRNGGFFAQYAGLFQRYGEGTKKIEYDSQYYSIPSLFVEKLQVHRLVGGYDNNALYASVAAQQQDAKLYGTRGANSHNSQTEVAATAAYRFG

SEQ ID NO: 18561 - protein, 179 aa, Neisseria gonorrhoeae
GLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYGDQAYSMSSLFVEKLQVHRLVGGYDNNALYVSVAAQQQDAKLYGAKRANSHNSQTEVAATAAYRFG

SEQ ID NO: 18562 - protein, 179 aa, Neisseria gonorrhoeae
GLKGGFGTIRAGSLNSPLKNTGANVNAWESGKYTGEFLEISKMAQREHRYLSVRYDSPEFAGFSGSVQYAPKDNSGSNGESYHVGLNYRNNGFFAQYAGLFQRYGEGTKKIEYEYQVYSIPSLFVEKLQVHRLVGGYDNNALYVSVAAQQQDAKLYGAKRANSHNSQTEVAATAAYRFG

SEQ ID NO: 18563 - protein, 179 aa, Neisseria gonorrhoeae
GLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQNYSMPSLFVEKLQVHRLVGGYDNNALYVSVAAQQQDAKLYGAMSGNSHNSQTEVAATAAYRFG

SEQ ID NO: 18564 - protein, 179 aa, Neisseria gonorrhoeae
GLKGGFGTIRAGSLNSPLKNTGANVNAWESGKFTGNVLEISGMAQREHRYLSVRYDSPEFAGFSGSVQYAPKDNSGSNGESYHVGLNYRNSGFFAQYAGLFQRYGEGTKKIEYNDQAYSIPSLFVEKLQVHRLVGGYDNNALYVSVAAQQQDAKLYGAMSGNSHNSQTEVAATAAYRFG

SEQ ID NO: 18565 - protein, 179 aa, Neisseria gonorrhoeae
GLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQAYSMPSLFVEKLQVHRLVGGYDNNALYVSVAAQQQDAKLYGAKRANSHNSQTEVAATAAYRFG

SEQ ID NO: 18566 - protein, 179 aa, Neisseria gonorrhoeae
GLKGGFGTIRAGSLNSPLKNTKDNVNAWESGKFTGNVLEISGMAQREHRYLSVRYDSPEFAGFSGSVQYAPKDNSGSNGESYHVGLNYQNSGFFAQYAGLFQRYGEGTKKIEYDGQAYSMPSLFVEKLQVHRLVGGYDNNALYVSVAAQQQDAKLYGAKRANSHNSQTEVAATAAYRFG

SEQ ID NO: 18567 - protein, 179 aa, Neisseria gonorrhoeae
GLKGGFGTIRVGSLNSPLKNTGANVNAWESGKYTGEFLEISKMARREHRYLSARYDSPEFAGFSGSVQYAPKDNSGSNGESYHVGLNYRNGGFFAQYAGLFQRYGEGTKKIEYDSQYYSIPSLFVEKLQVHRLVGGYDNNALYASVAAQQQDAKLYGTWSANSHNSQTEVAATAAYRFG

SEQ ID NO: 18568 - protein, 179 aa, Neisseria gonorrhoeae
GLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQDYSMPSLFVEKLQVHRLVGGYDNNALYVSVAAQQQDAKLYGAMSGNSHNSQTEVAATAAYRFG

SEQ ID NO: 18569 - protein, 179 aa, Neisseria gonorrhoeae
GLKGGFGTIRVGSLNSPLKNTGANVNAWESGKYTGEFLEISKMAEREHRYLSARYDSPEFAGFSGSVQYAPKDNSGSNGESYHVGLNYRNGGFFAQYAGLFQRYGEGTKKIEYDNQFYSIPSLFVEKLQVHRLVGGYDNNALYASVAAQQQDAKLYGTWHANSHNSQTEVAATAAYRFG

SEQ ID NO: 18570 - protein, 179 aa, Neisseria gonorrhoeae
GLKGGFGTIRVGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDGQAYSMPSLFVEKLQVHRLVGGYDNNALYVSVAAQQQDAKLYGATRVNSHNSQTEVAATAAYRFG

SEQ ID NO: 18571 - protein, 179 aa, Neisseria gonorrhoeae
GLKGGFGTIRAGSLNSPLKNTGSKVNAWESGKYTGEFLEISKMAEREHRYLSARYDSPEFAGFSGSVQYAPKDNSGSNGESYHVGLNYRNNGFFAQYAGLFQRYGEGTKKMEGYSYNIPSLFVEKLQVHRLVGGYDNNALYASVAAQQQDAKLYQNQLVRDNSHNSQTEVAASVAYRFG

SEQ ID NO: 18572 - protein, 179 aa, Neisseria gonorrhoeae
GLKGGFGTIRAGSLNSPLKNTGANVNAWESGKYTGEFLEISKMAQREHRYLSVRYDSPEFAGFSGSVQYAPKDNSGSNGESYHVGLNYRNNGFFAQYAGLFQRYGEGTKKVEGYAYNIPSLFVEKLQVHRLVGGYDNNALYASVAAQQQDAKLYQNQIVRDNSHNSQTEVAATVAYRFG

SEQ ID NO: 18573 - protein, 179 aa, Neisseria gonorrhoeae
GLKGGFGTIRAGSLNSPLKNTDANVNAWESGKFTGNVLEISKMAEREHRYLSARYDSPEFAGFSGSVQYAPKDNSGSNGESYHVGLNYQNSGFFAQYAGLFQRYGEGTKKMEGYLYNIPSLFVEKLQVHRLVGGYDNNALYASVAVQQQDAKLYQNQLVRDNSHNSQTEVAATAAYRFG

SEQ ID NO: 18574 - protein, 179 aa, Neisseria gonorrhoeae
GLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDRTYSMPSLFVEKLQVHRLVGGYDNNALYVSVAAQQQDAKLYGATRVNSHNSQTEVAATAAYRFG

SEQ ID NO: 18575 - protein, 179 aa, Neisseria gonorrhoeae
GLKGGFGTIRAGSLNSPLKNTKDNVNAWESGKFTGNVLEISGMAQREHRYLSVRYDSPEFAGFSGSVQYAPKDNSGSNGESYHVGLNYQNSGFFAQYAGLFQRYGEGTKKIEYEHQAYSIPSLFVEKLQVHRLVGGYDNNALYVSVAAQQQDAKLYGARRANSHNSQTEVAATAAYRFG

SEQ ID NO: 18576 - protein, 176 aa, Neisseria gonorrhoeae
GLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKIEYVYSIPSLFVEKLQVHRLVGGYDNNALYVSVAAQQQDAKLYGARRANSHNSQTEVAATAAYRFG

SEQ ID NO: 18577 - protein, 179 aa, Neisseria gonorrhoeae
GLKGGFGTIRAGSLNSPLKNTDANVNAWESGKFTGNVLEISGMAQREHRYLSVRYDSPEFAGFSGSVQYAPKDNSGSNGESYHVGLNYQNSGFFAQYAGLFQRYGEGTKKIEYDGQAYSMPSLFVEKLQVHRLVGGYDNNALYVSVAAQQQDAKLYGARRANSHNSQTEVAATAAYRFG

SEQ ID NO: 18578 - protein, 179 aa, Neisseria gonorrhoeae
GLKGGFGTIRAGSLNSPLKNTDDNVNAWESGKFTGNVLEISGMTKREHRYLSVRYDSPEFAGFSGSVQYAPKDNSGSNGESYHVGLNYQNSGFFAQYAGLFQRYGEGTKKIEYEHQVYSIPSLFVEKLQVHRLVGGYDNNALYVSVAAQQQDAKLYGARRANSHNSQTEVAATAAYRFG

SEQ ID NO: 18579 - protein, 178 aa, Neisseria gonorrhoeae
GLKGGFGTIRAGSLNSPLKNTRDNVNAWESGKFTGNVLEISGMAQREHRYLSARYDSPEFAGFSGSVQYAPKDNSGSNGESYHVGLNYQNSGFFAQYAGLFQRYGEGTKKMEGYYLYNIPSLFVEKLQVHRLVGGYDNNALYASVAAQQQDAKLYGTWSANSHNSQTEVAATVAYRFG

SEQ ID NO: 18580 - protein, 179 aa, Neisseria gonorrhoeae
GLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEDDSQYYSIPSLFVEKLQVHRLVGGYDNNALYASVAAQQQDAKLYGTWRANSHNSQTEVAATAAYRFG

SEQ ID NO: 18581 - protein, 179 aa, Neisseria gonorrhoeae
GLKGGFGTIRAGSLNSPLKNTDANVNAWESGKFTGNVLEISGMAQREHRYLSVRYDSPEFAGFSGSVQYAPKDNSGSNGESYHVGLNYRNNGFFAQYAGLFQRYGEGTKKVEGYAYNIPSLFVEKLQVHRLVGGYDNNALYASVAAQQQDAKLYQNQIMRDNSHNSQTEVAATVAYRFG

SEQ ID NO: 18582 - protein, 179 aa, Neisseria gonorrhoeae
GLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQAYSMPSLFVEKLQVHRLVGGYDNNALYVSVAAQQQDAKLYGAMSGNSHNSQTEVAATAAYRFG

SEQ ID NO: 18583 - protein, 179 aa, Neisseria gonorrhoeae
GLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDGQAYSMPSLFVEKLQVHRLVGGYDNNALYVSVAAQQQDAKLYGAKRANSHNSQTEVAATAAYRFG

SEQ ID NO: 18584 - protein, 179 aa, Neisseria gonorrhoeae
GLKGGFGTIRAGSLNSPLKNTGANVNAWESGKFTGNVLEISGMAQREHRYLSVRYDSPEFAGFSGSVQYAPKDNSGSNGESYHVGLNYRNNGFFAQYAGLFQRYGEGTKKMEGFSYNIPSLFVEKLQVHRLVGGYDNNALYASVAAQQQDAKLYQNQLVRDNSHNSQTEVAATVAYRFG

SEQ ID NO: 18585 - protein, 179 aa, Neisseria gonorrhoeae
GLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYDNQFYSIPSLFVEKLQVHRLVGGYDNNALYASVAAQQQDAKLYRTWHANSHNSQTEVAATAAYRFG

SEQ ID NO: 18586 - protein, 158 aa, Neisseria gonorrhoeae
GLKGGFGKVRVGRLNNILKDTNGFNPWEGKNYYLGLSNIAQPEERHVSVRYDSPEFAGFSGSVQYVPNDNSGKNHSESYHAGFNYKNSGFFVQYAGSYKRHNFTTEKHQVHRLVGGYDHDALYASVAVQQQDAKLAWSDDNSHNSQTEVAATAAYRFG

SEQ ID NO: 18587 - protein, 179 aa, Neisseria gonorrhoeae
GLKGGFGTIRAGSLNSPLKNTDANVNAWESGKFTGNVLEISGMAKREHRYLSVRYDSPEFAGFSGSVQYAPKDNSGSNGESYHVGLNYQNSGFFAQYAGLFQRYGEGTKKIEYDGQAYSIPSLFVEKLQVHRLVGGYDNNALYVSVAAQQQDAKLYGATRVNSHNSQTEVAATAAYRFG

SEQ ID NO: 18588 - protein, 179 aa, Neisseria gonorrhoeae
GLKGGFGTIRVGSLNSPLKNTGANVNAWESGKYTGEFLEISKMAEREHRYLSARYDSPEFAGFSGSVQYAPKDNSGSNGESYHVGLNYRNGGFFAQYAGLFQRYGEGTKKIEYDNQFYSIPSLFVEKLQVHRLVGGYDNNALYVSVAAQQQDAKLYGTWRANSHNSQTEVAATAAYRFG

SEQ ID NO: 18589 - protein, 179 aa, Neisseria gonorrhoeae
GLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQDYSTPSLFVEKLQVHRLVGGYDNNALYVSVAAQQQDAKLYGATRVNSHNSQTEVAATAAYRFG

SEQ ID NO: 18590 - protein, 179 aa, Neisseria gonorrhoeae
GLKGGFGTIRAGSLNSPLKNTDANVNAWESGKFTGNVLEISGMAQREHRYLSVRYDSPEFAGFSGSVQYAPKDNSGSNGESYHVGLNYRNSGFFAQYAGLFQRYGEGTKKIEYEHQVYSIPSLFVEKLQVHRLVGGYDNNALYVSVAAQQQDAKLYGARRDNSHNSQTEVAATAAYRFG

SEQ ID NO: 18591 - protein, 179 aa, Neisseria gonorrhoeae
GLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYGSQHYSIPSLFVEKLQVHRLVGGYDNNALYASVAAQQQDAKLYGTWRANSHNSQTEVVATAAYRFG

SEQ ID NO: 18592 - protein, 179 aa, Neisseria gonorrhoeae
GLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDGQAYSIPTLFVEKLQVHRLVGGYDNNALYVSVAAQQQDAKLYGAMSGNSHNSQTEVAATVAYRFG

SEQ ID NO: 18593 - protein, 181 aa, Neisseria gonorrhoeae
GLKGGFGTIRAGSLNSPLKNTGSKVNAWESGKHTGELLEISKMAEREHRYLSARYDSPEFAGFSGSVQYAPKDNSGSNGESYHVGLNYRNNGFFAQYAGLFQRYGEGTKKMEGYSYTYNIPSLFVEKLQVHRLVGGYDNNALYASVAAQQQDAKLYQNQLVRDNSHNSQTEVAATVAYRFG

SEQ ID NO: 18594 - protein, 179 aa, Neisseria gonorrhoeae
GLKGGFGTIRVGSLNSPLKNTGANVNAWESGKYTGEFLEISKMAEREHRYLSARYDSPEFAGFSGSVQYAPKDNSGSNGESYHVGLNYRNGGFFAQYAGLFQRYGEGTKKIEYDNQFYSIPSLLVEKLQVHRLVGGYDNNALYASVAAQQQDAKLYGTWHANSHNSQTEVAATVAYRFG

SEQ ID NO: 18595 - protein, 177 aa, Neisseria gonorrhoeae
GLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKMEEYTYNIPSLFVEKLQVHRLVGGYDNNALYASVAAQQQDAKLYGTRRANSHNSQTEVAATVAYRFG

SEQ ID NO: 18596 - protein, 179 aa, Neisseria gonorrhoeae
GLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYDSQYYSIPSLFVEKLQVHRLVGGYDNNALYASVAAQQQDAKLYGTRRANSHNSQTEVAATAAYRFG

SEQ ID NO: 18597 - protein, 179 aa, Neisseria gonorrhoeae
GLKGGFGTIRVGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYNGQAYSMPSLFVEKLQVHRLVGGYDNNALYVSVAAQQQDAKLYGATRVNSHNSQTEVAATAAYRFG

SEQ ID NO: 18598 - protein, 179 aa, Neisseria gonorrhoeae
GLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYDSQYYSIPSLFVEKLQVHRLVGGYDNNALYASVAAQQQDAKLYGTWHANSHNSQTEVAATAAYRFG

SEQ ID NO: 18599 - protein, 159 aa, Neisseria gonorrhoeae
IGLKGGFGKVRVGRLNSVLKDTGGFNPWEGKSEYLSLSNIARPEERPISVRYDSPEFAGFSGSVQYVPNDNSGENKSESYHAGFNYKNSGFFVQYAGSYKRHNYTTEKHQIHRLVGGYDHDALYASVAVQQQDAKLAWPDDNSHNSQTEVAATVAYRFG

SEQ ID NO: 18600 - protein, 159 aa, Neisseria gonorrhoeae
IGLKGGFGKVRVGRLNSVLKDTGGFNPWEGKSYYLGLSNIVQPEERHVSVRYDSPEFAGFSGSVQYVPNDNSDKNRSESYHAGFNYKNSGFFVQYAGSYKRHNFTTEKHQVHRLVGGYDHDALYASVAVQQQDAKLTWRNDNSHNSQTEVAATAAYRFG

SEQ ID NO: 18601 - protein, 230 aa, Neisseria gonorrhoeae
IGKDHYFSIKRATQSMNSQDTVSLTAAGRYKGFDALIVHTERNSNEMKNYGYESYDDKVVGIKREKTDPYSISRHSTLVKLGFEPTENHRFSVAVDKSTLKTDGQDLSHSLRPSQYVNTEIKQGERFIHDKSKRENIQFSYENFTQTPFWDHFKLTYSSQKIKNKARSDEYCAFTNCASVLNPQGLHLDDSNGVYKILDKDNKELTGESDGGIEHIKILKVKMSVLVSAL

SEQ ID NO: 18602 - protein, 159 aa, Neisseria gonorrhoeae
IGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLAWSNDNSHNSQTEVAATAAYRFG

SEQ ID NO: 18603 - protein, 159 aa, Neisseria gonorrhoeae
IGLKGGFGKVRVGRLNNILKDTGGFNPWEGKSYYSGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWRDDNSHNSQTEVATTVAYRFG

SEQ ID NO: 18604 - protein, 159 aa, Neisseria gonorrhoeae
IGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATAAYRFG

SEQ ID NO: 18605 - protein, 159 aa, Neisseria gonorrhoeae
IGLKGGFGKVRVGRLNSVLKDTGGFNPWEGKSDYLSLSNIAEPEARHISVRYDSPEFAGFSGSVQYELNDNSNKYNSESYHAGFNYKNSGFFVQYAGAYKRHHYATEKHQVHRLVGGYDHDALYASVAVQQQDAKLALIDDNSHNSQTEVAATVAYRFG

SEQ ID NO: 18606 - protein, 658 aa, Vibrio fluvialis
MYNKSILSASILIALSQGAYAEDHSTFNEVVVTATRTNSQIEDTAASVAVVTDKNIEESMVTGLDDLFEYTPGVTVKTNSRQGVQSINIRGIEGNRIKVLVDGVSQGNQFESGNTFINSARVNVDTDLIKAVEIVKGAASSLHGSDAIGGIVAFETKDPADFLKSRNFGGHAKFNYSSEDNTFSESVALANKTGDLESLVAYTRRDGNELDNFGDLADASTEANNLLVKLQYQVNDAHRVEFNGNYIRNKGNGKQSYNGYTNATSEDVTEQYQVGIKHIWEMQTALADSLTWQLDWLSKEENGITDRVKGQNIQRKDYIYEDEGYQFDSQFDKYLSLGSTEHYFVYGASFSDKDIKNVNKEYNSASANKEIFYIPSASERRYGLFLQDEITIGNFTITPGVRWDAFETDPGDTSSNPSGNAASDYKKFSDSAFTGRLGSVYKLNEQHRLFAQISQGFRAPDFQELYYSFGNPMHGYIFKPNPDLKAEDSISYEFGWRHNNDISSSEVSVFYSDYDNFIESKTVSGTWTPVTDPAIQQYVNIGKATIKGIEFSNQLSWNKFMPIEGFSSRVAAAYTEGEDGNNNPLNSVNPWNLVAGFNYDSEQNWGTTLTINYTASKDKSDINDDKVLPISAATVVDITAYYKPIKDLTLRAGLSRDR

SEQ ID NO: 18607 - protein, 176 aa, Wolbachia pipientis
EETSYYVRLQYNGEFLPLYTKVDGITGAKKDSKETKDLYAASFKAVGGAFGYKMDDIRVDIELLYSQLGKDKDVTGANPEIASDLMAASALANVYYDIAIEDMPITPYVGVGVGVAGVSTPLNTVVSEQKYKFGVAGQVKAGVSYDVTPEIKLFAGARYFGSWGANFDKDATTGKD

SEQ ID NO: 18608 - protein, 230 aa, Wolbachia pipientis
YYVQQHVDKDSRIKVHNLKPSLLLGAGLEYAITPELAARVEYQYLNRVGNLDKAVRTTVGYLIPRGTNFQYSPDIHSVSAGLSYRFGQGAAPVEAPEVVTKNFAFSSDVLFDFGKSSLKPAAATSLDAAHAEISNLGLANLAIQVNGYTDRIGKEASNLKLSQRRAETVANYIVSKGTNPANVTAVGYGEANPVTGHTCDAVKGRKALIACLAPDRRVEIQVQGSKEVTM

SEQ ID NO: 18609 - protein, 282 aa, Anaplasma phagocytophilum
MNYRELLVGSLSAAAVCACSLLISGSSFAYSGNNDASDVSGVMNGSFYVSGSYSPSFPSISSFAISESDRGGSYVKGYNKNLSTLNVSDPASFTQHDPSFKFAKSLLTSFDGATGYAIGGARVEVEVGYKKFETLAESDYKHVESHNFVAVGRDATLTPDNFFVMKIDSVKDISVMLNACYDVMHTDLPVSPYMCAGLGASFINIADHVTSKLAYSGKVGVSYKLTPEISLIAGGFYHGIFDEQYAGIPASNRVNIAGGAAAKVKANIASYGFNIGARFAFN

SEQ ID NO: 18610 - protein, 282 aa, Anaplasma phagocytophilum
MNYRELLVGSLSAAAVCACSLLISGSSFAYSGNNDASDVSGVMNGSFYVSGSYSPSFPSISSFAISESDRGGSYVKGYNKNLSTLNVSDPASFTQHEPSFKFAKSLLTSFDGATGYAIGGARVEVEVGYKKFETLAESDYKHVESHNFVAVGRDATLTPDNFFVMKIDSVKDISVMLNACYDVMHTDLPVSPYMCAGLGASFINIADHVTSKLAYRGKVGVSYKLTPEISLIAGGFYHGIFDEQYAGIPASNRVNIAGGAAAKVKANIASYGFNIGARFAFN

SEQ ID NO: 18611 - protein, 282 aa, Anaplasma phagocytophilum
MNYRELLVGSLSAAAVCACSLLISGSSFAYSGNNDASDVSGVMNGSFYVSGSYSPSFPSISSFAISESDRGGSYVKGYNKNLSTLNVSDPASFTQHDPSFKFAKSLLTSFDGATGYAIGGARVEVEVGYKKFETLAESDYKHVESHNFVAVGRDATLTPDNFFVMKIDSVKDISVMLNACYDVMHTDLPVSPYMCAGLGASFINIADHVTSKLAYRGKVGVSYKLTPEMSLIAGGFYHGIFDEQYAGIPASNRVNIAGGAAAKVKANIASYGFNIGARFAFN

SEQ ID NO: 18612 - protein, 282 aa, Anaplasma phagocytophilum
MNYRELLVGSLSAAAVCACSLLISGSSFAYSGNNDASDVSGVMNGSFYVSGSYSPSFPSISSFAISESDRGGSYVKGYNKNLSTLNVSDPASFTQHDPSFKFAKSLLTSFDGATGYAIGGARVEVEVGYKKFETLAESDYKHVESHNFVAVGRDATLTPDNFFVMKIDSVKDISVMLNACYDVMHTDLPVSPYMCAGLGASFINIADHVTSKLAYRGKVGVSYKLTPEISLIAGGFYHGIFDEQYAGIPASNRVNIAGGAAAKVKANIASYGFNIGARFAFN

SEQ ID NO: 18613 - protein, 160 aa, Wolbachia endosymbiont
KKATDIHNPLKASFIAGGGAFGYKMDDIRVDVEGLYSQLNKNDVTGAAFNPDTVADSLTAISGLVNAYYDIAIEDMPITPYVGVGVGAAYISTPLKDAVNDQKSKFGFAGQVKAGVSYDVTPEVKLYAGARYFGSFGAHFDKDTAAASKDKGELKVLYST

SEQ ID NO: 18614 - protein, 158 aa, Wolbachia endosymbiont
KKDKSDYSPLKPSFIAGGGAFGYKMDDIRVDVEGVYSYLNKNDVTDAEFTPDTIADSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYGT

SEQ ID NO: 18615 - protein, 167 aa, Wolbachia endosymbiont
KKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLETAVNDQKSKFGFAGQVKAGVSYDVTPEVKLYAGARYFGSYGANFDGKKTGPQDSTRQVTGAGAYKVLYST

SEQ ID NO: 18616 - protein, 236 aa, Wolbachia sp.
MHYKKFFSATALVALLSLSNAAFSGPIGPIDDEETSYYIRLQYNSEFLPFKTEVDGVIGAKKKSANANVTTDLYKASFMAGGSAFGYKMDDIRVDIEGLYSQLSRDIFETAPTPAIADNLNALSGLVNVYYDVSIEDMPVTPYIGIGVGAAYLSNPLATKVTGDKEYGFGFAYQAKAGISYDVTPEIKLFAGARYFGSYGAKFDKPVTENDQQPIKDGIKVLYGTVGTEAGLMFNF

SEQ ID NO: 18617 - protein, 528 aa, Wolbachia sp.
MMSMAFAAQNEQEQAEQTLEKPAEPVKLETIFVTAEEQVKQSLGVSVITKEDLEKLPVRNDISDYVRRMPGVNLTGNSATGQRGNNRQIDIRGMGPENTLILVDGKPINSRNSVRYGWKGERDTRGDSNWVPAEAIESIEVLRGPAAARYGSGAAGGVVNIITKKVTNETHGSVEFYTSQPEDSKEGSSNRVGFNVSGPLIKDVLSYRLYGNYNKTEADDVDINKSIGSTAAGREGVKNKDISGRLAWQATDQQTVLLDISSSKQGNIYSGDSQLNANAEADAILSQLIGKETNTMYRDSYALTHEGDWSWGKSKLVAQYDKTHNKRLPEGLAGSVEGKINNLDDKATSRLETLRFNGEANIPFEYYLPQVLTVGTEWVEDRFKDNVSTTQGKDSSGSGYGDQLAKGDRSKMESRIASAYIEDNLKVTDSTDVVLGLRFDDHSKSGSNWSPSLNITQRLNDYFTLKGGVAKAYKAPNMYQNAEGYLLSTNGNGCPANIESRCLLQGNGDLKPETSVNKELGISSKKIS

SEQ ID NO: 18618 - protein, 858 aa, Wolbachia sp.
MMKRQPQLLMGLWLAGVFIAVQPAWGSIPTLLSERGLTSTNSQGLLSQASAPQSPILVNGVRIDTKDKVIEVILETKQGEQLQVANSSSGNSLIVNITNAQLNLPSGNTFRQERPLAGITEVTVVNQDSNTIRITVTGEVGTPTYELFDSDAGLIFGVTPVLPSASQPETPQQPPEEKPTTETPTAQPTAETDAPIELVVTGEQDTYRVREATTATKLDVPLRDVPASVQVIPKEVIQDRQVIRLNELADNVSGVRPQETYGGLASQGYFIRGFSTGFETLRDGFRDFGFISPRDVANIELVEFLKGPASVLYGSATSPGGVVNTITKKPLADPFYQINGTIGNNDFYRSSIDFSGPLLENRAALYRINAAYENARSFRDFVENESTFIAPIITVKAGERTNLTFGYEYQKYDYTFERGFPSNNKVVFDLPINRFLGEPNLNRGEFKSNNFTYTLESEFGYNNNWKFRQAFNVINVSGNTKGAQPDEINADGQTVARGYRNVDEAQNNLSFQNEISGKFNTGSIVHNMLVGLELSYYKYSYDFLSGSIGDLDIFNPVYGAPAPTDLSRSNEEYGGDTIAVYFQNLVELTPQIKLLAGGRFDTVDSVYRDVETGTVYDETSDSKFSPRLGLVYQPTDSTSIYASWTNSFNPQIFGKTRNNEPFKPETAEQFEVGIKQEFLNKRLSATLAYFDITKKNVLTTDPEDDNFSIQTGEQKSRGVELDVVGEILPGWKIIGTYTYTDANISQDNNSSLVNNRLVGVPYNSASLWTTYELQQGNLQGLGLGLGVVYVGEREASLPNNLKIPSYVRTDASIFYKRDNWRAALNFKNLFDTKYYESQSFFIVPAAPFTVLGTVSFEF

SEQ ID NO: 18619 - protein, 391 aa, Xanthomonas oryzae
MQSKRGKSTSKVRKVWQVTLAATILSGCAESALAQSSVTLYGFLYSGVRYVNNSGGHHVTGLATGPSRWGLKGHEDLGSGLRGLFTLESGFDMSTGNSRQGGRLFGRQAYVGLSDRSAGTVTLGRQYDLVAEWIAPFTPPGKWNGYMAHVGDNDNTNWQFRINNAVKYVTPNFGGFQAGAMYGFGEVAGDSHRNSTMSFGVTYAGGRFRAAAAYLHIDNPASAVPEGNWNTILFPAVSATSPLQPNRIAPSSMSVAALAGQYDLDKLKLAVSFTQSRYKDLGDAADGLTNGDVRFNNIDVNGSYSVAPAWQLGLGYTYTAGKVQPTGFTPKYHQVNAVSNYFLSKRTILQAAVAYQRAAGDAQNAYLLFGSSGASSTSGQLMLLAGIFHVF

SEQ ID NO: 18620 - protein, 1012 aa, Xanthomonas oryzae
MGHKLSKITLAVLSATSLSFASSALAQEAQPVEERDVEVIAVSGIRSSLTSALLEKRETNNLIEVIEAVDIGKLPDQNLAEVLENVTGIQITRTAGIGTGVQIRGSNANRVEINGASTVGSGSGRSGMNFEDLSAAIIAGVEITKAPEAKTTEGSIGGTINLRTIRPLELTETLGSIRLQGEDSSLTTDGVQPRVSGAYGDNWELDSGRFGFVISGSYTKQEATSFRPRLDRDGSLVENVNADVIRSGELEDQAADRPIAQSFDFLGIQFLNQELENFEYETTNIATTFEFAPNDNMKFFFDAVITDQERRQDSTRVQASGVGSVLNYSLPTEFETVNFGSLDGVNLGSIQAAVRGTIQPNLGVDDDDPNLRFNSDTGARITDTEIFRLGGEWQGENLFASFEFSSASSDTETPSLNTQLNFINPNPLTPLDNLDEDGNPTADTSNDNSVPFIYDLTGDSLAFGIDFASPFAPTVADLLNPNNVVLDQVDLTRSTTENSEDAFRTDFTYFIDDSIVTSVDFGYRYNKTEHSAVSISDRIGGFSKLVDSPNGSLFSELLVEGPDHFGDADGRELAFRNFLIVDPDRAFSDRDGTLEILESAIIAHGGNQDLANLVPDSSEIFSIEEKTHALYAQANFEYEMLRGNIGVRHIETDIESIGNTEINGVVSAVTNKGDYSYTLPRLNLVADVAEDVVLRLGWGKDILRPNFGDLNTSVSFGTNENQSVEIGNAGLEPEEVTSFDLSAEWYFAEAAVVSIGYFKKDRTNLFVTNLESATLDANGLRDSNPACSGGGIYNPAVQPNVLGDPNTTGLCVDVETFFNDSATTTQSGVEMAFQYDLSSFEDDLGWASGFGILANYTVQEFDGGSAFYTSATRGTDVFNAINGVYDDSQFVKVTSERGLLDFSENAYNFTLYYEKYGLSARVRYTWREAFRTEDTAAGASLNSTLGFPVVTHDRGQLNASISYDVNDQLNLGVEAVNLTESDITQSCVNEDALLCAQGITDRRITFGASYRF

SEQ ID NO: 18621 - protein, 832 aa, Xanthomonas oryzae
MALPARAICHTLRTPLIKGMALASLGLMNPAQAAEKSTQEEARLEKVTVISTGVRGTQRTVTDSPAPVDIVTSDQLLKTGRADLTEAIAKLLPSFNYGTNVAGYNSTIRPLSNRSLAPAYTLVLVNGKRRHNSALPANGSTDSSGANSVDIDMIPISAVERIEVLKDSAAAQYGSDAIAGVINVILKSGAEGGHLGLTYGKLYSGEGEVSKFEGDTGFELGDGGFLHLSADARKRGDASWNDKATNTAYFPGDPREATWDRVGVKNGDPQIKAFNLAYNAELPLDDQTTLYSYGTYGQRDAIINNYFRYPNGNANIPELFADGYYPLNNLDDTDYQYLIGGKGQALGWNWDLSTTYGRNNNHQYSDLTINPSLGPASPTSFDDLATYRFEQWVNNLDITRAFDGLFGVPLQVSAGLEHRWERFRTFSGDAQAYQVGGYRFPASLPNGQASPLAGQLASIAAQAAAVISPQDATRLQRNNYAAYVDFGITPIEPLFVDLALRAEHFDDDSGNTVSAKLNSRYEFTDTFAVRGTVGTGFRAPSLTQTGYSISDNRVGAAPDGTIVPAVTRIAPVNSALAQALGATTLDPEKSRNLGVGVTWQPAPRTSLTADAYWIEIADRIARTESLYGPALAPTLTAQGVDTSTWTSYYANAFDTRTRGLDIVLDHSSQYGAWGDVRWSAGFNYNKTVITDVKDAPAALQGLGSNPGGSLTWVGRAREGDLTDAQPKTKWVLGGKWTLGDLGVNLQTTRYGKVKTLQQLESGDRSFGAKWITDLDVSYTLYDNITLSLGGTNIFDVRPDKHAIPSAVGLNLYGNSPFYPGGGFWYSKIAYDF

SEQ ID NO: 18622 - protein, 352 aa, Xanthomonas oryzae
MSKARFAILPLALLISGAVNAATVNPFYAGVRAGGVHYSDFDSKNYANGTYGSGAEGVDRDDFAAGVFMGYNVTPWFAIEGGYTWLGEVTSKYDEHHDSGKIEQQAIDLVGKFTYQATDKVDLYTKVGGAWQFTRAKGLPGQTATDRDDSLIATAGLGAEYHFTDNLSARAEYQYYHNMETKPTGTDTKINWDANYYGVSLVYGWGAPAPVVAPVVEEVVEATTVQVEPISVTMPFAFDSNTLTAEDQARLEPIAQRLVNFPNSELVVIGHTDSRGSEAYNQKLSEERAKTVAVYLMKHFNIDASRVKGEGRGELDPVASNDTAEGRAQNRRVDVTTPGFEIQAEDAEAVAQ

SEQ ID NO: 18623 - protein, 1953 aa, Xanthomonas oryzae
MKLHLPLSLLSSLLACMAAVSSPHAVAETYTWLGGTVDVHLNTNWTPDYGSSNWSATWAGTATNSMRFDAGSMTGQVKALQASFNTLSLGGITVTDNSDGFSVSKSNGSNRTVNLRDGGEGYTLFDIGGDFSLGVASQVWNGVVFNSSALFNIASGKTMNIYGGLGMAGTGARTMTVGTDGFAGTLILNTAAQSSMTADWVISHGATVQLNNAAALGSGSVSLNGGNITAQHDAVYNNALAVSGSSGMNVNAATRFASVSLSNAAVLNMNGGTLGIANAGVLTLGSSGTITGNLTLGNTSLLNFSALPASGSYLLNVTGTLTVGSELLLGQETMEGVAWTEGSYSLVHAGSVEGVPASSFVLGDNLLGSWSTENNNLTLVVEQVALLEWKGGDGIWSVTAPASSPWKNEGVYNNASGVVMGDIDGSSLQTVTIDGVVSPSIMMVQADTTDYVWNAADEGGALEGSGNLEKTGSAKLTINMDNADYAGKVILGGGTLEMGNDAALGTGDLAFDGGTLRYGTGVTADISGQISTTSKSSVKVDTNGNNVSWASADHYKALNLEKSGNGVLTLGGAVYTGGLTVDEGGVSITSGSVQTKFSAGVTVNAGGTLAISSAINGISTGDNANIVINGMSGAGRIELDNQAAKSRFYISGDNSSFTGELVATGLNNNPGNTNDARDLQFATAASMGRGTVTLNGRGFWLGTANSADTAVMAAINVLEKGSYLNGGSGNSYYFGGAFTGSGTMTTALGNAFAYLTGDMTGFQGAFSHTGDSLFTWAFGNNTEAVLNDGKLFGDGVVLKADGGTSQFKFSYTNDIILMNATVGAEGALNARVEQAGTGTLVLTQDNSATGTLTITSGTVQLGNGEVSGSWTGQITGAGALVVDRSAGSSALELNSANDYQGGTTLNGGTVKALGAGSLGTGDVFVNGGSILDMNGQAIANNVAITKGGLQHAGAYATSGGVTVNAEADSGDIDLGGLSGDKVGGINTTTAGTAITGLTGNLTLTGNNALHVGVENTTYASDGDQKSLIQFNDAATGTVSLGGDSSDLTLHMDIDTDILIAMRELDSVGILLTDGTITGLPDSGLVAWLNQHLTFNATLESLGFGIQGVDGGNIIISGRTDQIYIASVDGSSVTEIPALNSYAQVIVDKDLSLNFDVPASNTDKTIVRHLSSGTSATGNLAVNVAGEGSLNIELANDLDDSVFNGNLIVNGNGADLVKTGEKTLVLNGSVSTSNAVIAKEGTLVLNGSVNNIGTLALASASADAIARTVIGGTVTATLSDEDEGGSLEIAAGGTLKTAGDSVLDQATSISGAGSLNIQEGSALSLTGKAGLSGTSVTLNGTLGLSGTGEKSIQSLSGSGTLALNGGTLSVTSASARNGSFSGTLDGEGRIDVSGSVTQVMQTGSSTYDLGVHGGGTLVLKGTSAAPALDYRNVAVGSAGTLRIEAIGHEAGDSNTSLNVGSIDFQSGSTTEFVYNLSASDPFGSAMLTADSITIGNGAGFSLANMEGNTGLGTYDNLDGVVLMTADTIDGLTEGESISVGTSGLFAVYYKDATMSREGNHIVLNATVQQDNIFTPAVNSHNSGAGSELLWEAKNNLDATSQLGQAMHSISTMITGDNPDLAGASRALAAVAGSTVNALGTAQRDALRDQMGWIRNRTTLMGVNPAYVNDDLPRFHMWMEGTGSYAKLDTRGDESGYQLTTWGGTVGMDADLSDRLTVGAAFTAGYGDLTAGAADSADGHLDSYYASLFGRYQDRRWAHTLILTGGWNDAKLNRTVNYGEGSYGTQGSTSGWGFGAMYELTYDVYLNENRSSVLQPLFNASVVTTRMDGYEETGAGNAGLNVGRQDWTTGTLALGGRWMGLVGSNIFGREALAEIRVNAAQDLGDRRGETNVSLLGNPGFAQSVRGAKEGTTALQLGAGLSVPVGTKGTIYVNGNADIRDGSSALNGSVGYRYDF

SEQ ID NO: 18624 - protein, 673 aa, Xanthomonas oryzae
MIAQRTLLASAVLSALASLSNSALAQEQEKTLPAVVVTASPFSNDESAQIMAPAKVLYGDELREKLGNSLGDTLSQELGVSASAFGAGASRPIIRGMEGPRVKILQNGMSVMDASSLSNDHAVVGESATARQIEILRGPSALLYGSGAIGGVVNIVNDRIPTILNSKPTGEAETRFGSADKMKNASFSVDGAAGAIGLHVDGNVRDADDYKIPGYANPNDPSQGSGRLPNSYARANSVGFGASYIQSWGYIGASVGVDDNRYGIPTAEKSFITLDQTRYDIGGLIKNPFENFESFRFKIGHTDYKHTENLEDGTPATEFKNKASETRWELTHKPLAGWRGTFGLQTENSEFSALPVDDDHGHSHATVPVTKSQSVAGFLVEERDFGPFRASAGARIESVKRRPDTASGLVQRDFNLGSYSLGGLWTFTQGYGLGLTASVAQRAPAIEELYSNGPHESTATYDIGDANLRKETSRNIELSLQKTEGLMRWKANVYQNRVKNYVYGRTDGTMVDDHGDADPSGEFLQRFWSQNDATIRGIEAELSYNLRGNGFSWRGFADTSRGTLSGAGNLPLQPTTRVGAEIGYREGNWRSGLKVLHAEKQDRLASFETYAAPSYTQVDANLSYTQNYNSTPVTWFAIAKNLLNEDIRLSTSVLREVAPLSGRNLIIGVRTSF

SEQ ID NO: 18625 - protein, 754 aa, Xanthomonas oryzae
MPVQAQNTVAINIPSQPLSDALLQLGQQTSLQILYTPDLVRELNTSGLQGNYTPENALRQLLKGTGIEYERQGNTVTLKRISAVTLPPLTVSTASLKQGTAEEGYRVSNVSGVGLWDERSLRDTPYSMSVVTSDLIENINAQNMGQIFKMNPLTQEPNIQNHNGVPIVTIRGFQSTNPIYDGIPMADSNGSAVSVIEIDRVEILSGTSGFLYGGGRVGGAVNYVTKNSTNIPLRRLTLGNYGGTQFYGHADIGGKFDERGRFGYRVNLLYQGGDTAIGEPVNQKVANIVLDGHLTDTLYADVKYTYNDYRKEATQPTFNNVRERTGIDTSKRYAPKWASNDIESHKAYTSLRWDPSKYFPLRNAFFYQNTRAKTNEITLNEQADRTFIPRISSGNPWQKYENYGGYIYLDTRFSTFSVDHKLTVGYSSTVLNQVFLDGSPSWSGTNLLLSEIKNISRPDWEEPPPRSASIWYDRYNNVLIGDDITFNDQWSVMVGLNYATTANKATGIYGDRDYEKSALTPTVSLLYKPIEAVTTYVSYMEALEKGTIVGRTYTNYGEVLPPLVSKQYEAGLKYDINPNLLLSTALFRIEKANQFSNLATPVPTYVRDGLQVHNGVELVLTGKITDNLTIMGGGTLMDLSVEKSNNPALEGNKPANAASRMGKIYAEYALPWIPGLSLTGGIYYTGERYANAANTDKIPSYTLYDIGARYSTRVLNKALTVRLNVINLTGKNYWQNATYLGVPRTVAFSVSTMF

SEQ ID NO: 18626 - protein, 741 aa, Xanthomonas oryzae
MQPLPVTSTHSAFRPRPLSLLICAIAGSMPVLAAAQAQAQSASVDGGSLNAVEVRVDRIKSDLVNPMRQVTVIEREELDELRTGSTNLATMLSKVIPGMADSSRTVTDFGQTLRGRSALVLVDGIPLNTNRDSARNLATIDPSNIERIEVLRGSSALYGAGASGGIISITTRQAGGPPSADTTVTLGTPLTRLSKEGLSANVQQHFSGSQGPIDYAFHLGAQRIGSPYDAEGHRIAPEPSQGDLFDSNVYNLSGKLGWRIDGQQRLQLSVSRYQAKQNTDYASDPSVARAPAGSTAARAIRGLQLEDQNELRNTVVNLDYQHQDLFGSTVSSQFYYRDYFTRFPPFDARAVATRGGNVDQISQNSDVFGGRLTISTPLGQARATKLLWGADYNQERSDMPLDLFDPRAYDSSGGLVFNRIGTATYMPPLTTRSGGIFGQLQHKFSEQWSAEGGLRYERASASFDDFVPLSQSRVSNPATVKGGTVNYGAWLFNLGAAYAPVKGQEFYASFSQGFQLPDIGLQIRNARAGFDIHSSSLDPVKTNNYEVGWRGALGNTLASVTLFYTTSKLGDVQSFNNGLILTRTEERIAGVEAAADYRSDDERWGAGGTMTWINGRERPQGSAGFQDMTGYRIPPLKLTAYLQFRPVSQWSNRVQLSYYASRDYRLNGQNSFGRREVSSYTTVDLISRYELTRKDTITVGIENLFNRNYYPLYSQLLRNSNNTSRLPAAGITLTAMYQHRW

SEQ ID NO: 18627 - protein, 817 aa, Xanthomonas oryzae
MNRQKSRLLVGAAVLAMLPLAAHAQQSVTKNDQDVLELDAVVITASRDGATKMNSSISVSALSADQILAQAPRSTAEIFRGLPGVRSEATGGDGNANIAVRGLPVASGGAKFLQLQEDGLPVMEFGDIAFGNADIFLRADQNVARIESVRGGSSSTFASNSPGGVINFISKTGEVEGGEIALTKGLGYDHTRLDFDYGAPLSDTLRFHVGGFYREGEGARKSGYTSEKGGQIKANLTKDFENGFIRLNVKYLNDRAVGYLPMPTRVTGSNGDPDIGSFAGYDIGRDDLQSIYLARNPGLDGDGNRRISKVADGMHPDTLQFGAEAKFDIGGWKIEDRFKVAKTSGRFVAPFPAEVLSAQALATSIGGAGATLRYANGPSAGQAITAPGSLNGNGLAMRIHMFDVEINDFGNAMNDLKLSRSFDTGAAVVDVTVGYYKSRQTIAMDWLWNTFVSEVKGDNAALLDVYNSAGTKLTQTGLAAYGVPLWGNCCTRRYDVTYDIDAPYLSLSSRIGDLSLDASLRRDEGKARGLYAGAKQAAVDVNGDGVIQNVEQSVSVIDNANASPVNYDWGYTSWSLGANYQFNPDVAAFARVSRGGRANADRLLFGKVRADGTVSKEDAVDMVDQVEGGVKYRRAGFGLFATAFWARTQEQNFEATSQRFFDRTYKAKGIELEASYRIGDFSVTGGATYTDAVIDKDALTPAVVGNAPRRQAKWIYQFAPTWTINDKATIGASVIGTTKAYAQDDNQLIFPAYAQVNAFAEYKLAETLSLSVNANNLFDKVGLTEAEEGSITAGSVNAIRARSINGRTVTATLRYSF

SEQ ID NO: 18628 - protein, 384 aa, Xanthomonas oryzae
MQPDGRVRASVKQPIQSETPTMKKHRRLAGTTAISASLAACAGLASGHALAQSSVTLYGIMDAGIEYVNHAAPDGGGAFRMKSGNKNTSRWGLRGVEDLGGGLKAVFRLESGIDLANGAFDDGPDSIFARRATVGLKGQWGELTLGRNFTPTYDYMLPFDPMGYAQNYSWATSSTATGGRKDGLFTRSSNAVRYDGAYGGLRFGAMYGFGNVPGSMKTSSKYDFALGYESGPFAAVVTFDRQNGAADSVTPADPVNYVQGIHAGVSYDFGRLKTMAGYRNYRRTYHTAAATQLSDMYWLGGSYDFTPAFSLTGALYHQNIKGGTDADPTLVSLRAQYALSKRTVLYAAGGFAIAKHGQNVSVSRDSVGYADTQLGVTVGMQQRF

SEQ ID NO: 18629 - protein, 420 aa, Xanthomonas oryzae
MQASRLLLMPLLLTGILFAPNGARAAGFALQNQNGAGNGYAYAGAAAVAQDASTIYFNPAGMTYLAPGHHVSGAGNLLIRSLRFKNTGSSPFLSYPLGDNGGQAGGLSPIPAFYWSMSLGSAFRLGLGVSPTFGNSTEWNKTFIGRYQGRFSEILAINFNPSFAWQLSEDVSIGAGLNIVKFDADLRSMVPVTSLLPLPVDVETKMKGDDVGFGYNLGVMFRFSPSTRMGLTYRSTVDLKVDGRLSAPGTVIPASVALELPNTASLAISHMMSDRLRLLADLTWTGWGHIPAIVATSRASGTILANERLGFEDSFRVGLGAQYQYTERLRLHAGFAYDQSPVRNARDRSVRLPDSDRFWLAVGLNQKLGERTSIDVGYSHVFFKGAEIERPTFPNPLLQVVRGSFSTNAHIISLQLNHHF

SEQ ID NO: 18630 - protein, 693 aa, Xanthomonas oryzae
MPIHAPQTARLPLAAALALCLLPAANTFAQDGATTLDSIQVSGSWLGTGLHDSVKSFAGARTVVDRQRIEASGAASIGDAMRRIPGVQVTDNSGTAGSSVSLNIGVRGLTGRYSPRSTVLLDGVPLAVAPYGQPQLSFAPTSLSNIESIDVVRGGGAVRYGPQNVGGIINFSTRAIPTEAGLHSEAGVRYTAYDHGGGDSTQYNAFLGGTGDNGLGAALLYSGQDGRGWRQGSDDRFNDLALKFAYAIDEQQELRAKLSYYDVRSLTPGGLTRAQYEADPFQNTRPTDFWKGHRTGIDLGYTNTLSANSEFEVVAYYNESSRASSLINAANTQLTVQPRDYRVLGIEPRYTQRLHWGASVHDITAGYRFLRERGNDRSYTVTRRTGVASATNRFDNATDAHAFYIDDRIAIGQWRITPGVRMEWIDMDRRQSGGAATVSSRNDKALPSLNIAYLLTPQLTVFGNYTTSFGPVQNIQLNSQTASNPLNPEIARTTELGARWQDGALRAEVTVFKMRFDNQILQVPGITPPTFQNIGATDHKGVESALEYHFAEDSALAGLELYANYTWTKAIQQSGDNRGLDVPFYSRDTDSVGARYALAGWTFNVSSTHQSGQYSDAANTWAESADARVGRVPGVRLWNAQVAWQVPGLGDSEIALGVNNLADKRWYTRNVDGNAGRMVAAPRTFYLQGRYRF

SEQ ID NO: 18631 - protein, 790 aa, Xanthomonas oryzae
MTELKWAASTAVIAALACAGPALAQETGGATVEAIIVTAQKREQNLQDVPIVVNVVSGQQLQDAGVRDVKDLQVLTPGLSVTSSTGGAQTSIRIRGVGTIGDNPGLESSVGTVIDGVYRARSGVAFGDLGELERIEVLKGPQGTVFGKNTSAGVINVITKAPEFDFGADAEFVAGNYDHLAASASVTGPITDTLAGRIFAARRVRDGFYDVRNGEGPSTQKDNDDQDVSTVRGQLLWLPTDALSLRFLADYTKREEHCCLNTITVPGPTAPIVDALATDEGLMRPADPFRRIAYANRESNQDIEDMGVSLQIDWDMSDEVTVTSITAWRDWENFQANDIDFSSADIWYRPDDGRTFSKFETFSQELRVAGRSGPLDWMIGGYYSDEQLDSSAFTAFGLDYETYFGLLLSGGASPTAVSSLTGLPFGTNFIPGQGSYDTYDHSNTGWAIFTNNTWHVTDALEVTFGLRYTDDTKKVFSQYRNTAPGNACAAAIARPIPAAARAAICAPTGDPAFNNVDTRQKRTEDRLGGTVKVSYRLSPELMTYVSYASSHKSGGFNLDRARFAPGQINTDTSFPAETVESYEAGFKSNLAGNSLMLNAAAFDQTFKHFQLNTYTGISFVVASVPKVTSKGVDLDLVYRTPFEGLTLTGGVTYAVTQFGDFVPGPGIGPRLPTSRVSYAPLWSASWSAAYEKPLGQDFKLRASLSGRYTSSYNTGSNLDPLKRQRPMTIWNGRIGIGPEDERWMLEAWAQNLTDVNYYQVVVDQPLQSGTFAAFLGSPRTVGATLRVKFN

SEQ ID NO: 18632 - protein, 861 aa, Xanthomonas oryzae
MEARAQAPIVIRVDEAPLTAALEEVRAQTDLDLVYAERLVEDRTASCSYTGADRGAALACVLDGTDVRAERVRRGQYVLVARPDDERNAEATPRASLKGYVLDAETGERLPGAHVYLTQLKAGATTNQDGYFVMSGLPPKDYRVRISYLGYQSIDTTLTAGAGPARISLAGTSIQSEGVVVEAGSTSVDDNERLPGMRSVALNRLDQLPSFGEPDLFRALQWTPGIRKSGVTSGGLSVRGGNPDQNLYLLDGAPVYHPWHAFSLISTFQTQTLRSTELYRGTFPVEHGGRLSAVLDAQMKDGSRRAPKAVAGLSVFSGRFRVESPLTESTSFMVSGRRSYLDKLIGRRHPVTGDSGRRDTLRTGYYFFDTSAKLTHRFGPNHRLSFSYYHGGDDLDLRLPFDLSLDFSSWLRPPDLLFEVAQNWDNRVVSAQHRYLAGDDLFLTTTGYYSGYRAQEASFVQPTTTASLTSDYRVRLSDAGVKVRADYHHSVSHEWTGGLEVSTLQFESTLNSTLQRSSGTSSRRVQDSRVAAAKVVGYLQDTWTPTPQWTVESGVRAGYFSGGDYVHLAPRLSAQHVVHPRWLVVEGSVGLHVQHLQRLRDRYSLAYDLVSSRWIPASDRVRPATGGQLGLGTYTQLRPGWSLELDAYARETRDILVPADVFQEKEGIEGPGIEIGALLGQYVTGTERAFGLEFSTRYEQGPWRARLGLSMGRTFIQAPARSGLRWRPSGLDVPVSVRSTLGWEGAHWQATVAAELRSGYPITVPEARYKLGDPTASTPTSYLYRPQVHNGRLPPYLRVDLTVGYQFQLLSADWTATVDVSNVTNRDNVLDRTYRPTETGVDVNRQRGLPILPLVELEMRL

SEQ ID NO: 18633 - protein, 911 aa, Xanthomonas oryzae
MNRSLLATTIASCLVLTACGGGGGGGNVRSNAPQDTIIAPAPTPPPPAADPPPKTAPAPTPAPQRYQGVGSNLLVPTNADLAQQAGAKGKGVKLAVLDDNLVQSYTPISGKVDSFNDYTASPGTPESSANALRGHGTIVSALVLGSAQDGFAGGVAPDADLFYARICAENSCGTQATRRAAVDLAAAGVRIANLSIGTSYPDAAASANAALAWKYALTPLVQADALIVASTGNEGAAEASYPAATPVQEASVRNNWLAVGAINIDSAGNAAGLTSYSNHCGAAAQWCLVAPGSYTVPALAGSELGGQIAGTSFSTAAVSGVAAQVLGVYPWMTASQLQQTLLTTATDLGDPGVDALYGWGLVNAAKAIKGPGQFASDWAINVTSGYDSTFSNDISGVGSLTKSGAGKLTLSGTNTYTGGTTILDGVLSLTGSLRSDLLVANSATFEAHGGVINGNYSLVNSTGTTAIELGKALTVTGQASLKGNLLLLPEAAGYPVGSTEKIVNAGVLHGTFDRVQYANHFFWNAALSYNPTTVTATLTRNSSAASAQAAGAPQSVVNGGNQVDSLVKVLDTRVASGDTDNLGGLISATGALIAASDAQVAASLPTLAGQVHGIERTLGFQSALNDGRVAADRLPYLADTTTLTTWMQGSYLDGDLSRSGFDSADYTQQATTFGVDLPMGNAGTIVGAAVTSGQDRAHIAASSSRLRSDRYAMTAYLYQPMGQAYLSAIGSYGMSNVETERNVQAGSIGERLQDRRHDTNWSARAEIGLMPHAGLSPFVAAGVVSQTQDAFSEASMTGLGLSANRDTLRAGYGEVGVRGHLAHGKWGFDGLVAYRSLLGNPNSDFSAWFTGLPEARFNVAGEPVSKQSLRASAGVRYQLNDAFSIYGNLGTERSRSDANSINANVGLRWQF

SEQ ID NO: 18634 - protein, 1025 aa, Xanthomonas oryzae
MDSKIRKRSEAAAAGVVLLSAWMTTGGAKAECTTPGVAVSCSGSITTAVTVYDAAAATATPASGSNAYTPANPAFPARGYNPNPPTAIITLDATANRTLVTNTQAGLADRGMIAANFSNAENPAVNNVVINNAGWLSLTTSQLSAGRLHVVVADSQVNRFTVNNTGTLAATQNVFSTFDPARLTVSTGATATARYNGTNLAIISALYSDDNTNSFVLNNRAGGTVSATGHFAAAYYGRAATIIANSGTIANTDWTAASRFYDGHWAIAAFAGAEFRTVAGSNPDTPLYAFDSNGNVTVSETKTLNLTNTAGGVIKGDILALDTNPLTTAAGRASGQAFPLTGSGSNSGPRDSVIANAGLIQGNLYLGSGAHNVTNSGTISGKIEVDQSASRGSFTKGIAGTAAGTFSSSGTGTDAGGRACPAAGTNTTDPLCAATTAQAASFSGARNFRLVNSGRLDGDITIIDQRGASNTILLRGTGFSGNVVARNGIGSNALTLDGVTSLASVVNFGMLDLMKSQVTVNSVNGVQLVDNAVLRTTIYGPGGTAAAPSTNLGNISGRLAFAGTGTIAPRLQGIVRDGDVYRVATSVSTAPLNVDFSGALVSFNADSTTGALLLKANVRSPASIAGLSPSSLAALDHLVGYRGGNAQLQALGGAVQSLRSDNEVRRAGDQLRPFVNGAQIEVPLATAALLQGQIDNRLTAAAAGASPNARVASAFADDTDPLTSVLLAFAPTKARPTLKAPAVVPEPERTVWGSLIGTNISQREVGGVAGYAGNTGGLVAGIDQRIGSASRIGAAFGYAASAMDDKTAAGDSVGIQHYQGTVYGAYVQPSWYVSGSAGVALLDYTTTRRIGFAGFADSVSGSHKGWLTVGRAELGVPVKVDQAVLTPFAGVAFAHLDQQGYTEASAAGAALTIAKQTTNSVRSNLGLRSMIPLLVTSTYGFGLETLAAWRHEFGNTAQTVTAGFAGGAGTFFAAGPSPTRDTAELGAALKLIAFGDRQSLSLGYNAVVGSAYLEQSAVLKVRAEF

SEQ ID NO: 18635 - protein, 803 aa, Xanthomonas oryzae
MRHFWLLTSLIILFSTPALAQKAVKIGGTVTDENGNPIELATIRLEGTAISTVSNLKGRYSLKFESRDSVTVIFSMLGYQTRKRKLVRPQGNISLNITLPPMNFELGEVSVTERRRQTGTIQQIETKQNRLAPDASGGSIEAVIATQAGVSSNNELSSQYNVRGGSFDENMVYVNGIEIYRPLLIRSGQQEGLSFINPDMVQSVGFSTGGYEAKYGDKMSSVLDITYKKPERLEGSASVSLLGASAYVGIATKKLTWTNGVRYKTNQYLLGTLDTKGEYDPRYIDYQTYLDWTPSKRWEIGVIGNISENRYNFQPEDRYTRFGTLSNVREFKVYFEGQEKDLFRTLFGTAYATYRLNEQNSLTLQVSAFHTKEQETYDITGQYWLNSLDSGTQVDGTTNEEETSETIGVGTYMEHARNHLTAEVQSYSITGRHRLKSHSLQWGAEFKRERIKDRMREWEMRDSAGYSMPQTSEGPKLFYTLRSRNETDSKRYGFYLQDTYRFRSTAGLFTLTAGIRGSYWNWNKEFIFSPRASLTLIPAFNEKFTLRVAAGVYYQAPFYKEFRDTTQVDGIATVSLNRDIRSQRSLHFVTGGDYNFRAMERPFRFSMEVYYKALGNLIPYNIDNVRISYYGRNLSKGYATGIDMKLFGEFVPGTDSWLSFSLMKTEEKINGQWLPRPTDQRYRLSLYFTDYFPGSRKWKMNLKGTLAGGLPFGPPHSGREAAVFRTSPYRRVDIGMSRCIIDRSERENKRGIRSLWLGVDIFNLLNISNVNSYYWVTDTRNNQFAVPNYLTSRQINVRLLLDF

SEQ ID NO: 18636 - protein, 875 aa, Xanthomonas oryzae
MAAGQEQQAPASTPSATTELDTITVTGYRASLEKSQSVKRAANSIVDAISAEDIGKFPDTNAAESLAHVPGISVDRQFGEGEKVSINGTDPALNRVLLNGQTIASGDWGGNPSDTSGRTFNYTLLSPEIIGLMEVYKTPEARIDEGSIGGTVIVHTRKPLDLPKNTIRGSVGYNYNNRSKEGNPRGSALWSWKNDDETFGALISATHDKQDLARAGIEYFGYTTGDKIPPTATITGDGSNVATARVPAGISSAFFQQTRERNGLQGALQWKPDENNEFNLTGIYIKGKYNNYSQARYVCPACNDDLKKVTRANVENGVVTSATVSDNTQGGVNDQPYAQMDTNYRESTVTTKSLNLRHDWSGEKWVFTTQIGDTEATGGKNPEYLMKYLMQDGGYNYAFDGRNTAVNYDNGGAANWALPGNPAGLAPGAETIPGTSPSVSPMQAGGIYYQKSKDQEKYFQWDASRDLALGPFNKLQFGYKYINHDNGVDARGNRINTTDPVSLTQFNPGTTQSSLYDGLGASGDLTTWPTANLGAVRRYLLAQPQGPYNTDFGGSFDVKEITQNVYTQLNFESGQWRGNVGVRLLDTTDKSEYWQSPDNGQSYSRVAETHEYRKALPSFNVAYDVTDDAVLRFSVAKVMARPRYADLAGSFTVNSGNGNLTASGGNPDLKPYESTNYDLAAEWYFAPSSMLSGEVFYRDISSYIVSTTVGEQRPATNLNPAGLYQVTTPTNASDAKVKGASINYQQTFGLGFGLQANYTYAKADASTGLNLPYLSRDTYNVIPYWEHGDWTVRVNYSYRSKYFTQLGRLASEDFADSYKQLDLTASYQITDYMGLTFGATNLLDSTYKLYSGTRDTPTAFYKNGRGYQAQLNFKF

SEQ ID NO: 18637 - protein, 969 aa, Xanthomonas oryzae
MNFKSNKLRDAVVLALVLGTGNAVLSATAVAQTKPADEAATLDAINVTGSRISTPGLTTSSPVTSIEREDFMRTQPVAVEEFVKQLPSVSPTVGPGTNNGATGAAELDLRGLGSNRTLVLVDGRRPVPYDLSGVVDTNTIPVALIQSVDLLTGGASVVYGADAISGVANFILRRDFEGVEVQSSYGQSKYGDGARQRIEATMGANSSDGKGNVVFSVGHTKVDPVFQGDRAWGKVSRSSANGRPQGSGTTVPSLIVGPPGVWGTPGDDGTLDGRGQIDPTTGQIVSDVQTYNFNPINLFQTGLDRYQATALGRYEINEHAEAYGQVNYTRSRVEASLAPSGLFQEAFDMPIGNPLIPEPARQQLCQAYGIDAANCVPGNATMIEGLTIGRRLTELGPRTDRFDTKTFQVTAGLRGAITDNWKYDAFWSHGESERLAESRNWGSLSKTRQALMSLDGSTCVDPSNGCVPLNVWGPEGSVSPEALKFINLSAFSIQNVEQDNAALNVSGDLGGFKSPWSEYPIGVAVGAEHRRATAGTRSDGPSQIQGEVMGTGAPTPDSHGGFTINEAFGEFIVPLIDNAPGVYALSLEAGYRYSDFKTSSNTSDEYGSFKYGINWAPIESLRFRGMFQRANRAPGIGELFAPQVTSLDNLETDPCAGGAISAAQANVPGTLSNLCVQTGVPAGSAGLVAQPNAGQVNVLTGGNLLLTPEQADTQTIGLVWNPTSNFAMTLDYWKIEMEKTISSQSVDDVISGCYDPAFNPGLTFNSNCALIGRSPLTGTFNGTTSRGISLILSNQGTLKTDGFDLGLKYGFDLPGSMGRLNLAYDATLVTTLESQATPESENRDCLGYYSVSCTPNSKYRSILRSSWSYNDLSVSLAWRYNSKMEVEPETGTWFQSYREIPSYSYFDFGVNYKLPFNAEVNLSVANLTNKKAPVVGNTIGDTTQNSGNTFPNFYDAIGRFYTLGMTFSF

SEQ ID NO: 18638 - protein, 890 aa, Xanthomonas oryzae
MHSRTTTLALCITAALYCSGSAMAAGQEQQAPASTPSATTELDTITVTGYRASLEKSQAVKRSANSIVDAISAEDIGKFPDVNAAESLSHLPGISVDRQFGEGEKVSINGTDPALNRVLLNGQTIASGDWGGNPTDTSGRTFNYTLLSPEIIGLMEVYKTPEARIDEGSIGGTVIVHTRKPLDLPKNTIRGSVGYNYNDRSEEGNPRGSALWSWKNDDETFGALISATHDKQDLARAGIEYFGYTTGANIPPTATITGDGSDVATARVPAGISSAFFQQTRERSGLQGALQWKPDEQNEFNLTGVYIKGKYNNFSQARYVCPACNDDRQKITQANVQNGVVTSATVSDNTRGGVNDQPYAQLDANYRESTVTTKSLNLRHDWSGEKWVFTTQVGDTQATGGKNPEYLMKFLMTDGGYNYAFDGSHTAVNYDNGGASNWALPGNTAGLPAGSTADGVMQAGGIYYQKSKDEEKYFQWDAARDLTWGPFTKLQFGYKYINHNNGVDARGNRINTTDPISLTQFNPGSTPSSLYDGLGASGDLTTWPTADLSAVRRYLLAQPQGPYSTDFGASFDVKEITQNAYTQLNFESGQWRGNVGVRLLDTTDKSEYWQSQDNNVTFSRVAETHEYRKALPSFNVAYDLADDAVLRFSAAKVMARPRYADLAGSFTVNSGNGNLTASGGNPDLKPYESTNYDLAAEWYFAPSSMLSGEVFYRDISSYIVSTTTTQRLNPQPPAIPGDYQVTTPTNASNAKVKGASINYQQTFGLGFGLQANYTFAKSDASSGLNLPYLSRDTYNVIPYWEHGDWTVRVNYSYRSKYFTQIGRLGSEDFADSYKQLDLTASYQITDYMGLTFGATNLLDSTYRLYSGTRDTPTAFYKNGRGYQAQLNFKF

SEQ ID NO: 18639 - protein, 328 aa, Xanthomonas oryzae
MMRPAILAGVLMALPSVTLAQGLTLDGAVTLGYGFSTIDGFGTDITLNGASLDFDGDLRFSDEFSVGLGFGFGSSDLSVTGLPNDINIDLLSLSVEPEYRFSNGAYVGAYYRMGDLDLSLVSPVTVGVDTFQYGIFGGYDFGQGHVEAFYGQSDFTENSLLGLGISTDVTDYGVSAAYQMTPELELFGSVLRTDIGLGPAGDVHVTAFSLGAEYDITPELAVYGAVGQTIFDLSDIGAPSDITATGLTLGASYDLTSAASIPMYVSAEYSRTNLDLSAIGLATDPTVDRFALGLTIPIGNGSGSALNSNTRVARGEYRSAVAAVFNSF

SEQ ID NO: 18640 - protein, 684 aa, Xanthomonas oryzae
MRMGEPGLAGLAASVMLAAGAAAQGPLPGNNRDDVFNRDDVIVVTGARSGEAVDATILPVTRIDGDTLIRTAAQHPAEILARVPGVALNRGNGAEHLAAIRSPVLTGGAGAGSFLYLEDGIPLRAAGFANVNGLFEALNGLSGGIEIVRGPGSALQGSNGLHGVINYLTPTAADTASGFEAELGSFGRRRGQLIISRPGDGASALLAIAGQHEDGWRDEAGLDRVETLVRLDGAMPRFDWRATAALVSLQQETAGYVGGLDAYRNLDLARRNGDPEAFRNAQALRLTLSLSGQADALTQWQVTPYLRANEMDFLMHFLPSEALEESGHASAGVQTSLTRQTGWGEWVLGADVEATTGTLRETQTRPTLFSFVQGEHYDYTVDSTLTAVYGQGYWDASDALRLQAGLRLERVQYDYDNRLADNAIGRYLRVADRSDGYDLVLPHVGASWQINTSSHVVTRLARGARAPQTAELYRLQPGQVIDGIEPETLDSFEIGYRRGGARFDWSVTAFAMKKHNVFFRDADGFNVTGGQTRHHGLELALDWLASSTLTFNLAGSWARHLYDFDRPVSTASETIRAGAEIDTAPEWLWNVRARWQPTARFSGELEWSHMGRYFTDAGNLHSYDGHDLFHLRARYQWREGAEIFGAIRNLLNTRYAERADYAFGSDRYFPGEERGVSIGVRVGF

SEQ ID NO: 18641 - protein, 491 aa, Xanthomonas oryzae
MAAESRARVDGGTRIGILMTYRASSALIGAPHKNSDAGWKCCSGGACFMRHIRNLRRFAPGVVIPVLALAGAGEASAGGFGLREQSSYYQGTSFAGVAAGGWGLASMYWNPAAISFVPGLQVEGNVSYVAPHASIDVNRATAPITGTNLGTFGVSDIVDNAAIPAMYASYAWERWAVGVSVNAPFGLVTDAPCNWSGRFYGCYSRIYDVNVQGNVAYKVNDWLVIGGGVSVNYMDARLNQAQINGVSTAGPVLGTGQVDGDDVGLGFSLGALFTLAPGTTLGIGYRSSIDLNLTGQVSVYAPTGQNLAMFPANAGLTLPDQVTASFRSQLNPQWTVSGTVEWTNWSSLQKLVVVPQGASISVLDLGWRDGWFFSGGVEYQWDPRLALRTGLAYEISPVTDDVRNPRLPDSNRIWLSVGATYAWTNQLSMDLAYTHIFGQSGSINLSPADPANALRGSLSAQVSDAYVDIVSVALRYKFDAPQPTAVALITK

SEQ ID NO: 18642 - protein, 167 aa, Xanthomonas oryzae
MPGNSPHYGRWPQHDFTSLKKLRPQSVTSRIQPGSDVIVCAEMDEQWGYVGAKSRQRWLFYAYDSLRKTVVAHVFGERTMATLGRLMSLLSPFDVVIWMTDGWPLYESRLKGKLHVISKRYTQRIERHNLNLRQHLARLGRKSLSFSKSVELHDKVIGHYLNIKHYQ

SEQ ID NO: 18643 - protein, 895 aa, Xanthomonas oryzae
MCVVLLSVSLHAQAQNKETRINLNIRNATLESFVKQLENATGFSFIYGEEVKLTHRITLEMKQKNISEILQRAFENEPITFEISGKHILLHKRPVPQKPVSRKFTISGYVTDGASSETLIGANILESRRSTGTATNPFGFYSLTLPEGETELVFSYLGYESRHSRFELTKDTLLNVRLDSNNQLAEVVVLSDKREAGIESTAMGAHEIPMTQIRHTPSILGEADLLKTIQLMPGVQAGMEGFAGMYVRGGGPDQNLVMLDGIPVYNADHLLGVFSIFTPEAVKNTTLFKSSFPARYGGRLSSIVDVRTNDGDMHKYHGAFSIGLLTDKLHIEGPIWKERTSFSFSARAIPTLFFKNLIVDKDDTYSDKYNYYFYDVNAKVNHKFSDRSRIFLSFYKGKDHYHYDSDYHGDNYDNSIKNYSKDNSHLNWGNTIAYGRWNYVFNSKLFCNTTVSYNKYEMGLDGNIEDTYTVANKVQDRYYYSSKFNSGIRDWSARMDFDYTPMPQHHIKFGAEYIHHTFRPGIATSKIQDIDNGALQEDTVYNTSNSHAMRGQEISLYAEDNFNVNARLSLNAGVRTSLFHTQGKSYYSLQPRLSARYDLGQGYSAKASYTCMAQYVHLLSSTPLSMPTDLWVPITKDISPMYANQFSIGGYYSGLPGWEFSVEGYYKQMKHILEYQDGVSFFGTSTNWEEKVEMGEGRSFGLELMVQKTLGKTTGWLAYTLSKTDHRFKNGTINQGRWFPYKYDRRHSISLNLSHKFSDRIDAGASWIFNTGGCITIPEKATIIIRPDGSIEETGYISRRNNYRLPASHRLNLGVNFNKKTKHGMRTWNISIYNAYNAMNPNIVYSKYKNGYNVYYDDFYESIYHGNTGQKKAQTVIKKITILPCIPSVTYTYRF

SEQ ID NO: 18644 - protein, 304 aa, Xanthomonas oryzae
MIPLLLAAVAALPCTAALAQPASAEDSAQGEALSPPASPKEGKGAYFSDWFNQDLTLIGSKDISFGPKPNDDIYLEYEYFGRKGPFELYGYVDVPKILGIGNDNDKGVWDHGSPLFMEHEPRISIDYLAGRSLAVGPFKEWYVAFDWIYDHGSNSANRANTLYSGLGTDIDTHSRVNLSANFYGRYQWENYGASNEYSWDGYRAQLKYIVPISKFDNGASLTYIGFTNFDFGSDLKNDPARTGNSTVATNVLLYAFTHLRFTLVGRYFHNGGNWQDGSELNFGDGNFRARSDGWGYYAGVGYQF

SEQ ID NO: 18645 - protein, 713 aa, Xanthomonas oryzae
MSTFRFHALAIAIAASTLTLPQLTRASDTPTTDALDASVGGTPIRALDAIQVQGSLLGRSKPDDVQRYAGSRQVIDREQLRNGGNRSLDDALQRVPGIKIFDETGTGALPQLMLRGLYESRSGRVQVLEDGIPLALAPYGQTSLSLFPVGLNQIDRIDIVRGGAAVQYGPNNVGGVINLVSKEIPSAWSTTLAHKVTAGGEGQFLQDSALSSGGYLTDHFGMQIDANRTYGEYWRAHSDTDISNLRVRAEWWLDDTKLLKASVQRYLVDMDLAGALSPDDYRRDPRQSTRPLDSFNGRTTRASLSYEQLLGDWGPMQDVRLDWSNFSARSSRNFIVGMRQASTETWRSDLPPQLRQTAPRDFRVVGSEPRLSWSMGDAGGVRQQWTAGVRAVREDIDFLVGNLRLRDGLFTTVRDWQFEDRALAAYISNAITLPDERVTITPGLRYERLDSRYFNRATGVSTLNQTRDVLPGLTLGFQATEQWFFYADGQRSMRAPQVTQIIFGNNLDAELAWNYEAGARYQPNERTRIQLGGYLIDFDQQIQLDNTTRVFRNLGRTRHQGGELELQWSPEQLRALTLNASYAYLDASQESGAFRGLRVPYTSRNQITLGGTYALGHTTVALSGYYFSKAFSDAANTVQENAIASVGQLPAYMVWNTQVSHTLFERDGQKFSASLAINNLFDRHYWFRGVDTSPWGRQAAPARTVTAGLEYTF

SEQ ID NO: 18646 - protein, 668 aa, Xanthomonas oryzae
MDSRPPLGRRARALALVFSAVVVCAGAGPFAAARADDAPPAPGDAGAPDPGAAPVELDELVIRVPGAEATRDPTGAVTVVEAGRYAGEAKAVAELVATAPGVAVSAYGGLGQLSTVSIRGSSASGVLVLLDGLPLNTAFGGGVDLSTLPRQWIERIEVLRGAEGAHYGAGALGGVVNVVTRGGEPGRWSAEASGGSFGTAAASAEAAAGGERWTLFGAAGAERSDGDFTYRKRPQSSLPGSPYQTFTRENNGSARGGGIAKLTARLGERRLDALLQLSGGRRELAGWPGNDTPDDWQRDARALLSVRLSGPGPAPGLTLGARLTGRADLLDTRIGSLSGGDPVHQRGGAAGAEAEAVLLHRHGALRAALGADGEALRADGLGDPRTRAQLSATLSEDARLAAGRVRLSPAVRAERVGPFDGLSAKLGGSVRLLGPLAARASAGRTFRAPGFAELYLQQGGALPNPSLRPETGLSADAALVAEGARGMASVGGHLTRYEDLIVYQASALGRMKPFNTGRARVAGLEVEAATAPAPRLLGLALGAAYTYLRTETLRGEAAEVGRDLPFRPRHRLFARAAIAPGPAEAHLEAHYVGAQWRDARNADRVAEALLWNAGASVRLARRAGLRLGLEARNLLDDRTLTDPIGNPLPGRMVMVTLRAGSTPGDPTP

SEQ ID NO: 18647 - protein, 619 aa, Xanthomonas oryzae
MFRAQLGSNTRSTKIGDDADFSFSDKPKPGTSHYFSSGKTDQNSSEYGYDEINIQGKNYNSGILAVDNMPVVKKYITEKYGADLKQAVKSQLQDLYKTRPEAWAENKKRTEEAYIAQFGTKFSTLKQTMPDLINKLVEDSVLTPHSNTSQTSLNNIFNKKLHVKIENKSHVAGQVLELTKMTLKDSLWEPRRHSDIHTLETSDNARIRLNTKDEKLTVHKDYAGGADFLFGYDVRESDEPALTFEDKVSGQSGVVLERRPENLKTLDGRKLIAAKTADSGSLAFKQNYRQGLYELLLKQCEGGFCLGVQRLAIPEAEAVLYAQQAYAANTLFGLRAADRGDDVYAADPSRQKLWLRFIGGRSHQNIRGGAAADGWRKGVQIGGEVFVRQNEGSRLAIGVMGGRAGQHASVNGKGGAAGSDLYGYGGGVYAAWHQLRDKQTGAYLDGWLQYQRFKHRINDENRAERYKTKGWTASVEGGYNALVAEGIVGKGNNVRFYLQPQAQFTYLGVNGGFTDSEGTAVGLLGSGQWQSRAGIRAKTRFALRNGVNLQPFAAFNVLHRSKSFGVEMDGEKQTLAGRTALEGRFGIEAGWKGHMSARIGYGKRTDGDKEAALSLKWLF

SEQ ID NO: 18648 - protein, 972 aa, Xanthomonas oryzae
MVGTPCGVPPSTALRHRHSAARGQGPVAWLRGTFSMNFHRNDLSHVLGAILALGLTQTAFAQETKPAKPPAAQDEPQVLEAVTVTGTRIQGLDLKGAVQAYQIDRELIDESGATSVIDLFNQLPIAAGGGGTFSTASAGALSGDTPVGASGVSLRGLGTSATLTLINGRRASISAFARGQESFIDASAIPLAALERVEILPNGASALYGADAVAGVVNYVLRKDFEGLEASLSYGDSTAKSDEGRVNFNLVAGKAFGDHHVTAVVDYFKRNAFYLRDRAASRDSFRPSQQGFHPSFNDLFFMTNDQTEGPGGSGCASADFKVGNLGEYCQVNANRYVSSQDEQESVGGLISHSYSFGDGATWYNELLFQSSKAQGTSSPANFSRAPIDPENPNWPTTLKDDLVAEGKVRRFSSYYGFPIFAWGKLIDSRAVEVESQSYRFVTGLKGRLASGWTYDAGLTIGGNDRTQEGLSGLYRSKAFYDANLGNLCTDGSAVRRWDVNLSRPSATYVGATCEAAGKTTLWYNPFGGQTQQPGGLTDRLETKARREGRSRAYALDGSLSGDLFTLAGRQVKGAFGAEYRRETLRDTPSGDAVATATNPEPILGFSSTSAKAERDQWAVYGEVYAPLSDRLDLQLAARYDHYDAFGGDFNPKVSARFRATDALTFRANWSTSFRAPSLAQSGAGVLLSSYRVNCRITPQACGGSATANGQALLSEDVGNPELKAENAKTWGGGLLFEPTDDIEIKLDYWNIEHRNLVGVAEDDFIRRALAGAFPVKGPGQLPTGQAGVEVTNGFVTDAHFQISNLGYQKTRGVDFSYTQHLPESSAGRFTATFDATYLIAFDRKASADALIERLAGDYLYPRFMANARIRWSKDAWRASLGARYVSRYTDQPDPRTLAAVGIAANTKVKVDASFTLDGSVSYDFSEHSYIQLNVRNLLDEAPPRVLGSSANVDLYNHDLIGRFATLRLTHRF

SEQ ID NO: 18649 - protein, 133 aa, Xanthomonas oryzae
MQRVTITLDDDLLETLDSLSQRRGYNNRSEAIRDILRSALAQEATQQHGTQGFAVLSYVYEHEKRDLASRIVSTQHHHHDLSVATLHVHINHDDCLEIAVLKGDMGDVQHFADDVIAQRGVRHGHLQCLPKED

SEQ ID NO: 18650 - protein, 203 aa, Xanthomonas oryzae
MRVSSLTVGGYGKEVSWQAVQRASLIRIINPALPHILHDRPALARLHWAAEVTGIGLAASIKPQLTDIMIRKTACSAVALLVLIGATPAFATNGMNLEGYGAKSMAMGGTGSAYDTGNSAVMNNPATLGFMKEGTSEIGFGIRGLHPDISLDNNGITDKSDATVLHALDVLHAPRRTDHLGRRMLAQGAWAPTTATTRRCSLR

SEQ ID NO: 18651 - protein, 642 aa, Xanthomonas oryzae
MLPSMAAATAAAADALPTATDSEQLTLPELVVYSPRVANQESTDSFAMPVTALRYEPLVDVQARSASEAQADVSIRGGTFENTGFSIGAVPIYDPQTGHYLFSEQPVAPALLGAPQVRTGADNAISGWNATAGSVAYGWQRVQTGGFASVGTGNDSLFNADLYSGYVSDVKLGGRTLAVDASASWSQGDGALDYNDHEFQRYNLRFQLQGDNAQTDLFAGWQKKFFGLQNLYAAPYNRYETDQLETLLVALNHRVMQGVDGGWFQAGAYYRRNVDDYTFDRLAPPPAIPYHHVTQALGAGLEGSVPVFATAGTEGGGGGGASTAIRYRAGVVADEIDSVRLSKTGDGLGDGRFDHRTQVYAGLFADQTFVLAGGHQIVATAGANYDDSNRDGSAVSPVAELAWVRKPSGNENPTTDGVRRVYVSYAESTQLPTYTALNSSPTSGLFRGDRDLGRSKAQNIELGALASVARWDVQAAVFYRHDDDLVDWYYDPANPSAARIPVAGSLDTTGVELVARRSFEWLDLVFGYTWLHKNEDYLPSGAASFYAYNFAEHRLTAALVLRPGAGIELRMDNELRLQADNPLRSSGDDVILSSLGVYYRVPGIRGLTLSVQVDNLWNTYFEEVPLVPGAPRTWSAGVTYAW

SEQ ID NO: 18652 - protein, 953 aa, Xanthomonas oryzae
MRRHRPEPLSAPPHATPRIRAVATEGVGDLRPCPLTGFGLPFPIMRVPSMQLPRPFHRLSCAIAVVLSTPSLACAAEMTATTLDSVNVQATHAAAPGSLNEQRLSNSVNSVMSKQQIDAIPSGGIANVVAHMPGLSAYSDMHLGQATTGENAYVSIRGMDASYNAYTLNGFGMPETDSSTRAISLNMLAPFGIQSVQVSKSPTPDMPGDSIGGAINMRTPNAFDFAQDVYAKSTAQGQFNALAHHLGGKDSGGTFQQELAWKFGQGDAFGIYASAYYGKNNNMAQAPAPNSKYVPADPTLAQATDLRDVGPLISTRYKYSLYTSQIERYGGTLSLDWQGDTSALYARAIYGSYGVTGTQDQSSARLETYRKQPTAVRGGYFNTHDIDETLATLQLGGETTLDRLRFDYGSSFGRGTRSRPDYVSASLYGFTPGSFAFDLSDPTYPSIGPSSPALKDFFYNLDSSLLWKVQGHDAGSHDNRFNAHTDIAYQVDGAVLDSVKLGLSADHSEREAYDHPFFHKDGNFVTNGPYFGGPNYAFPTAGGPPLSTIPGRITDNAFDGHYAGPFKLLDRGWMRAQALPYKYIDDPNGAGSYTANDYNANTTSSNEAIYSGYAMAALHIGAVSVLPGVRYELTRYAADSWQSSGDGRNGSFVDTGSTYGKVLPGISINYRPDDLTVYRAALRRSFSRPAFGLISGETVYSIDDTQKVVGISKPNPNLQASTADNADLSAEFYDHNGGVLSASTYYKRINGFIYTSQSATSNDSTLGGLVPTGTTFENGVPVTMPQNGGTAKLYGLELAASKRLQQLPGLWSNLGVTANLTLQHSQADSKRSDQPEKTWLPRAPERIYNLDLFYDDTHLRMDLSYNYTGLQLLGLTTDRLNYYLQPVKSLDFNATYHLPHHIDVGVAAKNLLNAATFYETQGKSKRYMAYDPGADGAYVQTGRTYMLTLGYTY

SEQ ID NO: 18653 - protein, 997 aa, Xanthomonas oryzae
MFVTANSNKLIYEIKNYVVLGARFAVFNTVDFRSAKTVTGTVTDGEGLPLPGVNIVVQGTTNGTQTDFDGNYSINAQVNQVLVFTYVGFEEQQKTVGSASTINVQMTAGEALDEVVVVGYGTRDKTDVVGSVAQVSGDILENRPVANIVDGLQGQVAGLQIFSSSGEPGATPSIRLRGNGSLGAGSTPLILLDGFQVDAAIFTRLNPTDIQDVTVLKDASETAIYGSRAANGVVLITTKKGRKNAEPVINVGVQYGFSNLANTDFFERLMNTEQLTNFWVDAGIYSQGQIDGILAENNADTRWYKYYYKEDVPMQQVNISAQGGSEKTSYFISGAYYGQEGLAYRSDFERFNLRSNVTTNITDWLKTGINIGMAYVTDETNPYGSNSTNRGLAPLAQPFYSPINPETGGRYEGVIPGWNRYDPVYLANKNPYDRNRFQVNPSAFLELSPLDGLTMRSAIGFDGFDERETDRRLPSNVGSLNNGRTDEAFRRDVLMTVSNTVEYDFNIAERHELTVLGGHEFSDFNRERFAAISTGQTDDRLILLEQGPTNRDVEHYKEEWSLESFFGRLTYGFDGKYFVNATIREDGSSRFGRDNRKATFWAVGARWNVINENFLTDVNWLDNLVLRANIGTSGNSDIGFYNSYALVGTNQYQGQTGWQLNTPGNPGLQWESQEAASVGLELGLFNKLRATVEYYERTTSNMLIDVPYPYTTGFDEVTENTGSLKNYGFDVALEFDVVKNEDLSITPYVTLNYNQNKVTELFQGRDYWIIPNTGVSWAVGQPVSYFYPVFAGVNPDNGDAEWYLPNEDPDQIVNNRQDPDAVTNQFNTAALQQNTGIDRYAPFNGGFGLRANYKGIFLQSHFAFSSGKYMINNGRYFFENPNVFAGFNQNDRVQDFWREPGDQTLFPRANVQFTQFDSNLIEDASFIRMKTLTLGYNFPQELMRQIGFVDNVKVYMTGRNLLTWTKYLGPDPEVDTNVALGTNPNTKQLIFGVDFQF

SEQ ID NO: 18654 - protein, 732 aa, Xanthomonas oryzae
MDHMVAMNSRRAQGRRRLLLLASVATQMIWIAPAAAQGAGSDGDIIVTARKREERMIDVPVSVAAITGPLLEKNRVANVDNLIGNVPSLYFSSNALSPGKDFINLVIRGIGAQSAGSPAVATIVDGVYVPALSFDIQFMDVERVEVLRGPQGTLFGRNTEGGALNIVLRRPDERTRGRIALTYDEFDTARAQAGMSGQLAEGLFGSASLDFEQSDGYLKNRVIPAALGLSGSIKANDYRKLSGRAALRFKPDDRLDINLAVDASSQTGLDGLPGVPRGGEHYVVRSDFQTDARYRNRGGALTIDYDLGDVGLTSITGYRKVTSRLPFDFDGSPEFVDNVHDLKTSQSITSQEVRLAKTAGGAFKWLLGGYAFDERHVQDRGYRLDTVPIFPSGIFIDAQNQRLKRRGFALFGDATLTLLDRLDLNAGLRYSWEKTRASTLIDFTIPDLLGPGADLHVAGAARGAITDKALTPSASATWRWSRNLTTYVRYARGYRAGGFPLAPADPSTDIPFGPEKSDNFEIGSKASLWNGLVHLDGALYLINIIGQQVSTVVFLNNDPTLPVTSVANAGRGRSKGFEFSADARPVDGLLLGANVGYTDARYRRYVDTVGKNRAGERFPFVPKWTAQANASYRFPISGGVDLELYGAYRHVGKILSGSGVDIDIQFPVRAYDIADIRASLIGPKWKADLFVDNVTNNYVETRVFNAFFFLQPRPFSIVLPPRRAGIRLTYEL

SEQ ID NO: 18655 - protein, 948 aa, Xanthomonas oryzae
MMNLRTSAVRLGLLPAGIAIALTPAFAAAQESTTTLDRIEITGSRIRSADVETQQPILTLDRQALEKQGLTSVADVLQNLTSAGSPAISRADALSSGEDVGGYYVDLRNLGAQRTLVLVNGKRLGASTSGLQDLSQIPMSAIERIEVLKDGASSIYGSDAIAGVVNVITRKRFDGAEASVQFGQFGQGDGDTTQYSFTVGSQGERGGVTLSAEYSKQDPVFAKNRWFSRDGSRGPNSTPNSWSPISQNGSWCNPLQVDCDDPDTAVWQTLNAGGNPNNPADYHRITPAEYANSNQQMMVQTGIERKSVFANVNYDVADAITFNADIAYNERTTDGQIAGYPYQSGSFGTPLEGSSAFNPIGQDVDFRRRLWEVPRASENQLKTLRFAPTLSGYFDIGGKTWDWDVGALWNRNENTKRSRGDMSLIASRQALGPSFINGQGVAQCGTAADPISLSACRPWNPLLPYNVAGQGSLADPALQEFLFPTFTDTGLTKTTSFTANLSGSVVELPAGDLGVAVGYEHRKEEGRFSPDAFAQSGESTGLGAKTTQGQYSLDEVYLELNVPLLSDVAFAKELTFNAATRYSDYSNFGNTLNSKFGLTWRPLEDLLVRATYAEGFRAPTISDLYGGLSSSFESYIDPCGVGAPNSVNGNAACNNANVPLGYTQLGQGFVPCTTYPCQTPDEFISGANPNLKPETSTSKTAGLVWSPRWVQGLDISLDWYRYEINDMIIADSVDRILRDCYVLGNAERCANVTRAADGHISAMSYGVANLGQMETEGYDLGVKYRLPETAIGSFTFDWQTSYVSKYDEAGQDSAGNAIMIGRVGEPGIFRVRSNVGVNWSLGDFGVNYTLRYYSGMKESCITLAEGYCDAPDHVANGESDPLRHTGANTFHDLQVNWKAPWDATIALGANNVFDHRGPLQYSAPNSSFAYYGGFEIGRFVYMKYTQRF

SEQ ID NO: 18656 - protein, 1107 aa, Xanthomonas oryzae
MLRDLQFSRLAVLCLLTSGTLFAQNNTGRISGTITDHSGSVIAGATVTVANQATKVTEKVTTESSGYFVVPDLQVGTYDVTVEATGFRRAEKTGYDLVDGGRITADFKMEIGTVTDSITVTEILGESVNTVSGELAHTIDSQQVQDLALNGRNYLQLVSLMPGVALLDEDQMATTTSLSVTTWTANGARPGTAHLMIDGGMNLDSGSNGSQVNNVGVDFVQQVSAQTSGVSAKYGRNSGAAVNAVTKSGSNRFTGGVNFTIRNDALDAKDYFAPSKPVLRYDDFTVNVGGPIKKNRLFFFWGEEYKKINKFTSPTRVTLPTRAEIAGNFADRTTTTIRYPGTTTPIPNKDLSSLMTPDGKAVMAVYTAMIAKAAVYTDTPTTNNATFQVLNPFTWRQDIAKIDWRPNDKDYFYGRWIHDNYDLVDPYGTFNASSLPNTPTARNRPGYGPQFAYNHTFGPTLINEAKINASWNGQRTPMQGTDWQRASFGFQFPRVFGGNGLYSNGIPDVSINSFTGYKGPANIYLMSPTTDIAVSDNLTWIKQTHTITTGVMIIRNRKDQNGRTQYDGTVAFNTSPNTNTTNYALSDAAIGNFSTYSEAQSDPVGFYRFTQYEAFVEDAWRVNRSLSLTIGVRFSHFLPTYTSANNISNFDPSRYDPSQAVTVTSAGLIVPNSGNPYNGIIRAGEIPSDQVGRVSIANPALLKTIPPVGPRGFYPDYNLFMPRFGFAWSPFGNGKTSVRGGFATLYDRVQGNLVFSQTAIPPFSNSVSYESGNLGNPAGGTTSAQGVLGGINSIATNLQPPVVYDFSLTVERELPKGNFLRVAYAGKLMRHLLRQPDINFPSFDVLVANNNIPSASRPTTNAIRPYKGYSTIRMYMSDSSGNYNSLQAFFSKRKGNLNMTTAYTWSHALADTSGDGDNQDSGLGYGNRHFYYGPTSYDRRHIFVQTYTYRIPLFRHSIAPLRYTLGGWEVSGITRAQSGPHLTPVGSSTGVTRRADYIGGDVALSSDERGPNHWFNTAVFKTPATSVLGNAGAGTIVAPGLYLWDVSVRKEFKVRERGRLQFRADSFNIMNHVNFRSLQVTTSSSNFGTLTGSGPARNIQGGLRLDF

SEQ ID NO: 18657 - protein, 513 aa, Xanthomonas oryzae
MPRFKNVNDCDRPVGLTDLLEIGSTVDLPCNIGQFVRLSSRSGSRVSRPHRAYRQVVLSMSVVMLLAAGAAAQEDKKTDDDKPADPDTGESTVEEKTLGILPNPLQKYGVKFAATYIGEAFGNATGGLKQGAIYEGRLNLAVDVDLQKLVGIDKLTFHANMFQIHGDGLSRSNLQNFFVVSGIEALPSTRLYEAYFEKQWGAKKVSLKVGQLAADSEFFNTKYTDVFTNASMGWPAITSLDLPSGGPSPPLAAMGARLLVNVTDQLSLLGGIFDGDQAGPGSGDPQQRNRYGVNFRVNDPPLLLGQIQYAWNNKKGDPNLTGQVKLGGWRHFGSFADQQLASNGVSFAAPGTSAEPLLLAGDIGGWAVFEQQIYRVPHSDDRGIGLFARAAGAPADRNLIDLYADAGLEFIGLRDDRPDDKFGIAAGYAHVSKRAQALDADYRTLVNPSWPIRSFEGLLTAVYQYQIRDGWTVQPNFQYIVHPGGGATLPVGPLAGKILKNASVFGLRTTLKF

SEQ ID NO: 18658 - protein, 1000 aa, Xanthomonas oryzae
MSALGRTRRGSPFLNVLFATSAVAMIVSAGSAVAQTAPPPAEPDATALTEIVVTGTRIRSTGFTAPTPTQVLGQADLERNAEPNVFTTIAQLPSLQGSTGATTGTFSTSSGQQGLSSFSLRGLGTIRTLTLLDGQRVVPANITGVPDISLFPQLLVERVDVVTGGASASYGSDAVGGVVNFITNKRFEGFKANVSAGVTTYGDNEQFLLQVAGGKAFMNDRLHVQVSGEYDEEQGVPAGGFGEDAPGSRDWYTTATLVNRGVTNDGSPQYLYREHAQAYQYTKYGLISAGPLQGTAFDQAGNPFQFQYGSNGVPSKAANGAVIGCYSNGGFCVGGDLSGNVGVGTSLQSEITRMNSYGRVAYDIDDNNEIYGTLNIARVESANQPNPGGATTGLTMQCSNPYLPASVVAACAANNITSFTFGTSNALLPNNISVHPTRTQYRGVIGADGKFAAFGTDWHYDAYYTHGENTTNIHVNNIMLTPRYRAAIQATLVNGQIVCADPVARANGCQPINVFGGQRPSDAALKYIEPENGPYQHSVQKQDVASINFSGEPIQGWAGPVALAFGAEYRREAYHVQGDSYGDGSAASPYTTDYPADPLLNTAGNNWYAGNYHSGAGKYTVKEAYAEVNLPLVNSDAAGKANLNFAGRWTDYSTSGTVYTWKVGGTWDTPIDGVRLRAVTSRDVRAPNLSELYAAPVTTTLPNFTIPSNGTPPPGQPSGPGALLVLQNVVGNPDLKPEIAKNTSLGVVLANPKWLPGFSVSVDWYNIVLNGGISSLSAQQVVNFCYSGLTQYCGSFNFAPPAGTTPYVNAQVFNLASIKTSGFDIETSYRFEIPSVPGRFDLRALATNTHKFVTNQGFPGGSVVDTAGQNSGATPDWKVLAVQSWSSDRFMLSLQERWFSDGVIGGQYIECAAGSCPVGRTAADNNNYPTIDHNQMKGATYVDVSGSYKVTKSLQAYFKVANLFNKDPTPSPQTNTGLDANPALYDLLGRFYHVGLRYSF

SEQ ID NO: 18659 - protein, 713 aa, Xanthomonas oryzae
MPVFSRRRMRHTLPLLSLLAWACSIACAQADALRARELDAVQVRSQYTPYRELSITGATKTDAPLRDLPISARVLDRTLLDDAGVTDLAGALELASGITKANNLGGLWDSYSMRGFTGDPNFSSDYMVNGFNASRGYNGLRDAANTQSIEVIKGPASALYGRGEPGGVVNIITKKPLFQPQNSVDVSAGRFDSYRAAIDSTGPLSESVAYRLNVMHKDQHSFRDTVDSDNTLLAPSLLWMPTPETTVSYELEAVRIHAPFDRGVTAIDGDANRLPASRFLGEPRDGDIDLHSTGHQLFVVHGLNQTWSLQGGATYRESGMRGFSTEPWTLQADQRTLRRERRYRDYQGRDIAARAELLGSLQAGRVTHNVLLGIDGNRFDDSRFQQRARSAATPYSIDVLAPRYGVAQPGQLAAITDTEERQQVWGAYAQDQIDLGARWKALLGLRYDHYEQDLDNHLRGTTQRASDGVVSPRAGLTFLVDDALSLYASAAAGFRPNSGVGANGQSFAPEKSRSLETGLKYVQPGDGLEATVAAFRIDKKNVLSLDPADTSFSLPVGEMRSQGVELDLLGRLTPHLAASVGLAYTDPQVTRSSAAAAGTGLAEGRRFPNVSRFSGNAFLNYEQPLTGKRSAAIGMGVSHTGERLGSVDSNTDFVLPAYTVWRVVGHYDLSDRLRLYAKVENLTDRRYAAFSYSEQWVYPGAPRSWTVGVHLRF

SEQ ID NO: 18660 - protein, 347 aa, Xanthomonas oryzae
MAFAAMGLAAAGSASAQSSVTMYGLVDAGIEYVSHAGPDGSAVKLTSGGKNTSRWGIRGSEDLGGGLKAIFALESGIAIDTGRLDTDNTLFDRRATVGLASRYGQVVLGRTFTTTYDFMLPFDPMGYAPAYSWATSSTATGGRKDGLFSRASNAVRYDGSFGGLKLGATVAMGEVAGDFKSSSKYALGVGYSAGKFAAAATWDRQNGAGSSTTPADSTDYIQGIHAGASYDFGDLKLFAGYRNYKRTFTTGAATDRSDMYWGGASYDFTPAFTLYGAVYKQNIKGGNNADPILFSLRGQYALSKRTLAYLSVGYADARNGQNVSVSRDLVGFANNQTGVMAGLQHRF

SEQ ID NO: 18661 - protein, 213 aa, Xanthomonas oryzae
MHRTIRSRITVAAVAASLAAIAAPSLAASPGDGIYQGDVLARVRAISIQPNERGSDTLGALHTGVNNAIVPELDFTYMIRDYLGIELILGTSRHQVTSSVGHLGGVNVLPPTLLLQYHFNHAGKVRPYVGAGLNYTYFYNNGLNVGGQGVSIDKSSFGPALQFGVDVQVSKKMFVNVDVKKIWMSTDATLGGNGIGTLHIDPLIVGVGVGMKF

SEQ ID NO: 18662 - protein, 167 aa, Xanthomonas oryzae
MAGSVNKVILVGNLGADPEIRSLGSGDRVANLRIATSETWRDRSSGERKEKTEWHRVVIFNDNLVKVAEQYLRKGSTVYIEGALQTRKWTDNTGQEKYSTEIVLQKFRGELTMLGGRGGDAGMSSGGGDEYGGGYSGGGSSFGGGQRSQPSGPRESFSADLDDEIPF

SEQ ID NO: 18663 - protein, 282 aa, Ehrlichia ruminantium
MNYKKILVRSALISLMSFLPYQSFAEPVSSNNIGNENAKEGFYISAKYNPSIPHFRKFSAEETPVYGKDSPTKKVFGLKKEGSITKYSDFTRTDISFEGQNNFISGFSGSIGYIMDGPRVEIEAAYQKFNPKNPANETDTSDYYKHYGLSRAEAMADKKYVVLTNNGVTFSSLMFNACYDITAEGVPFIPYACAGIGADLISIFDDINLKFAYQGKIGISYPITPEISAFIGGYYHGVIGNKYNKVPVKLPVTLTDAPQSTSASVTLDAGYFGGELGVRFTF

SEQ ID NO: 18664 - protein, 290 aa, Ehrlichia ruminantium
MKNKLIATGIVLISLSFIPNISFSETINNNIKTHYAIYISGQYKPSVPHFSNFSINETNTDIQNLVAAKQNISSLDIDTVLKEPSNFNHPYTTEFQDNNISFGGAIGYYSTEGTRIELEGSYEFFDVKDPSGYKLHDAYRYFALARDMNRKKSFEPKKQIGLRTNYTVMRNNGLFISSVILNGCYDFSINELKISPYMCVGIGINAIEFFDALHLKLAYQGKFGISYPISNNIKLFADGYYYKVTDNKFKNLKVIYVADLNNTPLVTSAIATLNVEYFGGEIGIRFGLKL

SEQ ID NO: 18665 - protein, 381 aa, Ehrlichia ruminantium
MTNKLKLASSIAVLVSSLSAGVSFADEGDKSIFVTTGKYFYDNDLSIDDATPLTLGAGYDFSDKWGGELSYTYLNSEIENSNVDVTTKHLLLDGLYYLGDAKGDWKPYLVSGIGGRNVDVDGFGDSSSTFVNAGVGIKGLLAENFQVRGDVRALHDLDDSFNDVGVNVGLAYVFGGKAKASKPTVKPAATTPAKPMDSDNDGVANTLDACPATPANVKVDAKGCALDSDNDGVADYQDSCANTAATHKVDAKGCSLSLTETVAINLSIQFDNNSAVVKESYYAEVKRVADFMNQYANTQVSVEGYTDDRGSAAYNKQLSQKRADAVKATLVSQFNIDAARVTATGFGEINPIDTNDTAAGRAANRRVVANVSSEVEKAVTK

SEQ ID NO: 18666 - protein, 854 aa, Ehrlichia ruminantium
MGKFALLGSAAICVSMVAPQAAAQEAKKSYDLPAQELGAGLRVIARANDYQLVADPKSLQGRRSPALTGEFTVQEAVTALLAQSGLNADIRGRTIYLRGRPTPSREEVEGAADNLLFVTGSRIRGAKPMSPVIAASREKIGDLGYTDLGSFVRSIPQNFSGGQNPGVISSVQTGSENTTSSSTLNLRGLGADATLTLLNGHRVAYDAVSQGIDISAIPLAAIERVEIVADGSSALYGSDAVGGVANILLRRDYDGLLTTARFGAATDGGDVQQQYSAVTGRRWDSGGFMIAGDFNNATDITASQRSYMRSRQSSMTLLPSQRQVSAVLAGHQALGEVVEFEIDAHYNRHKSVAALPYSATADVTQSGIISRPEIEGYSISPSVKFRLPAGWEVTARATRAISDSTIIAEIYSGGTASAVNHVQYKNDLWSAELSGEGPLFALPGGDARLAVGAGLRSNGLDASIRRVTATATTSLLNYHDGQTATFAYGELFLPLVADRNAVPLIRSLQFSGAVRYERYDEIGGLATPKIGISYQPISDLTLKGAWGKSFKAPTLSQQNTVRQGVLLFPAYYLPSPPTSRNVLQISGGSKDLEPEKATTLTLTAEAKPQSIPGLRLEASYFDVRYKNRVVRPIADSSQAFKAEYADLILLNPTLEQVLAATANLPLGVQNQTGGAYDPANLAAIIFNQLQNAARQHIRGVDASASYEFSAGENQFHLEASGSYLKSDQKLSASQPTIVKAGRIFNPPHWRGRASAGWKRGPIGTNLAYNYIGGTDDTRTTTTYKVSGFHSIDATISWEPEGSGLLGGWSFLLSGQNILNEKPSAIRATATNPTYDATNYSSIGRLLSFTVSKAW

SEQ ID NO: 18667 - protein, 282 aa, Ehrlichia ruminantium
MNKNKSIIIGTALTFLLAFSPIESFSANQTDETIPITAPISGIYFTGQYKPGISNFSNFSAKETNYNTQKLVRLKKDAKESNLLGVNTNFEDTYSVKFQNNIISFSGIIGYATSKGIRLEIEGAYESFDVKSPVGYSKDNAYYRYFALARSMTKENPKEFTVMKNNGLSVASIMINGCYDFALDDFALSPYICAGIGEDFIEFFDALHIKIAYQGKLGISYRESPKISLFIDGYYHHIIGNQFKNLSVHHAVELSEFPKNSSAVATLDIGYLGGEVGARFIF

SEQ ID NO: 18668 - protein, 257 aa, Ehrlichia ruminantium
MNNKNSITKVYIVTILSFILLPIQSFSALIGNITKNEEYSNVYITSQFKPTVLYFKDFSLKEINASHKSNDDIITQHDTKFHNNTSSFSGSVGYSSLGLRLELEGSHEKFQMQNSDIISKISKYQYSTKAYAATTDNYTNTNNNNITLTSLMVNTCYDITIGNSSAVPYLCTGIGGDIINIFNATHLRFAYQGKIGISYQLNNNFFLFADTYYHKIMGNKFKDLYIHNSSNITPMLAKIDIGYFGSEVGLRIIFNKL

SEQ ID NO: 18669 - protein, 709 aa, Campylobacter jejuni
MHPNKKAFKLSLFALLLITNLNAQESNKAINLQKVVVSTTGFEQDADSNLRNVISIEGKDLQNKGYVSLEQALERISSISFVNFGLGRNIDMRGQGNKSNIAVKVMIDGHAINVLDNSHGVTPLDSINLDNVERIEIIPGGGSVLYGSGTRGGVINIITKKQKSDAFAINLKSSAYDHGGLGGNLGINGAKQINENLAFSFDIQSFNLDGYQEGYNEKGYFINTKTYIDINDNSDLTLGYNYFKSKNTSSGYLTKAQAQSDPTQKGKSDNITQINRPEISLDYHYYFDDIWEFNLEAFWQNQKINYLKDVSTMSYMNMSLPVYQNGSGFEDTLTGISLKNKLNYANNSYFIFGYEFANHDAKRKSLVYYSVPSVINYHRMTTLIDMTKQSHSIFALDSHNFNEFFTLSGGARYEFSSYNTDRSYRNEMSMNGRPPSPTIIDSTTLFDTNKNANNFAFEITPNFKYSDTGKLYIKYERGFVSPSPAQFVNKDKNSQKYYSANLNPEIFDTFELGIDDFWWDFYGFNLTLFYTLSKDEISYLGNPHSTSGSWWKYYNIDQTRRLGVELSLSQNFLDDDLIFRESLTYLDAKISKGVNDGMRIPYVSKIKATAGLEYAWNKNFSNFIDLTYFSRAKDGGTIDENTGKMSKNSWIRDYFLTDIGMKYNYKKLQILAGIRNLFDKRYYTYQDSINDQYLVGNGRNYYVEFKYAF

SEQ ID NO: 18670 - protein, 316 aa, Campylobacter jejuni
MKKIFLCLGLASALFAADNSVKFELTPTFSFNKFEGNLDLDDRAAPGVRLGYHFDDFWLDQLELGLEHYSSIKYSNTDRTNLTKVFLSAIKGIDVGEKFYFYGLAGGGYERFSNEQFDNESGGFGHYGVGMKYKLTDSLALRLETRDQISFHEANHNWVTTFGVSFGFGSAKDGAVSRTSSKVKAICPVQPREGALLDENGCEKTISLEGHFEFDKTTINPAFESRIQNIAKVLEENEKYNTILEGHTDNTGSRAYNQKLSERRAQRVANELMKFGVDKKRIEVKGYGQDKPRSSNETKEGRADNRRVEARFFLAQ

SEQ ID NO: 18671 - protein, 1041 aa, Campylobacter jejuni
MKKFFCLTLVCKLFALSEFELHHIDKVHKLGYSGDTIIIGVADDAFNQDHISLKDKILKSTYPTDTAGKQLIPDLKKSTHGSHVAGIAVGAKIGDSKPYGVAYGAKFYGAGVFPNGSYTQIPDIYNFFKDVSIINNSWGINFYPYFNLKASNSGLVDCTQTNQGTSYNICNTPLEYVMKADKVANDMMRLSKDKGVLNVFAAGNEGILSPALHAILPSYDESLRAWLAVGALDANEITLESDGTLIIKSQGLADFSNGFKGATNFSLVAAGVNINNVDSSTNDKFTKKSGTSMAAPMVSGTAALVKQNFPFLDGKQIADILLSTANKNYKAPKFTVKQVTDGTNQPKFLIVYISQDPPGIEDEIKRDLKQLYNGIQVQVNGQWIDYSDYIWDNRDSAQSQKLNTSTISSINGVVRVEKEELFGQGILDAQKALKGLSILDANRLSDQDVLKYEQEPNTAYYTINTAGYDAEFSNDISQRKWDESTHLSSAINKPTHLANLNIGLSKEGEGILIISGQNTYEGATLIKQGELKLKGKVKNNAYVEQKAILSGNGIVGQNLNNKGIVRPGNEDLNDLTVQGTYTQEGVDSKLQLDFGNYKNSKLIAKTYDIKSGNLEYIPLPKYYILNKPVKINLGDLEKSLSSFNHVLIQNTYALNFDFVLSDDLVSINKTLIKPNLKPNAYEIPNTSLGNALRQLRSRADLSQTYQEFFASLDNGIDVKTKLNRIEGSGYLSTFSNHNQSNLMQNNMLFTLHPLNINNFAQNNNILLASTYLPRIFSNEEYFWHLTPSYKYYKDKDFSGQKTGANISLGENFSSGFLAYALSLSSAKFNFNNGSDLKSYNMDLLLNYNHDLDFIKILSGLGIGVGFNTLNRFVVEQPIEGKYKTLQTSAQLGVTKDIILGQDFIFNPLMYFTHSFFYQEDFKENKSPFAKNYESLKHHSINANLGFNLAKNIEQDDYQASFSTFVIFEKRIYGRTLENKASFVDFPIAFIQKYKLKDNILSQGFNSEFLYKNNVFWQFMLMNRFSHNAYELHLMSSVGKRF

SEQ ID NO: 18672 - protein, 198 aa, Campylobacter jejuni
MKKLCIALAVAALAPVAMAQSAGDIVVRARAVYLDAANKDTVAITDVSINSKWLPEVDFTYYVTPNFAAELILTYPQKQDVSSTAHGGFIGTLKHLPPTLTAQYHVTGLGAIKPYVGAGVNYTRFSSVNLLNGALSVEKNSFGLAFQAGVDYAIDKQWSLNLDVKKVQIRTDLSLGATNLGTLKVDPTLIGIGLGYKF

SEQ ID NO: 18673 - protein, 758 aa, Campylobacter jejuni
MKKLSLFCAVGLCFANFAFSEELEFDSLEISGSKIKNDEKPFVTPGATSTRDNLNSNTQSIDSIVRSVPGAYTQVDQAQGGVSVNIRGMTGLGRVNTQIDGVTQTFFGSASDDSFHGQIGTSSFTAPIDKNFLVALDVNRGTFSGANGANALMGSANFRTIGVDDIVQEGRVFGFLGKYSYGSNAIGPNFMGAIAGKTMLENNANLGILFAYSGQNVSQNYKIGGGGYIGDQKPPFDTDDDGIPDDNLAAPINPNNLYNQPRSQLFKVEYKSDISEAILNYRAYKNNLAGRKITNDTYQIDYRLNPDSNLLDLKFLFAYNDGKQKYNQGSTWGYHDMSGVKTKNRAVTFDLSNTMNKEFSQDSNLYFTYGVNILNNHYSNDFPQDRVLLPYILTSFYPKGKQDIKTLYLDTSFTKGIFTLNSNINWTNAQLSGYKGICSMANPYCQPKNATNLEKDYNNFNYSLMLSADIHPLFNPFISYSKSHRIPNVQEYFFTHDASFEHNMNTFLKAESADTYQIGFNSFTHEILNDSDTLGFKMLYYDTKVKNYIYNRRYWQKADDAIFLMQLNDDEKAKFHGVELEFKYDTGFFYSILSYTYQKSKHKFSDTESLEFGGAQSGQSQFAQLPEHYANLDMGVRLFEEKLTLGALAKYTGKAKRIVPVGSLDDDPSNPDAMAPLKTTDELPKIPTIVDLYANYKILKNFTIKAEVQNLFDKNYMDALYSYNTGENQNAGGLFDPIYIYNNSARGRTFIVSFEYKY

SEQ ID NO: 18674 - protein, 322 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTEDVLGLGTIGRVESREISVRYDSPVFAGFSGSVQYVPRDNANDVDKYKHTKSSRESYHAGLKYENAGFFGQYAGSFAKYADLNTDAERVAVNTANAHPVKDYQVHRVVAGYDANDLYVSVAGQYEAAKNNEVGSTKGKKHEQTQVAATAAYRFGNVTPRVSYAHGFKAKVNGVKDANYQYEQVIVGADYDFSKRTSALVSAGWLKQGKGAGKVEQTASM

SEQ ID NO: 18675 - protein, 188 aa, Wolbachia endosymbiont
SYYVRLQYNGEILPFYTKVDGITNAKDKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVVYSTVGAEAGVA

SEQ ID NO: 18676 - protein, 188 aa, Wolbachia endosymbiont
SYYVRLQYNGEILPLFTKIEGIEYKKATDIHNPLKASFIAGGGAFGYKMDDIRVDVEGLYSQLNKNDVTGAAFNPDTVADSLTAISGLVNVYYDIAIEDMPITPYVGVGVGAAYISTPLKDAVNDQKSKFGFAGQVKAGVSYDVTPEVKLYAGARYFGSFGAHFDKDTAAASKDKGELKVLYSTVGAE

SEQ ID NO: 18677 - protein, 654 aa, Escherichia coli
MVRHSRAVVVVVGSIAASTSVGHAALPDYADLSLEQLMKIEVTSAAKRPESILNTPAAVFVLTNEDIRRMGARSVPEALRMVPGLNVAQITASTWAISARGFNGRFANKLLVLVDGRTVYTPLFSGVYWDRQDTILEDIERIEVIRGPGAALWGANAVNGVINIITKNARDTQGGYAQVGAGSDDQARGEVRYGGALGEYGHYRVFGKAFTEGNRPESNGTDGADDWRSGRAGFRADLTDPSGDTWHFQGGSFTTVAGDAYSSPSLTAPYAQRLATDSDASGNYFLGSWGRDLAVSNRVEVRAFYQQEAFSDPRISEDRSTLDVEASHRFLIGDRHNFVWGVGGRYSHDDIQDSFQFGFEPDSGEQYLVNAFAQDTIALWNGAVELTLGTKLEYNNYTGVEIQPNARALWHLDERNSVWTAASRAVRTPSRAENDVAASPLVFSPSAATGGLPTVVQYNGSRSLASEELLALEAGYRWQTSDYLSFDLATFYNFYDRLVSASTGTSYVTTTNGVPHIVVPLNTNNDGEADVYGFELLANWQPRNDLRLQGWYAFAKSDDDSQNQVGIRSLYNVTPTVTLDATARYVSEIESVDIDAYAEFGVRLAWRPVPNVELAIVGQNVLHDERLEFSSDPLAGTQATKVERSIFGSVSLKF

SEQ ID NO: 18678 - protein, 198 aa, Wolbachia endosymbiont
GPISDEETSYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEGMPITPYVGVGVGAAYVSNPLVAEVTGDKKSGFGFAYQAKAGVSYDVTPEIKLYAGARYFGSYGANFGKTAKDDGGIKVLYSTVGAEAGVAFNF

SEQ ID NO: 18679 - protein, 198 aa, Wolbachia endosymbiont
  misc_feature (191)..(191): Xaa can be any naturally occurring amino acid
GPISDEETSYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARCFGSYGANFGKTAKDDGGIKVLYSTVGAXAGVTFNF

SEQ ID NO: 18680 - protein, 183 aa, Wolbachia endosymbiont
GPISDEETSYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARCFGSYGANFGKTAKDDGGIKV

SEQ ID NO: 18681 - protein, 162 aa, Wolbachia endosymbiont
SYYVRLQYNGEILPLFTKVDGITYKKDNSDYSPLKASFIVGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLCAGARYFGSFGA

SEQ ID NO: 18682 - protein, 162 aa, Wolbachia endosymbiont
SYYVRLQYYGEILPLFTKVDGITYKKDNSDYSPLKASFIAGGGAFGYKMDDIRVDVEGVYSYLNRNDVTDAKFTPDTIADSLTAISGLVNVYYDIAIEDMPVTPYIGVGVGAAYISTPLKAAVNDQKSKFGFAGQVKAGVSYDVTPEVKLYAGARCFGSFGA

SEQ ID NO: 18683 - protein, 198 aa, Wolbachia endosymbiont
  misc_feature (29)..(29): Xaa can be any naturally occurring amino acid
  misc_feature (65)..(65): Xaa can be any naturally occurring amino acid
SYYVRLQYNGEFLPLFTKVDGITYKKDKXDYSPLKPSFIAGGGAFGYKMDDIRVDVEGVYSYLNXNDVKDVTFDPANTIADSVTAISGLVNVYYDIAIEDMPITPYIGVGVGAAYISTPLEPAVNDQKSKFGFAGQVKAGVSYDVTPEVKLYAGARYFGSFGAHFDKSEEVDKAGGGKETKVTKDAYKVLYSTVGAEA

SEQ ID NO: 18684 - protein, 197 aa, Wolbachia endosymbiont
  misc_feature (2)..(2): Xaa can be any naturally occurring amino acid
  misc_feature (51)..(51): Xaa can be any naturally occurring amino acid
  misc_feature (61)..(61): Xaa can be any naturally occurring amino acid
SXYVSLQYKGEISPFPDKNDGIGYKKDNNDAQDPLKASFMAGSGAFGYKMXDIRVDVEGLXSQLNKNDVSGAVFTPATVADNVTAFSGLVNVYYDVAIEDMPVTPYVGIGVGAAYFSNPSSADTVKDQKGFGFAYQAKAGVSYDVTPEIKLYAGARYFGSYGAKFDGEKKQGSGENEVTTTDKGAYKVFYSTIGAEA

SEQ ID NO: 18685 - protein, 162 aa, Wolbachia endosymbiont
SYYVRLQYNGEILPLFTKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVEAGVSYDVTPEVKLYAGARYFGSFGA

SEQ ID NO: 18686 - protein, 162 aa, Wolbachia endosymbiont
SYYVRLQYNGEILPLFTKVDGITYKKANSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGA

SEQ ID NO: 18687 - protein, 163 aa, Wolbachia endosymbiont
SYYVRLQYNGEFLPLFTKVDGITYKKDKSDYSPLKPSFIAGGGAFGYKMDDIRVDVEGVYSYLNKNDVIDVTFDPANTIADSVTAISGLVNVYYDIAIEDMPITPYIGVGVGAAYISTPLEPAVNDQKSKFGFAGQVKAGVSYDVTPEVKLYAGARYFGSYGA

SEQ ID NO: 18688 - protein, 188 aa, Wolbachia endosymbiont
SYYVRLQYNGEFLPLFTKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDATTGKDKGELKVLYSTVGAEA

SEQ ID NO: 18689 - protein, 196 aa, Wolbachia endosymbiont
SYYVRLRYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTVGAEA

SEQ ID NO: 18690 - protein, 187 aa, Wolbachia endosymbiont
SYYVRLQYNGEILPLFTKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYSTVGAE

SEQ ID NO: 18691 - protein, 196 aa, Wolbachia endosymbiont
SYYVRLQYNGEILPLFTKVDGITYKKDNSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTVGAEA

SEQ ID NO: 18692 - protein, 163 aa, Wolbachia endosymbiont
  misc_feature (112)..(112): Xaa can be any naturally occurring amino acid
SYYVRLQYNGEFLPLFTKVDGITYKKDKSDYSPLKPSFIAVGGAFGYKMDDIRVDVEGVYSYLNKNDVKDVTFDPANTIADSVTAISGLVNVYYDIAIEDMPITPYIGVGVXAAYISTPLEPAVNDQKSKFGFAGQVKAGVSYDVTPEVKLYAGARYFGSYGA

SEQ ID NO: 18693 - protein, 191 aa, Wolbachia endosymbiont
SYYVRLQYNGEFLPLFTKVDGITNATGKEKDSPLKASFIAGGGAFGYKMDDIRVDVEGLYSWLNKDADVVGDTVADNLTAISGLVNVYYDVAIEDMPITPYIGVGVGAAYISTPLKTPINDRKSKFGFAGQVKAGVSYDVTPEIKLYAGARYFGSYGANFDGKKTDPKDSTKQVTDAGAYKVLYSTVGAEA

SEQ ID NO: 18694 - protein, 226 aa, Wolbachia endosymbiont
GYPITDDLDVYTRLGGMVWRADTKSNTPGGESTKNHDTGVSPVFAGGIEYAITPEIATRLEYQWTNNIGDANTIGTRPDNGLLSVGVSYRFGQQEAAPVVAPAPAPAPEVQTKHFTLKSDVLFNFNKSTLKPEGQQALDQLYNQLSNLDPKDGSVVVLGFTDRIGSDAYNQGLSEKRAQSVVDYLISKGIPSDKISARGMGESNPVTGNTCDNVKPRAALIDCLAP

SEQ ID NO: 18695 - protein, 183 aa, Wolbachia endosymbiont
SYYVRLQYNGEILPLFTKVDGITYKKDNSDYSPLNGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDA

SEQ ID NO: 18696 - protein, 196 aa, Wolbachia endosymbiont
SYYVRLQYNGEILPLFTKVDGITYKKDNSDYSPLKPSFIAGGGAFGYKMDDIRVDVEGVYSYLNKNDVKDVTFDPANTIADSVTAISGLVNVYYDIAIEDMPITPYIGVGVGAAYMSTPLEPAVNDQKSKFGFAGQVKAGVSYDVTPEVKLYAGARYFGSYGANFDGKKTDPKDSTRQVTDAGAYKVLYSTVGAEA

SEQ ID NO: 18697 - protein, 212 aa, Wolbachia endosymbiont
GPISDEETSYYVRLQYNGEFLPLFTKIDGATGAKKKTADTGTTTDLYKASFMAGGGAFGYKMDDIRVDVEGLYSQLSKDTLDVAPTPAIAESLTAISGLVNVYYDVAIEDMPITPYVGVGVGAAYISTPLATAVSSQNGKFAFAGQVRAGVSYDITPEIKLYAGARYFGSFGSHFDGEKQDPTDASKKVADKDANKVLYSTVGAEAGVAFNF

SEQ ID NO: 18698 - protein, 172 aa, Serratia marcescens
MKKIACLSAVAACVLAVSAGTAFAGQSTVSAGYAQGDFQGVANKADGFNLKYRYEFDNNPLGVIGSFTHLEKDGSQDGFYNKAQYNSISAGPAYRINDWASIYGLVGLGYGKFTTNAQNGTSRHDTADYGFTYGAGLQFNPIENVALDVGYEQNRIRSVDVGTWNVGVGYRF

SEQ ID NO: 18699 - protein, 234 aa, Listonella damsela
MNIKLLSLAVASLISTSAVAVTIDYRHEMQDQSGNTHKDRLLMSHRFANGFGLSLEGKWKGAQDKDKPFNETVSNGTEVVASYVYKINNTFSIEPGFSLDSNSTSNNYRPYLRGKAVIVDDLSVSLRYRPYYKRTSANINTPKDTSENGYNLTSVISYKIAKDYQLDYEIDYKQANKAGVVLADKENYDWSHDLKLTYKWDKNWSPYMALGNVSGSKNTDERQTRYRVGVKYSF

SEQ ID NO: 18700 - protein, 703 aa, Wolbachia endosymbiont
KIYYEIRSKQASKQASKQASKQASKQASKQASKQASKQASKQKFSLIYSLLIAFLFIPYSVSGEPKYVQEYFVKERGIQYFGEGSGASVFYSLKDMLDRNSVAWSPVPKQIIDYITNTEACYFSHPDSPKDDCQLFGSNTYEKKWFLTDFSEQKYGAEEENGIFGNEYAKHFVYPFREDFPFYSESEKLLSSCLDQSYLYDTIETEKNKPAINALINNRVYDFNVLAIDNYRSKFPDETRGLTLTVKNQSEVRGATLQLLKMVLQDSLWEPRFNSDVHHLETQNANIRFNSTNTRLTVHENYQGDGSRFFIKFNPKEATQPVLTFDKDVTGTSNIVFEKPIDDLKSLDGHQIIKVNGTADKHAFRLSGKHQKGIYTLSLQQRPEGFFTKVQERDDIAIYAQQAQAANTLFALRLNDKNSDIFDRTLPRKGLWLRLISGHLSQDVQGKTAPVEGNRKGIQLGGDVFSLQNQDYQLSFGLMGGQAEQRSTFRNSDTDNLTTGSMKGFGAGIYATWHQLQDKQTGAYVDSWVQYQRFRHRINTEDGIERFTSKGITASIEAGYNALLAEHLTEKGTQIRFYLQPQAQLTYLGVNGDLTDSGNSKVNLLGSRQLQSRVGAQAKAQFTFTNGVIFQPFVALNSIYQQKPFGVEIDNERRVINNKTAIESQLGVALKIKSHLTLQATFNRQTGKHHHAKQGALNLQWTF

SEQ ID NO: 18701 - protein, 800 aa, Escherichia coli
MLFCRTALAFAVSAAFVSATGVASEKLDMSFIQGGGGVNPDVWAALNGSYAPGRYLVDLSLNGKEVGKQILDVTPRESNELCLTEAWLTKAGIYVSADYFREGYDATRQCYVLTKAPSVKVDFDVSTQSLALSVPQKGLVKMPENVDWDYGTGAFRVNYNANANTGRNNTSAFGSADLKANIGRWVVSSSATASGGDSGGNTATINMFTATRAIRALSADLAAGKTSTGDSLLGSTGTYGVSLSRNNSMKPGNLGYTPVFSGIANGPSRVTLTQNGRLLYSEMVPTGPFSITDVPLYTSGDVTMKITGEDGREQTQVFPLSVMAGQLSPGQHEFSVAAGLPDDDSDLKGSVLAASYGYGLDGLTLRTGGVFNQDWQGVSAGAVLGLSYLGAVSADGAYAKAKYRDGSRSGNKVQLSWSKQLEMTNTGLRVSWSRQSEEYEDMSSFDPTELWSQSNHGRRTKDEWNAGISQPVGGLFSLSVSGWQRSYYPASMTGSYRYSDDNGKDTGITGTMSTQIKGVSLNLGWSGSRNTRGGNNWSASASVSVPFTLFDRRYSSSTSVSTSKDGGTGFSTGVSGSLNDRFSYGLGGGRDSSGGVSSYLNVSYSGDRAYLSGALNNSQSGGTSGSVSASGSVLAVPAAKDIMFSRTTGDTVAVVNVKDTPGVKVTSGDGQTDSDGNLVVPLNSYDWNTVTIDAGTLPLSTELTNTSQKVVPTDKAVVWMPFDSLKVKRYLLQVKQRDGEFVPGGTWARDSKNTPLGFVANNGVLMINTVDTPGDITLEQCRIPAARLQDTEKLQEITCE

SEQ ID NO: 18702 - protein, 1070 aa, Chlamydophila abortus
MIEIHSCRITYVFLKKLFVACFFGMSFSIPVFAEDYGMHNYESSQQKQAQTKKSIMVKGKVVDEQGEPLPGVNIVVAGGTRGVATDLDGSFTIAVLPTDALQVSYLGMEDMTVAIKGRTELIITMRTKPDELDEVTVVAFAKQKKESVIASVSTVKPAELKVPSSNLTTALAGRVAGLIAYQRSGEPGSDDASFFVRGVTSFTYARGPLILIDGVEMSSSDLARLQVDDIASFSIMKDAAATALYGARGANGVILVTTKEGKEGKASISFRYESSLSAPTSKIELADPITYMKLNNEAILTRNPMQAVPYSMEKIEMTQRGANPLIYPANDWNEIMFKNFAVNHRANFNVSGGGKVARYYIAGSFTQDQGVIRSTKNSDNAIDLKKYLLRSNININLTKTTEAVVRLHGAFEDYNGPIVSGNDLYSRVMRSDPVAFPAYYAPDAANAYKEHILFGNTDQGQYINPYADMVKGFKNYSRSTMMAQFEVKQKLDFITKGLNARALFSTNRYAYFVQTREYTPYYYAVSMYDKINDTYVLNCLNPDKGSEWLSYTEGSKQVNATTYFEAAINYDRVFGNHGVSGLLVYNMRNYLSGNAGSLLLSLPHRNMGVSGRFTYNYDSRYFLEGNFGYNGSERFAKNNRWGFFPSIGFGWILTNEPFWLNRTDGWKHAISKLKLKATYGLVGNDQIGKDEDRFFYQSDVNVNDSGRKYIWGQDFGYTVNGVSIKRYANESIGWEISKKMNVGIELGLFDKVEIQADYYTERRSNILMSRADIPATMGLQQTPQANIGKAEGHGFDMSIDLNHSFTKDFWITGRANFTYSKSKYKVYEEPDYSSTPWRSKVGRPISQQWGYVAERLFVDEQDVASSPVQSFGTYMGGDIKYKDINGDDKITEADMVPIGYPTTPEIVYGFGLSTGYKGFDFSFFFQGLGRESFWIDAKKTSPFVDTDDNSSIVSKNALLKVYADDHWSEDNRNVKALWPRLSGTLVENNIQRSTWFMRDGSFLRLKSVELGYKVPDKYTRRAHITNLRIYASGTNLLTFSKFKLWDPEMAGDGMRYPVQRVYNLGIQLSF

SEQ ID NO: 18703 - protein, 2488 aa, Chlamydophila abortus
MSNNLHKVEKDLRSIAKRYKSIKYSIGLAILFLMLGVGAFSEEVDSSQANGVPTREEIASSKENLKNSVGSLQSKIDSARAENEKGLVGLKLELIQLMEQGDQVVKSPWSSWQFGANYMYSKWDGTYKGRGDKAEKYPYEGVYTRSSDLFLRNISTDSDVYEKYTSSINETSANSATTSTIRKKGGSLGYGIASTLPAQEPIVQIELGASVRPKKISKSPVAVTPPSITVNAVTPLSTPQPPGAPTPPTISIPEFNPVAPDPITVSLPTPPTFNIKLGSFCNYMTPNCEASTHQSGQHPENGGKNSGTAYSFDHNNGIISITESSLLGGPAVRYAWTSYNSALLKVYFDYGLNSNGMGGGTAKVDTNLTIDSIMGNITPNANANFDWNKGKFLTGGSRVATLDNARNATIQNNKTINMMGPLVVGYEVQSDNSTIFGGGHFWNNEVRILENSETGTLTDEIEKSDQTADNRLNDLLKVKQIYENGSGIHGYNPNSNGAGTVDSTTLTLPTFAGGGNLNISRDPDIGYKDENGNFITTKYGGYTGYKIGLILTYENIDNRDSSNYILRNKGTINFQGKRSIGIQVYAPGSDNNKINAPKVTVKNIGDKADITLGGVASYGLKLSSRVDENSIVENEGKININGDNTKSYVLDNNNPNVKTGIYDGDADGNRDNYSLSSGIAVIEDNTLKDNSSIRAYQGKVQNKGTINVSGGQGNTGMVLKVKANDDITNDGSGTITVTGIKNIGMRVDLGTTKTDNNPANIIPKAYNKGTITITNGEQNIGMVANSSESSGGNIVHKAIAENKNNITFTGKASNAIGMFSQDGAEIINATNGKITGPTVGGLEGTIGMVIQPKIAPTNVGSSGINNGEINLTGTKVTGVYNQGTFTMEGANSSITTSGKKAISLYAIGNSSTTNINSGKIIAKDGALGLFADDTTINLGNNTAAPELEGHGKGTLLFYNYTKNSSGSYESKGKFKINKETTAKLTTGATAFYFKDITPGSATGGATDQTTADKLNKMFAGSIDKLKLRLDKDSTLFVLDNKIFNTGAIPLSSIQPTQINNYLGDHVSVDTNNSSKNFKAYKTTRGTLSIDEDVQLDNHTGTAIDSYYRVDFLNSAVTVEAGKKMVGTDATEIEQVIAQANYEDATSDNHVKVINNGTIDFSKKGGTAIAVDYAPATNNGLIKMDAANGTNKNSIGLFGASSSKLTNSSTGEIQLGTRGVGIWGANKIGSSVGTWSKNINITNNGKITGLSGKEGVFGIYAVNDIATYTGATSNIVHGVTGNIDLSQSKKSIGIYMANGTLTSSGNISVSDKSVGLDATTSDVRISGGTHTIGKESVGFKLTNISNTKKFLGNSGNISIKDKGSVAYLIKSSVLTSGTNFKDNLALTSTSAYTYMSLINHSMLDYMNTKTIANDDSIFVNTKDSTVSLLSGTSVTSTNKKVTGVYSENSAVSNAGILALTGDESSALYGKAGSFLINSGKITIGKSGSGIYSIDSTGKNNGEITIGQGSVGMRAEDAIIENGVAGKILSTGVSALGMSQSGGTQNITNKGAITLMGDKSIALHSKGITSPNHKVINVGNITVGDSSNILSPSIGIYSANGVNSTVENSGKVVAGKKSTAIYAGNINLTGTSETTAGNGGIGVYSKIGNVNISENSKITVGATLGSGQEGVGVYLAGNNQTLNSNTDKLSIGKGSFGYVMTGQGNTIRTGKIGTTGVIKLSDDSVFMYSGDKTGTIKNYNNLKSIGNENYGVYALGSVENHGNIDFSQGIGNIGAYSYVEGATTTPNAIKNYGTIKVSKSDINDPDNRKYGIGMAAGYSEETPKGSGNFVTRGIGDIENHGTIKVTDPDSIGMYATGSGSKILNAGRIELSGPKRNIGIFAENGAEVINTGTITTVGSGNVGQIGIAIRKGAILDNRGTINIDASKGYGLLIAGGIVKNYGEANITVDSGATKIKEIRASDTSKEIEDLRGNKVKIYSPAGAANGVITENGVVRKPTVVHVQAIANRKPNDIPTSSVGMYMDTSGINYTRPINNIGALRGLTQSDIIIGVEATKYTTAKTIQLGQDIIEPYNDMIRKSGIEKFSIYSGSLTWMASITQLPDYTIRNAYLRKIPYTVWAGKMATPIDKKDTYNFTDGLEQRYGIEGIGTRENGVFQKLNSIGNNEEILLYQAFDEMMGHQYANVQQRVQSTGIILDKEFNYLRDEWRTASKDSNKIKTFGTNGEYKTNTAGVIDYKYHAYGVAYVHENEDIKMGRGTGWYTGIVHNTFKFKDIGNSKEQMLQAKVGLLKSVPFDVNNSLNWTISGDIFVGRNTMHRKFLVVDEIFNAKSRYYTYGIGVKNEIGKEFRLSEGFTLRPYAALKLEYGRVSKIREKSGEVRLEVKHNDYFSVRPEIGAELGFKHYFGMKALRTTLGVAYENELGRVANGKNKARVAHTDADWFNIRGEKENRRGNVKFDLNVGLDNTRYGVTANIGYDTKGENLRGGLGLRVIL

SEQ ID NO: 18704 - protein, 926 aa, Chlamydophila abortus
MRPSLYKILISSSLTIPISFHFSQLHAEVALTQESVLNANGVFSPLSTSTAGGTTYNVESDISIVDAGQATALASAAFVQTAADLTFKGNGHSLSLANINSGANTTGINVSTADKTLTLTDFSKLSFTKCPFFTTNTGKGAVQSGGALNLANNASILFDQNHSAENGGATSCKALSLTGSIKEISFTTNSSAKKGGAIATTGVANLSDNPGTVVFSGNTAVNSGGAVYAEGATTIAGNGRVVFSNNSVSGSNDGCGGAIHCSKSGTTPILAIRDNKVLIFNENTSAEKGGAIYADKLNLSSGGLTIFTKNKATNATPKGGAIGISSSGECSLTAELGNITFENNLIATANNSSIKRNAITIESNGKFTNLRAASGKSITFYDPIVCEGACADLLTLNKAEGTKVYNGKIIFSGEQLTPEQTAIVDNSKTIFTQPITLAAGELILRNGVEIEAKTVSQTDGSLILMDTGTKLSAKTEDVTLTNLAINPNSLDGKNLAIVAAAASAKNVTLSGAIGVIDPTEKFYENHKLNDRLALEGIKLSAKGAVTTTNVPGATIGTPEKHYGYQGHWTVSWVSDDTSDPKTKVAVFNWNKTGYVPNPERRASLVLNSLWGSFMDVRSIQEVLERSVDSLLETRRGLWISGVGNFFHKDKSAESRQFRHISAGYVLGATTNTSQEDTLSVAFSQLFGKDKDYLVAKNSANVYSGSLYYQHVGKFDNLTRLFKGPNSCCSGYSKEIPIFLDAQVTYCHTSNNMTTAYTDYPEVKGSWGNDTVGIALSTSVPIPVFSFSLFDSYAPCAKLQVVYSHQEDFKEPTTEGRVFESCDLLNVSVPMGIKFEKLSFGEKTAYDLTLLYVPDVYRHNPSSITGLAINDVSWLTTATNLSRQAFIIRAGNHIALSSGFEMFSQFGFELRSSSINYNVDLGTKVSF

SEQ ID NO: 18705 - protein, 794 aa, Chlamydophila abortus
MQGIIRGVLMAGTALVALPVLGGPVQAADQPAGRQGAEVSEGVAFKIAAQSLDGAVVAFGRQSGWQVSVDPPILAGKSTPGVSGRMTPEAALAQLLSGTGVTWRRTDAKTVVLSKAEVDGVVTLDPLRVEGRAESAYGPVGGYVAKRSATATKTDTAILDTPQSITVVGAEEMETRNVQTLEDAIKYTPGVALSYGATGDTRSSWYQMRGFPVTTTFYRDGMKVSGQSWQKIDSYLLERVEILRGPASVLYGQNEPGGLVNAVSKRPQDTQQGEATIEYGSFDWKRAEGDITGPLDDEGHWLYRFSAALQDSDGLNGIDHDRNDRKVFAPSLTWTPRDETFVTLSAVYQEDDSRGWWPRQSYRSAAGTVDPSTYLGEPDYDSYHQEQNHLTLQAEHAVDESLKVNLSARYSKVNLTYHQTWPGAIEEGGTTIDRGNYAYKQDASVYTVDAHVQKKLSLFSTHHTLLGGIDYLNQDRDELFGMASDNGISLINPVYGTYNVAKADSFSKGDVRSAGLYAQDQIEIGEHWVFQLGGRQDLAGWAGASDYESTFTGRLGVAYKTDFGLVPYASYAESFEPQSGSGWGGARFEPTTGRQYEVGVKYEPPGTNIMATVAVFDLVKQNVLTTDPDPTHLCEGSRCSVQTGEVTSQGVEVGLTMGLAAGLNAVAAYTYNPIEVTKSTIAGEVGRQQAATPIHTASLWADYTVQNGPLAGLGLGGGLRFIGKTTSSADDLSTGPQIIDEAMVRYAVKDWKMSMNVKNILDRDIEYSCNNQAHGRVCYLNEPLTITARLTRSF

SEQ ID NO: 18706 - protein, 786 aa, Chlamydophila abortus
MRNRWRHEATPRAQHAEGVFLPRLRRVWCAFSVKLRRVLVPAAPSAVKREAGSARPKRCANLRCPRNGKRTPRVPAISKRRWVPRGLSRCHCSFGNGKADRPLRQPGYRPGRWISEPMCNPGGNRIEILLPATRGGTGPADASCLFNMSLTIKRPLRMPRTAMRALAGALTGVMAGAVAPAWAQSNTQVASTPVGELNPTVVTASRSEQPLSDALPHTTVISRADIERSQAPDAVTLLRREAGIEIAQNGGPGTNASLFMRGAGSNQTLVLIDGVRVASGTSGGAQIAQLMSDQIDHIEVVRGNVSALYGSDAIGGVVQIFTRNGRGHGPLANAEIEYGARNTKRAQAGISGSVGENGDTSFALSVSEFRTNGFSTINPLQAPKANPNDNPYTNKSVSAQLSHRFPADWQAGLTYFQTWGDVSYDNAFGKPTDNNVAHNVVRSMSAYVDGKVTQDWKTRVTLSQGDDRSLNFTNGVLQVPARFNTRNQTASWQNDWAFMPNQLLKVGLEHLQTSIDSDAYNVPTRNVDSGYIGYEGKFGPHQLQLNLRRDRYSDFGGANSYYAGYGFAFNPQWKAVASVSNAFRAPSFNELYYPFFGNPNVQPEKARSVEGGVEYSSAMGLVRVTAFETDYSNLITSVFDPVAGTFTAANVNRARVNGLETSYRGSIYGVDLRASFTMQNPQDLSANQLLSRRARHFGSVSAYKTFGPFSAGVEWNAAGDRQDSTQTLGGYGLLNLVGRYQITPDWAVSARVENVTNKNYQLIYPYNTASRGVFFTLSWQQHKPKR

SEQ ID NO: 18707 - protein, 988 aa, Chlamydophila abortus
MKASFRKFLISTTLAIPCSFQAFSLEIIVPNGTYDGNLKQIFPYTSISNPEGTTAILSGNLSLLNLDNSMMATPSSCFSNTIGPMTIVGKNHNITFTNLRTSANGTALSSTPSANADTSPYTITGVNTLSFVNCAALTARIITPASTVSPKGGALYTSCPLFLKDIQNLDFKNNSAADNGGALWAKEADISNIKKSMQFLSNVGANGGAIGSSTSVSVTQCPTVLFRSNSAEKLGGAIHTEDTATTNQKNANVSFAGNGSVQFDANNAKSGGAIYSKGNINFSNNTQLLIQNNSASPEVAPNNEVLGQGGAIYCTKQNTTPPDFTGLTITKQNDILFANNFAATSGGAIYGEKVSITSCGKTVFTNNIAKDGGAIYIPASGDLTLAADYGDMIFYENFKKDGSTTTRNAITLEKGAKINLLAASGDHKLCFYDPIVTNLPGTAPNNNQLTINQDRTANTPFTNYIGTVLFSGAQVDSQSAAQPTNFESTIYQNVVLGGGKLVLADKASLSTVSFSQEADSILLMDNGTTLAITEHSHQTNGGNPSSQANATGTISIKDLHINASSLTQTGEGAKIEAKNATGTITLEGYVSLDDISGTTYENHALFNQNSVSFNALTLSTKEASKITTTSLQMTPRGDTEPKYGYQGSWQFAWEDSADQKKKILKATWTKTGFIPSPEREASLVPNSLWGAFIDLRSMNSLATASCDGFGYGKGLWIAGLSNVFHHDRNDVSHGFRRISGGYVIGANSQTISGSVFGVAFSQLFGKSKDYVVSTTKSQAVVGSAYLSIKHPLSNTIFTSFSARINYSYTHEDMKTRYTFIPEEDGNWNNNCWLGEVGGSLPIILPTTKLHLNQFVPFVNIQMGYAEHGSFREKLTEARSFCSSRLINLAIPCGLKIDRRSHSHPDFYSLAIAYIPDVWRRNPGCNTLLLANGFTWKTPATNLDRQGLLIQGSTHTAVNNHIEIFSHGSAELRKSSRNYNINVGSKFRF

SEQ ID NO: 18708 - protein, 981 aa, Chlamydophila abortus
MPLSLRSSSFCFLACLCSSGVSAQTINQAKLKPPLYDIGEAFYLTSNCFFEDTYGAKFPTSFLGSSTNFTVFGRNRSLIFVQSHAPVKEGAALISAVDSLKLTDLSKLVLNENISTGKNGLISGKNIAITSSKSLVITNNRAPYTPVVTSVTTPTASTTVNCFCGSAIHTETNLNITKIRDNISFNSNSANFGAALLNKTDATCTIENNAAAISFCQNFAACGGGAIYDGTISIKNNSGRITLEGNTAANGLLTTTPNPNVVIAAGCGGAICAPTKSVTFANNSGICNISYNLAEQDGGAIYTTTCDLATHAPTYFNKNAATRYGGAICAKALTINAHGPTIFVSNRAEKGGAIYVASTVGDTTAGPDSTLSLSTSSGDMVFVGNMLDSRPGTRNAIQIEGDGKITSLNATGLSSIIFHDPIANPGPTTVTTLDTITINSSGCSGSVKFTSETLSISEQLNPDNSTTSLFGKVVIEDGQLVVTNKAKVNVLGLTAETGRLTLGSGAAIGMLTTTNNQPPSENFVIKKLGFDVKSYLNPNYATATVTTTNTKTITLEGPLDLVSEDNEELYDNPLLVNALSIPIATFTSNNGNPTTTSFTTGDLAVSKHYGYQGVWSSTWTIPLLAPTPNGGIPSGTNNRTLYVAWRPDPAYRAPYVLAPERRGELVSNTLWTSFLATQTFAEALEETFLSEQEGVLISAKALGSYVRHPMKKTHEGFKGQFGGYQASLGIHYPDDASVGLAFGQLYGQVESKPYDAQSTEQISLVAFFGKFPIATENTVTNISWEASYGYAVNRMKTNYLNAITQKTRQSKGRWHNNTYYASVSVEHPFLTWCMLTRNIAHDLELSGFISAEFMGGWQNAFSEQGALPRGFSRGRGHNITLPIGFTSEWGTPFKKAPSMLTLKLAYKPDVYRVNPHNVVTILANGEKTPITGAQIPRHGFYLQVHDSVELSRHATGFVDYVFDSKRSYASHRITTGLQGRF

SEQ ID NO: 18709 - protein, 715 aa, Chlamydophila abortus
MKSTHKNRLAVSALVIPALLPVSASFAQDKDSEQTMVVTAKRSGLSELSTPAAVSVVTGDQIREARPQINLSESLGSVPGLQIQNRQNYAQDLQLSVRGFGARSMYGVRGVRIYVDGIPATMPDGQGQTSNIDLNSVEKVEVLRGPFSALYGNASGGMVNVETETGQQPPRIEAGSYFGSYGTWRYGVKATGATGDGTHAGDVNYTISGTRFTTQGFRDHSGARKNLGNAKLGVRIDDVSTLTLLFNSVDINANDPGGLTNAEWHDNPRQAPRADQYNTRKTTSQTQAGLHYQREMGVDDDLSIMMYAGERETTQYQSIPVAVQQRSAQHPGGVIDLTRHYQGIDTRWTHRGELGVPYTLTGGLDYETMTEQRKGYENFTQVNGVTELGTEGALRRNERNLMWNVDPYLQTSWQLTQQLTLDVGMRYSTVNFDSNDHYVTGANGDDSGSASYHQWLPAGSLNYAVMSGWNLYLSAGRGFETPTINELSYRSGDQAGLNFGLNPSTSDTVELGSKTRIGNGLLTAAVFQTDTRNEIVVDESSNGRTSYKNAGQTRRRGLELALDQQFAYDWRVQLAWTLLDARYRDDVCGDSQCSATNMVPSGNRMPGIARNMGYASLAWSPPEGWYAGAEVRYMSDIEVNDANTEQAPAYTTVGLNTGYRYPLGNWMLNVFGRVDNLFDRQYVGSVIVNEGNGRYYEPAPGRNWGGGLSVSYTFE

SEQ ID NO: 18710 - protein, 412 aa, Chlamydophila abortus
MVSAWGNAVQNLNRKGIGLVIDYTSESALALDAGNAGDAGYAHQIGVQLDLDWDKLVGWRGFVTHAAIVNRAGHNMAADFGDRSLNGFQEIYGGGGNTAVHMVYVYGTQNLFHDRVQIAIGKLPVNIDFSASPLFCTFMNKSMCGNPKSLTRGAAGFGTYPGSTWGTRVRYWPMHGVYAQAGLYGVNPDLNTNRYDRTGFNFNTNLYTGVYVPVEVGLIPSFGRNQLVGHYKVGVAYDSSNYADNYYDVNGAPLALTRRAARMDTGKTQLWIEGDQMLIRNGHGPLNGFYVMAGLVRNTPESSPYLYQYYFGIVDRGFWRARPDDTFGIEVSRATASPDLVDTQWLDYAAGRKLPANATYPQSHISVLEATYNIHVCEGLSIQPDYQRIMRPNLQRNKPAIDAIGLKIHATL

SEQ ID NO: 18711 - protein, 823 aa, Chlamydophila abortus
MKMKLLLNSKYYLILVFVLTFHTVLAQEPNTQNPPQATENPNPNPASEETIPEENPEDPKWKKAEIRVIGDKKDLKRIPGSATIITKKELEESRPTDNMEILRRVPGANIRYQDPAGLTMNLGFRGVSGEVSRKVLVLEDGLFTSLNPYGEPEMYYTPSIERMERIEIVKGSGSILFGPSTIGGVVNFITRKPPKDPKLTLQTIGGENAYFSQMVNYGGTFGNTGFDVNVLRKQGDGFRAHQGYFVNEANVKTIHQLNDKNNITTKIGFHQQESQATYVGLTTGMFNNNPKDNPAQNDKRSIERYSFSIGHEYTFSEKTKLITRVYSAYTERNWARQNYARNSRGSSIPSDALATYDGEPYTSRNSDTIWMRGTNAHRDRTYKFAGIESKLQTELETGSIKHEIDLGVRYHIDMAKVQLLNGPVTPDFVLYPNGPGTSAVVLQSQTSLATSGELRDDERRSAKAVSVYFQDRIRLTDKFSIIPGVRYESFSQTRSINRGRRDFNPVTFDYASGTNPTVQLDKTASTRNQIVLPGFGTTLDFARNLTWFTGVHRGFSPPRYESAISPTAEDLVLKPERSWNYETGVRGDITEYLSGQLVGYLLNFEDQIINSSAAGGNLGSRPVNAGRSIRRGVETNMTFDFGQFWKWNYNVPLDIIYTRTEAKSNQYTYNLTEWTRGNTNPLVHIDTNGNRLPYVSRDILTLSIGISSRSTGFYARVEWQYFSKQFHDLENSKSVYWYDSVGTSTDNRLLLSYAGIKSDASGLDGEIPAYELVNANIGYKKDNWSVFVSGKNLQDRKYISSRLPEGIQPGPFRQVNFGVTLQL

SEQ ID NO: 18712 - protein, 242 aa, Chlamydophila abortus
MKQSYKVIIASGLAIFATQALANDYKTTVEYRHEYKDGNNKHADRVKMFLDTGKNIGFELDARYNNKDQDQMYDEMSMNGSELSIFYYDKIAENTTGLLGSSLDFNPDGLVYVPYVRVNHSFDNGFRAQARYKWKIWDYTQTNAAGEKYTSKIQELDTWLGYNTGKWDFQYEFQIWNETDDDAKPQFDNESYDYLHNFRIMYSFVNPDGTKWRPFVEVGNVRQDSYSDNRQTRYRVGIKYTW

SEQ ID NO: 18713 - protein, 1873 aa, Chlamydophila abortus
MKWLSATAVFAAVLPSITVFCDPLSKELNSNYRGSGSSTADARLTNFTQQTQDASGITYLVSGDVSFSNFTNIPDPKPQPPSTEPETSPETKDSAAKSSESSNPASITQNIAHLQTQLYQSLFQSLGSSSFAPHFSDRDQGNLDLSNYLFSNIHSLSFPFTASAGSTTTTTTTPEDPKGGGAFYNDKDGPLSFTTYAGNPGSLSCSLIKMKGKGGAIYSKGPISFDGLENLTFKDNLSQQSGGALFTDSTLTIRNILNSIEFTTNAARVPIPLIPIQPAPTNPPAGSAVTGTLLASDSSEKKAANTSPTLPVYTTETAGNGGAAFATGAMLITTYKDMTFRRNSAEFPAIIDTIQATIDANKNKVVSAVPKSSQIISAAQPSQGSTTPEVIKGSGGALFGLDTITVSEGSGTTLFILNTATGNGGAVYGDKAVSFNNITSLKFQSNSADKQGGAIYSKGNLTIQDSSLLTMFNGNNGKTGGGAIYSLGDITLSNLSQVSFGANKAGNYDITITVKNDEGTNAIVPSVQSKISSALLASPPANLSASASAVDPAPNPPLGKGGGIYVGNNLSISNITSTLEFVKNQSTDSGGGVYVKGTLTCQDSHRLQFVSNSSKKSGGGLYSETDVTFTNLTGNTLFQGNTAEEDGGGICLANEKSLNMSNLESFCLIGNTSTKKNGGGANIPKALSLTFSAPNSSPDAILSETPAVIPVFGSAIISGNKAVEGNGGGIYTKKASFTNLELIDINQNSAKNGAGLCTQNISSSAASASGVGGLGGVGGFIKTSTGISSQKSEVAAVVSGAPAATPDDLDFKVDYVVTTNITKNAATENGGGVYGNKGQISRLDLLNITENSSGKCGGGLYFQETLTLEGIEVSNISNNTAKESGGALYAKTLTCKTFTDGLTVSNNKAETTSTVSGTNVVNASAAATNGALQAATLTEKFSTDNKAEAHASVAPAAQQASVPTAITGGALYAETLTLEGLQSTCAFSGNQAIDNNATDSTADTPADPDIQGGAIYAKTKFTLQNCSGNLTFKDNSVLTKRSQTTGQLAGGAIYAPTVEIKNCSQAINFSNNSASCTPKTAGASEKAGAGITPKESFGGAIAGTTSITFTGNQAIFFQNNSADIGSAIGCKNGNNNNGTVTFSDSGYYLFEGNTAKNRGTIYATTLSIPNGYLNFSNNSSANDGSAIYFTKQADITAGSSVLFLNNKVTLAQTPTSKNGKSAVNNLGAAIYGEPTSSSDDANLNLTALGGSITFKNNGCTAPTRQDNQVKSFCSIAGKVKLTLNAAENHSINFYDAVNITTQKTSDYNPLDINKPSNGKTSQQYTGTVLFSGELHEHKSFIPQKATLHAGTLVLGKNAELSLISFEQKPGSLLVMGPGSVLSTHKPTASGSAASGGIVINNITIDFSEIVSDNGVASPPTLKLGATPTPIAAGPGAHRSKQSALPQANKQAPDVDQEKIYLTGTLTLIDPSGVFYQNPYLGQDREIELLALPQDSSKVDISDLTLAGDTKPLKGYIGTWELQSTDQNGKLQAKWKFEEYRRWIYIPRDNYFYVNSILGSQNSLIAVKQGVVNNMLNNARFDDAAYNNLWLSGIGSFLQKSQGEESREFTYHGRGYSLAIDAKPRPELILGAAFSQVFGHAKSEKTVDNYKHKGSDHSFQGTLYAGRAFYLPYKRTKAPRPILLQGVVTYGYMKHDTTTYYPSIQERNLGNWEDLGWMFDVRMIMDLKEPSQNSTTRFSFYSEAEYTGVRQKQFTELDYDPRTFDSFAYRNLAIPLGFVMEGALMQYDILMYNKLSLAYVPVIYRNKPKCSYRVDSTGQTGEVYGVIPTRNAARAEYSTQLYLGPYWTLYGTYTVEAGMSSLVQIANCGARMIF

SEQ ID NO: 18714 - protein, 805 aa, Bacteroides fragilis
MNHKVLYRVALFCLFSMLSAVLMHAGEQQQQSKGIVTGRIVDQQKQPYYPVAVAIEGVYIGGYTNENGVYHINDVPAGSQTIVVSGIGVKTKKVPIHVTAGKVNRIPDIEIDTQAEELEEVQVIGKSEARRQQEQAYAISVLDIKKAYNSAAPLNKLLNNVSSVRIREEGGMGSNYNFSLNGFSGNQVKFFLDGIPMDNFGSSFNLANISANMAERVEVYKGVLPVNLGADALGGAVNIVSRRDANYLDATYSFGSFNTHKVSVNGAYTHLKTGFTVRANAFYNYSDNDYKVFVPIIDLATNKKIDERWVRRFNDAYRSGGIRLETGITNKPYADYLLAGIILSKNDKDVQTGATMDAVYGGVKMKSESVIPSIRYKKDDLFLDGLSLSLYGTYNSVNTFNVDTIARRYNWLGESVPSTSAGEGYYTDSKIKNREWLGNGNISYVIDGHQSLILNHVVSAMRRTMNDKVRPDDENNNVPQQLTKNITGLGWQIRYDRWNANVFGKMYKLYSSTYKRLDEYTENARWEKVRDHKTNFGYGAAATYYILPSLQAKFSYEHAYRLPESIEMFGDGLIQQRNPDLKPESSRNLNLGLSFIQTFGAHQLSADGNFIYRYTTDFILKGVSLTSNPTTGYENLGKVLTKGVEAAVRYNYKDLFHTGAGFTYQDITDRQRYEKTKDSFVGEGITENITYKERLPNIPYLFANADAGVRFHDLIWKNSVLTFDYNLNYIHSYYLSFPGLGAKSSKKVIPEQFSHDLALGYSMDNGKYSVVVECTNLTNQKLYDNYRLQKPGRAFNVKLRYFFSK

SEQ ID NO: 18715 - protein, 920 aa, Bacteroides fragilis
MKRVLKLVSSILLLSVMGGHLYADEKANVVKQGTIRGRIIDTSKQTLPGASIYIENLKTGVISDVNGFYTFANLNPGTYTVKVTYVGYAPVEMKITIPEGKTLERDVILNEGVELQEIVIGGAFQGQRRAINSQKSSLGIKNVVSADQVGKFPDSNIGDALKRISGINVQYDQGEARFGQVRGTSADLSSVTINGNRIPSAEGDTRNVQLDLIPADMIQTIEVSKVVTSDMDADAIGGSINLVTKNSPYKRTLTATAGSGYNWISEKAQLNLGLTYGDRFFNDKLGVMLSASYQNAPSGSYDTEFLWEKDDKGNVYINDYQIRQYYVTRERQSYSAALDWDISENHKLMFKGIFNNRNDWENRYRTTLKDMDEEGKATVRVQTKAGTPDNRNARLERQRTMDFTLGGEHLFGPVSMDWNASYAKATEERPNERYIDFQLKKQQFDMDLSNEREPLATPKSGSTMTLNKDFGLKELTEQQEDIKEKDLKFSMNFKLPFRNGNKLKFGAKVVRKTKDKEVDFYEYTPKDEEAFMANSLQNTVDQTNKNFMPDHKYQAGIYADKQYVGSLDLNNPSLFDKEQVQEELAGNFEARETVSSGYIRFDQKLTDNVELMTGLRIENTSLSYTGRTYDDETDQTSKTARETNSYINFLPSLLMKWNVNEDFKVRGSFTQTLSRPKYSALVPSVNIKRSDNEVTVGNPGLKPTLSYNFDLSADYYFKSIGLVSAGVFYKKIDDFIVNQVSTNYEYNGNLYNRFIQPKNAGNANLIGMELSYQRDFGFIAPALKCIGFYGTYTFTHSRVEDFNFEGRENEKDLSLPGSPKHTANASLYFEKNGLNLRLSYNFASAFIDEMGEDTFHDRYYDRVNYLDVNASYTFAKHYTLYAEANNLLNQPLRYYQGTQDRTMQAEYYGVKINAGFKINF

SEQ ID NO: 18716 - protein, 954 aa, Bacteroides fragilis
MVNMFNQLKIKGMTIINSIYKGKRYAILLTTILTFYAPVLFAQHIADSALVEVANGQQPEWRRTSAISSIRGEDLMKTTSASLGNSLQGQLPGLTLLQQSGEPGYDFSIANLYLRGRTSYASGQKMLVYVDGFEAPIESLSTAEIESVTLLKDASALALYGMRGANGVLLVTTKKGCVSAPQVSIRLQTGIQQPLGVPDPINAYDYTTLYNQARVNDGLPRLYTPEELNAYQNNTDPYFYPNVNWKKAILNNTAPLSMADLSFKGGGDVVQYYVMMNLLQNIGFYKDTDKKRRENSNAYYASFNFRSNLNIQISKHLSTGLNFSGSVGNRSIPGGSSSANGLLGAIWRTAPNAFPVYNPDGSYGGNAAFTNPVGNIVSRGLYKENSRTFQLIFMPKYDLEKLTKGLSVSAGIAYNNYMADSSIKNQNYARYSLSKGAGGEVLYTPYGADSPLESDEGFRTDWSRLNFKAQLDYDRVFKQHQLTASIFFLSDLYQKYGSRDDIKYLNYAGRVTYSYNQKYIGEFAASYTGCDDYAPGKRYGFFPAFSAGWILSKENFMKNINWVEYLKLRASIGLVGNNQNENGRYLFDQTYSSNGSYFLGTGSSSTGGFRADMIANPDISWEKERVFNIGLDAVLLKGLSVEFDYFHKERYDILSQPYSTIPGFVGASYGDILPYMNVGKVKNQGFEGTIRYESSLKNNFNYYVETSAWYAKNEIVDMAEEVKLYDYQYRKGRSVNTPFVLVADGLYQESDFDSNGSLKSHLPVPQFGEVNPGDIKYIDKNGDGVVDSNDSYPVGYSNIPEWNYALKIGFEWKGIDVEALFHGVANRDIYLSGPLAYSFTDNGSASKLALDSWTPENPNASYPRLSTRTFENNYRISTYWKRNGNYFRMKNIRIGYTFPQSIARAIKLSRLYVYANASNLFTVSHLDGLADPESSSLITYPLTRSYNLGIKIDF

SEQ ID NO: 18717 - protein, 1300 aa, Bacteroides fragilis
MTEHIAAQPASPEQQNQTPPVKRPKSFWHKLLCGLSAVIFLSILAFFITLSTSAGQRWLIELLDKALPQLSIAQVNGGLQEGLVLNQVRFDAEGVQTQLEQVRLQLDLSCLWRLHICVKEIALHQPHIQVNTALLPPKAKEKPTSAPMQRIHLPISVDVDNVVVEQLRLVIDDNAVDLAHFQTAASLNNESGLTIAPTTIQALLVKVVPPTAAVKEPSQTEKAPIDWVQIEKQLSAPLLAKLENIVLPFDMHIQHIQGQHWQYQQVNAQHTQVIDIPVFQLQANATGAQIELSQFNVESNLANLHGSGHLQLNADFPLHVALHAEMHALNEGEAILLPASQVDVTLSGNLKKQTALTLQSRGALNANLNGQFALSQEKTPFQIKLSSQDFRYPFQPVQPALVHIPQLNLQVSGNLLDYQLQLNTEAEGANIPKTALQFDAKGELLSLDITQLHLDTLKGSADLQGKIGWQNGVQWYSNLQLDKLNLSDYLAGLPTILSGQLFSTGLINQQQWLFDIPHLNLEGTLSQRPLALKGSLSVGSETWLHQLLLKVPDLVLTYGENKIVATGFLGEKSDLKLDINAPDLRGLMPNLSANLQGHLQLNGQLVQPTVALDLVGNQIKLNDLNINKVTLKGHVDMAKQTAGELALQVNKFQSGDVKLDTLDLTLHGNEAQHNLTLVSQGEPVAPKLSLEGQFDRATQRWQGALKQVSIASVIGHWHTDKNVVLAYDNSTMQTEISAHCWQNNDVELCFPQAFRVGKSGEVPFKITKFDLALVNDLLEQDLLQGQLQSEGKVAWFSDKPLQLNVQVKGDNLSFTQKIDYRTFGLDIPKLTLNADLQNNHFVLNSNLLLQDQGNISANLEVKDLAQARQLGGNLIIHKLNLDIFNQLLSNNEVITGDIVANLKFAGTLNAPNLNGQFKLSRLNAKMKSLPFDIEGGELALNFAGNRSTLNGHIKTPDSRLNLEGDASWQNLDNWRSRLHAKADQFKVDIPAMAKLKISPNVEITASPKRLQLTGNIDIPWARIEIESLPESAVSVSPDEVILDNQTSQKITAKLPSKTKSGMEILSDLKINIGQDVYLNAYGLKTNLNGLLSVRQEKGNLGLFGQIHLTNGRYASFGQDLLIRKGMISFSGQPSQPMLNIEAIRNPESMDTAGVVAGIKVLGLAESPEIKVFSEPGMSQDQALSYVLTGRSLENSGEAGSGGSIGAALLGLGLAKSGKAVGGIGQAFGIQDLNLGTQGVGDSSKVVVSGNITPRLQVKYGVGLFDGLAEFTVRYRLIPKLYLQSVSGVTQAVDLLYQFEF

SEQ ID NO: 18718 - protein, 949 aa, Bacteroides fragilis
MKHYSLISNSIKCALLTAAATASSTVLAQDEQVAKKIERVEVTGSRILREGAIAPAPVTVISGDQLVNSGAVNIGEALNNLPALGSTYSMANSGRFIGTAGLNILDLRNMGTDRTLVLVNGKRHVSSSAGSQSVDTNTIPSVWIERVEIITGGASAVYGADAVTGVVNFILKDNIEGLDVSLTRGFADLNSYNNKKATFSYGSNFNDDRGNAAFAVEYSGQDSLNALDHPWTSTSFSSLPNQAQTDENKNSADFPDDILTPNAGYYAINDSGVYALEDPTKLINSFNPDSSARDLYIGNNADPYSCANCDFFNLGQFEEIQPEFERYNVNFKVNYDVTDDLNVYFDAKYVNSQGESIGQPAFFFFDSDNSIKLDNPYLDPSIKARMQEEGVDSIMINRMMSDLGRRVENNTRETTRFVTGLQGTVFEDWELDTSIVYGKTELERENGANMILANYFNALDAVEDANGNIVCRSAEAQADGCVPVNIMGFGAPSQQAIDYINTVSIGDSTIEQTVVSASLANGAIYELPAGYVGIAFGAEYRKEESETNEPDNAEGTFFNALGEDKGSFNVREVFFEATMPILTDLPLIQDLVFDTAVRHADYSTIGEATSWKLGLDWTVNDELRVRVTQSAALRAPNISEVFGAASQTFYSVDDPCRAENLANLSNATTRSANCSALGVASDFNSGYDSASLDGLTSGNRDVKGEESTSTTVGIVYQPEFIDNAVLTIDYWEIDLENAIDTIDAQEILDRCVDSTTGINNQYCNLITRNASGEISLIQNSVLNVAGQKASGVDFELGYDFDALEGSFKTRLIGTYLIERKDYPFQDDPSSYIEYAGTTGEAKWQTNLSLTYAKDNFYSTVETRFISEVDLYTNVDLASNSNPSNQMFYGKYFITDMTVGYSFDSGLGVKVGVDNLFNRKLPYGSRGTSAGSASYDNIGRFGYINLSYSL

SEQ ID NO: 18719 - protein, 356 aa, Bacteroides fragilis
MAIAAIFVKSEKDIHGEYYSGGDPGALDNSSIGDNYVVPSGYFAFPINHKWSFGLATFSNYNVRNNYDSEYPAGILTGQRSLFTYEINPNIAVKLTDKLYLGIGVSAIYGNYQLATNYGAQNPNNPSQIYQDFNGSGLGFRYSIGGLYKINKHHQFGLSYRTATEIETEGDFTTLAKNNDLEFQDTTTLSMAVPSELTLSGFHQLDPRLAVQYSLAWYGWENLDYISVSHPDCPANLDFNLPQGQCLIESVTAEDSWKIAFAVSYKLSDVILLRSGASTEKATESATFAIPYDKKTNFSFGLTYYASRTLSFDIGLTYARYDTTRIKDTIGLDDFDVSTEGNSTMLGLQLNYQLID

SEQ ID NO: 18720 - protein, 356 aa, Bacteroides fragilis
MKYNNTISLIAISIVLFTSNSSAGELFDWYGTIRAQVQDTNNGELEYKDNYSRLGAAGGAEILDGIKATYNVEFRLFTSDGSFAGSDSRARLANIGLESEYGSLLIGKQYSPQWNYTNNAIDIFADVDQSAGCTNEASGVICHTSRYGLFGYDQAGNGHYVEVLRPDRAVTYTTPDLNGFQASAMAILNDGDVKASADGSDSETLVGYNIAAKYKWQDFTLSAARFEVSSFVEEASIDSVQLVYNHDKLSIAAHYQMSEDLRFYEGLPAAGEMVEEQVYEIYAGYKFSEVQIQAAYSIVDMTSPSNVNVDTDHLLIDVIYPHKYGRFYAEYSIWGDEAEEFFIAADTVILGVQFDF

SEQ ID NO: 18721 - protein, 1052 aa, Bacteroides fragilis
MNLISIRKKRRPAIALLLCTGLLGACPPDAVADAGDRLPVPEIQQSKSPVKRTLVGTVTDASTGETLIGVNVIIKGTTQGTVTDLDGKFSIEVTGKDEIEISYIGYKTQTIEVGDLGILNVKMEGDNEVLDEVVVVGAGTQKKVSITGAITATEGIQLKAPTSSLTSSLAGKLAGVISTNSSGEPGSTSAFYIRGINTFGGVATPLILLDGVEISSGDLNRIPAESIESFSVLKDASATAIYGNRGANGVMLVTTKHGKENTKATVNVSVEASYFQPMNTPEFADGPTFMRTYNEAQQARSATVITPRYSDEIIAATESGINPYVYPNVDWYDMIFRSGNYNQRANVNVSGGASRVTYYMSLQANHDTGLLNAADNSAFNPNINHWEYNFQNNISYKLTNTTTVNLRMMAQIGSQKGPNNKTTDIYKKVMYANPVSFPAYFPGEEDHIYYGNAEIKAGAYGENPYQYMMGSFREDNFNTLNTSLDISQDLGFVTKGLSAKVLVNFKNWSNSYYTRSLSPYYYQVQPDSYDPENDTYALRLLQTGTDYISQSDITKEADQTFYLDARLDWKRSFGKHNMTAMFMYMMREYRNGVLPNRNQGYSGRATYDYDNRYLVEFNFGYNGSERLAKEDRFEFFPAASLGWVLSGEQFWEPIADYVDYFKIRGSYGLVGSDQFNSGAQHFLYQNQVAIGSGASWHSGLPGQWLNRQGHGFNILAVQNAGWEHVKKLDIGLDASLFNQVNITFDYFRDYRDRILMKRASFGKLLGYWGSTPWSNIGEVLNTGFEVSVNWKKQFGKDWQVDFRGNFTYNRNEYKFSDEPNYPYVWQTETNKPLNRLTGYVAEGLFSSQEEINNWPDQTQLGSKPMPGDIKYRDIDGDGAITSEDKVMLSPYGDMPRIQYGLGLNVRWKKFDFGVFFNGSAKRKIMINSGFAPFLASGGDGGPSESLPRNLMSWIAESHWSVDNPNPDALYPRLGTSNADIAGNIQPSSYWMRNGNFLRFKTLELGYTFPMCRVYFSGDNLAVFSPFKLWDPELAWNAYPLQRTFNLGVQFTF

SEQ ID NO: 18722 - protein, 1083 aa, Bacteroides fragilis
MKKNLFSFPRSKVRMLKGSKGVWLFLIMFWMINTAASAAGIEIKGTVTDSKGEPLPGVNIVELGVKKNNGTISDLNGKYTITVESQKSVLQYTFIGYKTTEVTVGNRKTINVSLKDDTQSLDEVVVIGYGTMRKKDLSGAVASIKSDDLMLGNPTSISQALQGKLAGVQVNQSDGAPGSGVSITIRGANSFSTNSQPLYIVDGIPFEVGDTPSSKANEGNNSTTNPLSLINPNDIESIDILKDASATAIYGSRGANGVVLITTKRGRAGDAKVEFSANFGLSKIAKMVKMLDAYTYANYVNEGVINGAAYDNLPYSYLPYRGKWNYRRDENDKIVPNSGKYYASPEDYLNPGYREDEYGNKEWVEGTNWMDEILQDALTQEYNLSVSGGNEKSNYAFSGNYTDQTGIIKNSGYERFAVRANIGSHVKPWLNTGLNINFTRSLTKFAKSNSYDYSIIRSAMLYLPTLYVGDKTEDDSYAWLSANPRTYVNTAKDELKSINVFTSAFAEIKILDCLKFRQNLGISYSVNDRASYYNRETGEGKASNGRAGKSDNFWQNLTAESLITFDKTLNKLHHLNVVAGFTYEKSDWGGKTMNASNFPTDITQDFDMSQALNIETPASYRGQAVLVSLLGRANYTFKDRYIFTASFRRDGSSRFAPGNKFANFASGAVAWTISEEEFIKNLNIFSNLKLRLSYGQTGNQAISSYQTIASLAPSNYPLDGTLSSGFAGQTYKGPLNDKLKWETTDQYNVGLDMGFWNNRISLSANYYYKKTNDLLQNVSIPNSTGYTTMWTNFGHVKNKGLELTGKIIALDKKDWSLDFDGNISFNKNEIGGLTADQYANQLWYSAKEVFLQRNGLPIGTIFGYIEDGFYDNIAEVRADPIYAKASDDEARRMIGEIKYLDKNNDGKITSEDRAIIGDTNPDFIYGLNANLRWKNLTLGLFFQGTHGNDIFNGNLTNIGMSSIANITQDAYDSRWTPENAANARWPRVTTAMTRDMKLSDRYVEDGSYFRLKTINLNYNFGSVIKGISNLSVFGTVTNVFTITGYSWFDPDVNAFGSDASRRGVDIFSYPSSRTYSIGFKLTL

SEQ ID NO: 18723 - protein, 615 aa, Bacteroides fragilis
MLALTGTTLKGATAGVLSTDTLASGATSAVLVDGGSVASVAGPAFAARGGTVDIAVRNGTIVTAGNGTLLDLANGSTATFNASAVNLSGDILSDASSTGNVLLANGTTLTGKIDPVALTVDGTSTWRMTGSSVLSSLNNAGLVAFAAPSGAPTAAGSYRTLTTGSYVGYGGTLALNTYLGADASPTDRLIVNGGTASGTTGLKIANTAGTGAQTTGDGIPVVVTANGGTTAASAFHLAGPVQAGAYEYRLYRGGQSDANGWYLRSQLDPTDPDDSIHPSGNANGNGNGNGGNLAYRPGVAGYAMTPLLNADYGFSTLGKLHERVGDIYNIEKQAPGNRDGVWGRIGGQSLDANAGRFAADERTFFAQFGKDWTLEQAAAGGSTHAGVTASIGVANASFDDMARADTPDLSTSTGSVEMHAQSVGGYWTRYLADGTYFDSVGQVTHYGNRYRDSYGNEASQNGFGIALSQEVGKPFGIGGTPIAVEPQAQLMYQYLKLNGFNDNVSAVSGTTTNALRGRVGVRIFRPNLDANAGGGAATPYFTADVLHDFLSPGQTVVGGTPFATHLGRTWYELGLGVTAGFGKSGELYANVKYARNLGGDYRRGITGQVGYRYSW

SEQ ID NO: 18724 - protein, 263 aa, Bacteroides fragilis
MKKNLLCAAALASLASLAGTASAENTENFLGYQNGFADINVNYLDWSRHTENKSKNTTHKEDFAYFELEGGANFNWGELYGFFDVENPFNKQHEDPGKNQRYTLKTTARVYLADTGFNLYGHVYGTWSLPGDKHGGNFHEVNTLYGVGYNTSIGNLWFKPFVALHYVDQTYYSGNNGYVVGWVAGYNFKMFQEDFMVTNWHEMEFARHKRYGNGGRDGVNGALAFWWNATPHLSAGLQYRYADNKLGDDFYQDGLIYTLKYNF

SEQ ID NO: 18725 - protein, 260 aa, Bacteroides fragilis
MNNILKIALPIVIGCSCSVNAIAKDFTTVTAGYIAHASDTLDENKNQFDRTLITVANVRAKDWGRIATVGIFENLEQSSSDPQAEALGEAWSTFKFAGVAHIKTGFVPSLNYMVDEFFFTNTNGYENNMKLGLSYDMKLGDAKANIGAGVNYVSIDNAGAKFTGFSGYALNASVQYPISDNWGLKLLYNGVFDRDEKHAVGYTDSLDGKQHDSGYRLDLAVNYKISNAISACLTLRQLDSWYGYKTSKADMMVLTTSITF

SEQ ID NO: 18726 - protein, 1175 aa, Bacteroides fragilis
MKKNFCKVRRGHCLSLVWIVSFLLWGNVTMAALPIQEAKLSIQQRSVALSRVFYEIEKQTGYSFLVRNNDINMNEKVSIDVKNKSVEEVLEMLFVGKNIRYKVEGEHISVYKPQQSRQNAITGLVMDVAKEPVIGASVVVMGSTNGCITDFDGKFSLEVSEFPVKLQISYIGYKSQEVTVRDTKTIQVVLREDTETLDEVVVVGYGSQKKANLTGAVASVKMDEVIGNRPLSQAADALQGTVPGLFVSSDGNAPGKSKSFQIRGAYSVGIKNDDGSYGSAIKPLILIDNVEGDLDMVNPEDIETVTVLKDAASAAIYGARAAGGVILVTTKRPKGETSFQLNYNNNFAFATAMNLPEQAPLMEYLQAYSDAAGDQFWTMGSPSVSKWMGYLEQYRNNPSSIPTVGDGIFKDTDGAVYYMNEKDLVKNMLETSFQHTHNISMTGGTDKLRYRLSAGFIDNDGVLITDKDKYRRMNVSGFISANVTKWFTQEATFSYAHSKRMEPKSALGAVYSTRLASFYPEGNMPEGISAAGDGLPFFTPSNQIRWSNPEKTLYDNPRIFLKSILKPLKGFEIAFEYTFDKNIYDYSWYTGSVVYTTVQGGKDTTPTNDYLQKKKRYTDYNSINLYGTYDFSLGNHQFKIMAGFNQESSYQETMEALSYGQAVIEVPSLGSGTSTLKATDKYNEFSVRGGFFRVNYNYQDKYLLEVNGRYDGSSKFPKESRYGFFPSVSAGWNIAQEKFMESTQNWLGSLKLRASYGMIGNQNVPAYSFIPTMAVNNKYNGWISNGNYVTAITSIPSLVSRNFTWEKVGTLDIGIDFSMFSNRFTGTFDWYQRNTNGMLAPGVQLPAVVGADAPYQNTADMRTRGWELSFNWRDQIGKVSYRVGFNLSDSKSKIVKYDSNSSYILSSQKTNALTGGTYTFWEFYKGKELGEIWGYETDGYYTVDDFVDTSSWKLKDGVPSIDGYNPRPGDVKFKNLMDDERGTNMISSGNNTLNNPGDRKVIGNETPRYLYGINLGLNYKGFDLSAFLQGTGKRDKWIANTLTFPLYSDFKFIPLYKGLGDYWQPVDAANGDYTAVNPNAEFPRIYGNYGNQGSNYRQSDKYLSDASYLRIKNVTLSYTFPKAWITKISLSQLRAFVSVENLATFSSLPKGIDPETLKWDYPAFRTVSFGLNLTL

SEQ ID NO: 18727 - protein, 240 aa, Bacteroides fragilis
MKSVILASIAAMFATSAMAADVVVSEPSAPTAAPVDTFSWTGGYIGINAGYAGGKFKHPFSSFDKEDNEQVSGSLDVTAGGFVGGVQAGYNWQLDNGVVLGAETDFQGSSVTGSISAGASGLEGKAETKVEWFGTVRARLGYTATERLMVYGTGGLAYGKVKSAFNLGDDASALHTWSDKTKAGWTLGAGAEYAINNNWTLKSEYLYTDLGKRNLVDVDNSFLESKVNFHTVRVGLNYKF

SEQ ID NO: 18728 - protein, 1091 aa, Bacteroides fragilis
MKKNLLLLMLALLLPAFMYGQEQTVSGTVLDTYNMGVPGASIVEKGTTNGTITDFDGNYTLTVSNKNATLVFSFIGYKTQEIPVAGKAKVDVILQENAEQLDEVVVTGYGGSQKRATLTTSISKLDNAVLENAAMSNAGQSLQGTVSGLRVVNTTGQPGANPNIVLRGGATITGKDNGALVVVDGIVRNSLADINPSDIESIQVLKDAASTAIYGARANGGVILVTTKRGKEGSASVSYKFKGGANFARTGYDYLNAHDYIYYNRLGYQRTGRSGMDNQMGYGIGNDLFDIRYLDDSTKGLLAEGWQQMQDPTDPNKQILFKDYSGQMKDAAFQDPSFTQDHYINITGGNDKGTFAASLGYYKEDGLIKGTSYERFSGTFNGSYKIFPILTVNAGTTYTWSRQPGLWIGSYEFFYRTMSQRPTWNPYMEDGSPASGFGTGDGNPLYYKDKLTNTNGTRRSTYNIGFDLEIIPKKLILKENSALYHVDDQTDKFEKSYQQQNATNPNLTRKAEAKYIKQNQQQHSVTLTYTDTFKEKHNLEAMLGGEYFNWHQYTLNARTENSPSDDIPTLNAGSNRTYTYSYKEGYRILSGFARVNYNYNYKYLLSVVARYDGISKLSDNRWGFFPGISAGWNIMEEEFFKESKLVDVISNLKPRISYGVNGNVNGLGYYDVYGSYGQKDANGSIITNYDGSVGFYNDKLVNGGLRWEQSKSFEVGLDIGFFNNRLSFILDYYNRTTSDLLTDLDLPNYTGFNSIKTNLGTLRNQGFEMEVKANILNNVNGFSWDVSANLSTVANKIVKLPANGNENNRQGGYQVYDPQKGEVVWVGGKQEGGKLGDLFAFKQDHIFKDWDDVKANANNRYDAIGELYGPAAWEALKDKAGKQPIEPGDVCWADLNNDGVINNLDRVKVGNLFPTVTGGFSTTLGYKDFSLYARFDYALGHTLYNDLAARSLGQYQGSFNIIDMVKDSWSETNQDTDIPKFYYADQLSKKNITRSNNGLTAVDNNSSRFYEKGDYLALREITLTWNLPKKWINKALMSNASVYVTGQNLFYITGYTGVSPEPAVDTTYGQGLDNGRYPTPKTVLLGLSVTF

SEQ ID NO: 18729 - protein, 806 aa, Bacteroides fragilis
MRVTGWGWKAVSLGLGLGLSWGSLAQAQPAARIPETPLLAQATPRGATTIQEQIRELEAQIEAARRRGDQAEVERLQADLQVLRQGTPVFNLQQVTVTGTRTERTLADSPATITVIDRERLRQELIQNIQDLVRYEPGVSVRRNVRYGLQDFNIRGLDANRVLIQVDGIRQPERFSFGPFNIGRDTFELETLKTVEIIRGPASTLYGSDALGGVVTYTTLDPADLLGERDSHVGLSSQYDSKNQGFVNTLSLAGRQGNLEALLIYTRRDAREPDIKADPSFKDRQTVDGDNVLAKLVYRFSPLESLTLTGEYFNSRTTTTFSRRNLDPGISLFRETIDTERSRLSLEYRYANPENPAFELATAQIYYQPARTREPSVEERTITVQGRPVPVRRDTFNELVSNILGASLQAQSRFQTGDLSHRLVYGMEISTTRNERPRNRFQTNLQTGAVTQNIPPDTFPTKDFPDSDTVRFGLYVQDEIDFGGGNLTLIPGIRYDTYNLTPSPDEAFLKSGSEAASLFADAVSPKLGLVWRINPNLTFTAQYNTGFRAPQYNEINSGFTNLVSPFFRYRTLSNPDLRPETSQGFEVGLRGIYLQASFSLAAYYNTYNDFIEAFRRVGSEPSPPGPPGSPPPPPVILFQSQNVSRARIYGVEATGQYFFSPDLTGWSLNGSFAWAVGDNLTENKPLLSIEPLTAVLGLHYDDPSQVWGARLVATLVADPRDPQREVVQTNPNAPPQIPFVPSGYTVVDLLGYYNLDDNWQLNFGVFNLFDEKYFLYSETRTLFVGPEVERRAQPGRHVALSFSSRF

SEQ ID NO: 18730 - protein, 1098 aa, Bacteroides fragilis
MRKITRIKCLIVVLLTFIGTLAPVHAQQSGNFEISGVVKDTSGEPVIGATVIVKNTQIGTTTDVDGKFKLKVPHKSLLQISFIGMKTKDLKVTNNTFYEITLEDESVLLDEVVAIGYGTQSKATVTSGVVSVKKAELMSSVSASPLNNLQGKVAGLDIRQTTGQPGAQPVVLIRGGSTDPANDSPLFVIDGVVRSNMNGLNQEDIESMEVLKDAASAAIYGAKAANGIILITTKQGSSKDGKATISASYRLGVEQIRQHYPFSGARDYLYASRLAGSRGINDANVSGRLEGGAYPYSTGNINYKNGALEGYGYSRFTTEYLDDLISNMGQSYVDDLLNRQGYETMTDPYSGKQLIFKDNHYQKDVLFQTALTHNYDLSASGGNDKGNYYVSLGYINSEGIVLGTGYDRFSLTANGNYNLRSNLKLTVGLKHSTISNKATDPENSGTSTMDRSSRYPTTFRLYYDDGTPGIGEAGGSPRNRLHELYYQDISDKAYRNTIQLGLDWEILKGLHFKPSASYYMQENIYRFFEKYNEFNKGRKTLEKHDQYKQIMADAVFTYDKVFSDKHTLNAMIGMNYTQDDTYKLKGTGSEAPTDYVPTLAPTKPDLQRTTSSLDKEVLVGFFARVNYDYKRRYLLTVSARYDGASQFAEDHKFALFPAVSGGWNMHYENWFPKTVVSRMKLRASWGQTGNNKLSYSNTQGEYASYIYAGNPGVLNSVLANNSLVWETTSNVDYGFDAGFFDNRLELSVTGYNKLTSDRLYDKALPAQTGFSSIKANLGTVQNKGFELSLTAHPLSTTSPVNWDVTGTFSMNRTYMKKLPYNGRDKNRVQGGLVWDAKSGTYVETGGLAEGERIGGRWGYKYLGVYDTDEEAAKAPVDTKVSGSKMNKKKVAGDAIWADLDNNGVIDDKDITFIGWANPDKKGALINNLSYKNFSLRLVVDFALGHSIANIWRCRANANARNAIITTTDVTNGNIWWQTGDAATAKYPRYDVASDWDNGYRNHMRTIAYAGMNSNGNADNTAYYSKGDYLCFREVSLGYELPRSVCSKMKVKGVSLNAGVTNIGYITAFDGLNPEQYDGQETGEYFLPIQFNFGVRLTF

SEQ ID NO: 18731 - protein, 917 aa, Bacteroides fragilis
MRKSLYIGMVMCLLSGWTARAQRTVDLDFRQVTLNVVFDAIERQTGQPVYRQPLETDSMVVSVHSEKEEPLVALRRALEGTPFQVSSYGGAFFVLRDNTLMTSLPENFFLREKRREGDGDEEGSGISLMAGRKQQKATSENKVYEIGDASGKAADRVTVTGNISDFKTGEPMVGVAVFVKDPMIGATTDAYGYYTLRLPPGRHELYIQGMGMKDTRRQIMLHSDGKLDIELEEQVYTLKEVTISSEKIANVRNTTMGVERLKVKDIKNIPMAFGEVDIMKVVMSLPGVKAVGEASSGFNVRGGATDQNLILFNDGTVYNPTHLFGFFSVFNPDVVKDMELYKSSIPAKYGGRISSVLDINSREGNKKEFKGSASIGLLTSRLTLEGPLFSEKTSFIVGGRTTYSDWILKKLPEKSGYKDGNAGFYDLNATINHKFDERNNLYLNGYYSHDRFRFNVDERYAYENANASVKWRHIFSDRFTGVLTAGYDHYGYNTRNTDNPVNAYSLAFRIDQMYGKMDFTHYLSDKHTLDFGASSLFYGLEPGKYLPYGGESLVKEDRMEKEKAVESAIYVGDRWDITSQLSLNVGVRYSIFNVLGPRTYNLYADDQLPSLATVTGTVDKTGAFKTYHGPEFRISARYAFTEDFSVKAGFNTMRQNIHKLSNTTIMSPTDTWKLSDANIKPQTGMQVAAGLYRNFLSNTIEVSLEGYYKTMKDYLDYRNGAELLMNHHIETDVLRTEGRAYGVELMVKKTQGKLNGWVSYTYSRTQLRQNDPMIVNPVNKGDWYAADFDKPHDLKFVGNYKFTHRFSFSLNCDYSTGRPITLPVSKYHYGGGEFVYYSDRNQYRIPDFFRMDASFNIEPSHHLTLLTHSTISFGVYNLTGRKNAYSVYYISENGKLKGYKMAIFGVPIPFVSYNIKF

SEQ ID NO: 18732 - protein, 437 aa, Bacteroides fragilis
MLIKSTQLSPLALGILLSLPAFSVMAGTVTTDGADIVIKTKGGLEVATTDKAFSFKIGGRLQADYAMFDDYYTRNGNAADAAYFRRAYLELGGTAYKDWKYQVNYDLSRNTGNDSAGYFDEASVTYTGFSPLNIKLGRFYTDFGLEKATSSKWTTALERNLSYDLAEWTNDNSGMGVQASSVLADSVFLSGSVFSENNNDTDGDSVKRYNARGVFAPLNQPGNVLHVGLQYAYRDLSGSAVDTRIRSRMGMRGVDTNGGNSAGANGNRALFGGSAATADLWEDDAVWGVEGAWALNAFSIQGEYLSRTLKADQASSDIDAKGYYVQMAYTLTGEPRLYKLDGAKFDTIKPANKQLGAWELFYRFDSITIEDDNVTSSSATRQVGDASGKAHTLGVNWYANDAVKISANYIKASTDKVSNSVGDDSGDGVVMRLQYAF

SEQ ID NO: 18733 - protein, 698 aa, Bacteroides fragilis
MRKPFLLLFCLTAPAWANQLDPVLVNDQPEHNTLSVSPEVRRSELFVESRSVGVLDVESIEDGHVANQEDLFKRTPGVWVANQNGGDDVFLSIRGSGLSTTSFGRGIVSYQDGVPLSRLDNGTTNQLIDPLSYRYVEVYRGASALTLGASALGGAINYVSETGRTAPGIRLRTELGDYGWRANRITLGGKKGNMDGYLSLSQSDYRGYRDHSSQYNKRASGNFGVLFDNGIENRTYFSSDDAQLELPGSIRRDRLEDDSQEAGAFNKSFDTDRNWRAIRLANRTLIPLAGDQQLVASVFYNRTNLDHLPTPFVGIIDNSSESIGGAVDYRKHWSKGHTLLAGLRYSYGHDDNTRFQHAQNGKQKGNQFLDDVFRVKQVEAYAEQQWQVSDRWRVALGAQWVESERSLDDLQASVPPLCSNCPFFPQPSGEAVDDSYTVDMGGFSPKLGLSFTPLAGQTLFVQVAQSIGMPSGSELGAQPVPGLRLEQQEATTIELGWRGVGDVLDWDMVLYHANVEDELLNIEVNDVTALFNSPTDTIHQGLEAGITWRLPGKENVALQTVYNWSDFTFDDDPIYGDNQLPGIPEHTIFTALQWRPSAQVLVEPNLRYVSGYPLTYTNSGGRYWETAGYSVWGLRLSREFNNGLKVYFDGRNLGDKVYASTGSISTAPALASPFNPNPVASVTPGIGRSLYVGAEYRL

SEQ ID NO: 18734 - protein, 929 aa, Bacteroides fragilis
MNKFKRNLTGALAAFPLSVLSVAIGSAYAQEETAESKPKVDLGIKSPIEEVLILGRLQDSATDVIGERMDQSVAIDIITSETFSRTGDSTVAAALRRLPGVTLVDDKYVYVRGLGERYLSTTLNGAVVPSPDLTRNVIPLDIFPTSIVESLSVQKVASADMPAAFGGGHVDIRTTGIPAATMFNIELSTGMHSGSGGDFMSYNGGGDDNKGEDDGTRALSPVLRNALSTYRGNFSPFSIQEAQPGITTTEAEAVNRDLATELFRDITINNESGQKDLGVELNAGSVFDLWKGIELGVVAGGSYDRQWRNADTVQRSFSAPEEQVKFISDSTFTVDLTGTLGFGLRFNEENQINTTSIFIRNTDDTVSINNFFNANDELSSGKGQRYTEFEYQQREVTINQIHGEHELGFETIEALELDMIKFLEGLTVNWYYSDSEATTDIPLDLRINAFTTADPVTGDTITTTVGSQDRNAAQYRFSDLRDDVESYGWEATFPFELDKFEIKLIGGAENWEKVRYFEQLRFNLGAKTEERAEFSGPLGVLYSDENVLDPDFGYAISVQDATSSYFAANRVSAGYGKLDLTWDHTIRFVAGVRGEDYQQVNLGWNPNEFDGSPIVGLTQAFNQLEAQADYSNGNPVSQFFEDATYSDSELFYSAALTWMVQDFWAQDFQLRASYADSTVRPDLREIASSSYLDPITDVSVNGNPDVVPSTLKNYDLRAEWFFSNGDNFTVSAFYKDIKNPIELFEAAAADDNIAAKIHNADSATVSGIEVEYLKGLGDLTRVLDPFYTQGNFTVMDHELVTGNNADSPTNDIRGLNGASEYAANVLIGFDSYDSKHSATLAYNVFGERLYFAGRNGSPDSFEQPFNSLNFTYSFYPTESLTVKFRAKNLLNEDFVIQRTTTDTDGNASDVDIIREERGQTFSLSLKYSY

SEQ ID NO: 18735 - protein, 701 aa, Bacteroides fragilis
MKATSTTNMASSLLMLIAAMPVTTLAASEESSEKNASKNMVKATDKKAKAQDIEVIEVTSRRNQANSEMTEQTEQLMSVAGIGNDPLSAVYSLPGIVYAGGDTGSPAVRGSSPEDNAFYIDDMPAGYIFHLFGDSIFNENLIQDFTLHPAAFGSEYGNATGGVFDVQLRDPRQKDITTTVDLSMLKSGVMVEGETFEDQAFYVSYRRSQIHLFLPEGEEDEGYTVFKAPISEDYQGKYQWLIGDAHKLTLSASGASDTGGINISENSEEGRIDPDSVGDFKITTKFDSQSLSWQYYGDEEKIMQLVAGHTVNTTDQIFGKGQFIKVDEESYNVRFSSQITWLDNHKLGFGFDYSKSDVDYSFDMIPYYCTENDADCNENKGDRIQDVATLTDEDIAVYVHDIWQLSDAWQLTVGLRAERNDYTGQNFVHPRLALDWFATDDLTFKAKAGTYSRFPDVDTALNKLGNPKIKSPQATHYSLGVDYDLNGIWFTSLDIYHKELTKLPRSVDENTAVEDAEVHYTNDTSGDAQGVEWLVRHERHNGWFGWASLSWSQSQRTDDLTNVTADYYLDTPLVANVVVNYELNERWDFGLRFTLRSGAKYTPIVGLRENPDYEDHFLPTYGELNAKTLPVYHRLDLEANYKTNYWGYDAQWTWAIINAMAQKNVSGYYYDPSDNDSLTEYNVSGEEDIGVFPYIGLKMTF

SEQ ID NO: 18736 - protein, 1269 aa, Bacteroides fragilis
MNFVYTLKLNKKRELVVVSELSGGVKKSARNKLLKSVVVLMTTLATQLYSPLIQASIVGMDIPYQTYRDFAENKGAFSVGALDIPLYKKDGTLYSTLNKAPMIDFSAVDSGQTVATLISPQYIVSVKHNTGYKNVRFGYRDDSSYILVDRNNSSVDFHTPRLNKIVTEVVPADITDAGTANGTYQNQDRFPIFYRVGTGTQYVKDRNGKLTQLAGGYAYRTGGTVGKPTSSNKRIVSNPGNTYSAANGPMPSYGIPGDSGSPLFAWDTQRNKWVLVAVLNSYAGNAGKTNWFTVIPVNEVSANIEADTDAPVTPTSTTENINWTYDISTGTGKLTQGTDAWEMHGRDTGSSAVSFNHGKDLSFENTGTVVLKDIVNQGAGTLTFNGDYIVKPDADQTWVGGGIIVNGDHTVNWQVNGVKGDSMHKLGTGTLNISGTGINPGTLSVGDGTVVLAQKPDSNGQVQAFESASIVSGRPTLVLSDSQQMNPDNIKWGYRGGKLDINGNDLTFHALNAADEGAILTNSGSLATTSLDFNSTDTTKPVTTMFHGFFTGNVNVKNNATSNVNNTFVVDGGINTPAGSMTQQGGRLFFQGHPVIHAVSTQSVANKLKALGDDSVLTQPVSFTQSDWQTRQFNLKSLDLNNAAFYLARNAGLITTINANNSTVTLGSEDLYIDTNDGNGVKTTPVEGQSVATASEDQSHFTGNVNLTNGSALRVNENFSGGIISSNSSVTISSTNANLTESSMFTHSVIKLSDNAQLTSTAGLQSDGTIEFGNGAKLSLLGESSSTFTPFSATAWNLKGTGSSLNIGSGTNVNGDINAWSDTNINFGNSGKQSTSSGILYTGDIYAPEANVSIDNTSWTLNKTSLLGNLTLKNSQLIMSTDGKTSSGIKVVDTFSGENNILYVKPTRSLSEMSVSNIPLITAKNVTNNTRVFKTVTQQTGFHSMTPKIEVVNVDGTTQWRLKGFDVQSDSTALKEGQRLMNTNIKNFLTEVNNLNRRMGDLRDTKGETGAWARLMNSSGSGYGGFSDRHVHLQVGADRKHHFEGGDLFTGVMMTVTDSKASAESYQGKTRSVGGGLYASTLFDSGVYVDVIGKYVHHSNDYLLQTMGLKADDTAHSWYLGAETGWRYQWKPDVFIEPQAELVYGTLSGNTFNWQYNGMDVSMERKKAKPLIGRTGVEFGKTLDGRDWQVTAKAGLSYQFDLRNTGATTYRDFAGESTVYNGKDGRMLANIGIDTRIKDNTRIGLTVEKSAFGKYNVDNAINANIRYTF

SEQ ID NO: 18737 - protein, 734 aa, Bacteroides fragilis
MKIKKDLRIYVGTLSAITIGLGANYGYANVLEEVLVTAQKREENLQDVGLSVSALSGDQLQALNLNNTIQVTQQIPGLQVSTYMPGFTIFNLRGISQNNFQDNLEPPIAVYVDDVYTSNMNAVNAQMFDMNSVEVLRGPQGTLYGRNATGGLVHYRTNQADETDLNGYIRASVGEFGNQAIEGAVGGGSERVRLRVAGMYETHDGYIKPGFWAGPDIEASGRNAGGADGYSLRGNLQVDVTSNTLLTLGATYLEDDRVPTGQYVVRFADQNPETSFGQNAGAPITGDVHRHASDANYPGMDRDSTTLSAKLSHAFDNGLSLDYIGAWNDMYKYYIEDAGGGLVYFPFSTQAEYETITHEIRLSAENERLKWQAGAYFLDIDYSGIAVVAGPAIVGDSTGEVHQAAAIDSENWSIFGEVELALSERVTAIAGLRWSQDDKTIRYRNTAENFSEAPLPDGTILFDLADQIAANPNYANVDEVDYGDWAGRFQLNYALESALLYASVNRGIKGGNWSPSSSVSLDDFQHKEEVIWSYETGYKGVFMDGAMRFNAGAFYYDYEDYQAFSLTGATPQITNQDATVYGGEVELVILPNSNWDISLGLSLLESEVDFIPGVSPGTGAYDTELPQAPAMSFNYLVRYNVDLMGGNVAFQLDGVHNDDQYFEGSNAEVSLQEAYSVANLSVGYSTDTFSLTAWVKNAGDEDYLLYNLDIAYAGFIEQVYAPPRQYGVTAQLNF

SEQ ID NO: 18738 - protein, 1051 aa, Bacteroides fragilis
MTKRTCQFPKHTCLREINFLKIAGISLLLFCTTSQIAVADSYEKNAVTATQQSKTEKITGKIVDESGEAIIGASVKVQGSTIGTITNMEGEFMIPNVPNKAVLEISYIGYKPLEVAVGKSKDLRITMEEDTKTLDEVIVVGYGTTSKRKTTAAIASVNTEDIIKAPTANITQSLAGRAPGLLVTTSGGGLNNFSSVSIRGGGTPLYVIDDVISEERDFRNLNAEDIDQITILKDAASTAVYGARAANGIVMIVTKQGKAGKMSVNYNFNYNWSQPANMPNKLDAHDAAFYKNMSMTNDGLAPAYTDDELELFRNGSDPRRYPNTDWQKLCLKNFAPEMQHTLTVTGGSEKIKAYTSLGFYDQKSLYKFDVNSFKRYNFRTNIVADFKEIGLKVTSSIEAYKTDLRSPNAKSGDSYYHTWGHIQNKAPWEIAYNPNGQIFNTPDNPLMEISPDAGYTKNENLSAIANLALEWSVPYVPGLRLKALGNYRINNDKSKSWKKSPLAYDWDGNPNDPGKPSLSKSYSNWSSYTVQGFANYDRTFNQVHTISATAGIEAYKLFKDDASLSREEYLLDVDQIGAGPVSTAKNSSSEGEEARAGVVARLKYDYASKYVAEASLRYDGSDNFPRGKRWGTFYAGSLAWVISEESFWQTLKDRHIFDQFKVRASYGEIGSDAIGRYAYLQSYGLNDRGYLLNGSWYPGFSEGALVSKDITWYTTRDFNIGFDFGSLNNRLSGSVDYFRKSTKGYLTSPSAVAYTDPLGIALPQVKSNGEFIRQGAEFILQWKEKRGDFEYTLSGNFTYFDQYWNINPNEAETDTKNPYKRTTQAKGYWGIGYDCLGYYQNQEDIMNSPKRQSSVNLGAGDLKYNDFNGDGIIDGSDQHRIGKNSMPRGQYGFSADLNYKGWFMNMLWQGATPADLYMGGMIQGSQSGSGYPPVIYDFQTDVWTPNNTGARYPRLRSTASYNGSNNYGSSDFWLINTGYLRLKTLSIGYDFKHKLLKRVAWMNKCNVSLNGYNLLTFSKANKFDIDPEIGDGNLYTYPVSRVYSISVNVGF

SEQ ID NO: 18739 - protein, 880 aa, Bacteroides fragilis
MYLTVFVLLVFLGEALGQPSTLLQTPIQLEPGQYTVAQLLKQINNQTGVHFSYSRSLNISKKVLFTDKTLSIKQIVDQMLAPQKLKYLLKGKMIIIRKSFPKIATPTSTTASFTTQPRFYTISGTITDQSNGEALIGATVYIPSLGKGIATNSYGFFALRLAPGKYKVQVSYIGFQSKHYQINLEASKTLNVELPVDKNELATVVITDRGINEHVTSLEVSTNRLDIEEIKSMPAFLGEVDVLQSIRALPGVSSIGEGASGFNVRGGAADQNLILLDEAIVYNSAHLLGLFSVFNPHSVKDVKIYKGAIPPNYGGRLSSVLDIRQKEGNTKRFSGEGGVGFVTSRLMLETPIVKDKSALLVAARRSYADLFLKLSSDQDIRDTQLYFYDLNLKFNYAIDKKNRLYVSGYFGRDVAKIGKLFSFSWGNRTATIRWNHLFNSQLFSNVSLIFSDYNYKLGVLPTNTNGLEFEWVAGISSYQLKNDLTWFINPRHTLDFGISGIGYYFQPGQVDSETSSVKTASERALETAIYANYKQQINKKLTLSYGVRLSAFLSLGERNVRTYLPGQPRRNATVIGQRRYGNNEVVANYWGLEPRLSLRWQFKPKTALKASYARNRQYIHLVSNTTAPLPTDIWKSSDPYIRPLTSDQVALGIFHVIASPALELSAEVYYKKMYDLIDYRNGVNLLLNEYLETELLSGDGRAYGLELMVRKNTGKFRGWLSYTLARSERKIDSDFPEDRVNNGAYYPADYDRTHLLNLTTTYDFNKRVSLSANFTLSTGRPVTFPSAKYQFMGSTVLDYSTRNQNRIPSYHRLDLSLTLKGKPKRKRRWKGEWVFSVYNVYARRNAYSIYFIGDGTAQNEATRLSILGGLFPSITYNFKF

SEQ ID NO: 18740 - protein, 196 aa, Bacteroides fragilis
MLKIRIKLFFLFLLFFSVFADASIPGFYLLGQLGTADTHQEASHAAAQSINNKMAFTGRIAGGYQFNQNVAFEIGYFRFSDVDFSGIDGVPGQNVSLNQNAIDFMAKPMLPISCNVNFYAKLGLAYRRANGSAFVNGQSYLNYSDSWNPSFGLGFSYDITPFVPIDLAWTRIQRVGGENNLPSADFYSIGLAYYFG

SEQ ID NO: 18741 - protein, 783 aa, Bacteroides fragilis
MGFRVPLRHQNNLNQLKNLSTMMKNQKRAVCLLACLLIAGFTAAQEKKESAQTASGSKEEGNRNVMLNASSANGPREISIGLPGGDVNVLENGLPVVYTSNPHNVNTHWRGDSSLGHVGLLKISETAITTGNIGYAVNSFTQLGTEKFRGIVNYSTNHFGKQQFDANISGGMGKGWFYSGSVYQNFDPGSFKLRFTSNQDRTQIYKAALTKNYNEGRGQLSAIYHYSNSRWPSNEVTSAPFIYVGDGSVKEIPGFSLGTSSYLPTTGEMAYRDMRTGELKETNLYDATLNKGNQLTLLNTYTWDNGLNWKINLKYDHALGSYVYQTPMAMEQKDASAGYYLKAVDGTLKPYEGYVQSRMSCLNRGKIDEFFATSELSRSYRNTTWRIGVNEWHYKVDYASNTTMYDHTVGEYPERLVREGNTDGVYYDFNKNASEYYKGHENKLAVYATHDWDISPKWNVYYGARLEWQHLEGENAAVYDAEGNAVGRFPDYYLGAVSDKGVRITPRLFDYDWMNMAFTAAATYKLTREFGFTADFTYNTQRPGLSNFAPATMPNTGKISVPLGRAGVYYNTDWISLTSLFSYISKTNNNSTLNLINPNDQTEILAAPLSYDIQTVGWTTDAVIKPFKGFNFHFLFTYQSPTYKKYETSVTFKDGTVGEIDATGNIVTEIPKVLVELDPSYNITNDLRVWASFRYFSKTYANIKNAYYFNGRWETFGGINWTVNKHLALSATVINFLNQTGAKGSIAGAELVDKKDAASYNGHWMAGSYIRPFTVELAASIRF

SEQ ID NO: 18742 - protein, 1002 aa, Bacteroides fragilis
MKQVNLRVCRMILPLLFGLFLSLSAYAQQVSVKGHVKDSTGEPVIGANVVVKDNSSIGTITDLNGNFVLSVPQNSTLVISFIGYKPVEMKAAPSVTVTLHEDAVMLQEAVVIGYGTVKKNDVTGSVMAIDADKMVKGMATSASDLLVGKAAGVSVITDGGAPGAGATIRVRGGSSMSASNDPLIVIDGVPVDNTEIKGMGNPLSTVHPNDIETFTILKDASATAIYGSRASNGVIIITTKKGQSGRVKVDYSGTFSISTKSNTVDVMKAEDFRNFVIEKFGENSLQANALGKTSTDWQDEIFRTAFSTDHNVSVSGAVPHMPYRVSVAYTNENGILKTSNMQRLTGAINLNPNFFDKKLNIQLNVKGVYNKNRFADRAAIGLATQYDPTQPVYMEGNPYGNGYFMYMKQEGDKASPIDIGLANPVAMLEEKDDKSTVYRSIGNAQIDYKFHFLPELRANLNLGYDVSKSKGDVIIADNSPLTYCTGNFKNGFGENSHYTQLKRNTLLDFYLNYANTFGVNYIDVMAGYSWQHFYNSTTNSYPYSAAYAEKTGEEFYKKGDDYASESYLVSFFGRLNYTLLNRYLVTFTLRNDGSSRFSPDNRWGLFPSVALAWKLNEESFLKNVNAISDLKLRLGYGVTGQQNLGNGDYPYMARYMYSKAGANYYFGDTEYSLIAPQPYDQNLKWEETTTWNVGIDYGFLNGRITGTIDYYFRKTKDLLNTVTAPAGTNFSNQLLTNVGTLENKGFEFSINAHAVSTQDWNWNIGYNISYNKNKITKMTFNDDPNYAGVIHGGIDGGTGYNALIHRVGEAFNSFYVFEQIYGPDGKPIEGAYVDQNGDNQINDADLICFKKAAPDVFMGLTSQLSYKNWDFSFALRGSFGNYVYNNVQSNREAYEGANMYDQTGFLKNRLTSARSTDFKNAQYRSSYYVQNASFVRMDNISLGYTFNKLFNDKQSARVYATVQNPFVITKYKGLDPEISGEGIDNNIYPRPRVFMIGLNLNF

SEQ ID NO: 18743 - protein, 345 aa, Bacteroides fragilis
MKNTFLLTFALILLAGSPLKAQEKEEAATLNKVVNTLKERITLAGYAQLGYTYDDAAKKMNTFDIKRIIFMAHGKITDRWTCDFMYDFYNGGMLLEVYTDYRILPGLKVRIGEFKVPYTIENELSPTTVELINCYSQSVCYLAGVSGSDVACGMTSGRDIGAMVHGGLLNDLLCYKLAIMNGQGLNIKDKNNQKDIVGNLMVNPLKWLSVGGSFIKGTGHAIADSEITGIRAGENYTKNRWSIGGIITTTSFSLRSEYLAGKDGGVKSDGFYATGCYRMLRNFDLVASYDYFNANKAVSRKQTNYIAGLQYWFYPKCRLQAQYTFCDRNKGKDSNLFQAQVQVRF

SEQ ID NO: 18744 - protein, 1145 aa, Bacteroides fragilis
MKLKIKLRNILSVKIHKIVLLLLALCIYNTAYGQNQRISVYGNNQSLQKVFEQIEEQTQLGITYNQTRLDVNRKIKGNFVDKELSFVMDALLKNTGFTCRYEAEHIVITPVEQKKEKAAAGQATQMKKITGKVTGVTGEPLIGANVLAVGGKQATITNLEGEFSLEVSDNSKLQVTYIGYLPQEVSTNGKTHFVIQLKEDSQLMDEVVVVGFGTQKKINLTGAVTAVNIQETLGDRPITNVTAALQGVVPGLKIEGTTGTPGDNLSYNIRGTTSINGGGPLVLVNNVPMDINMIDPQDIESVSVLKDAASAAIYGARAAFGVILITTKQGKKDMAPKFNYNNNFSFSKALELPQKAGPLESILAYKEMGWPNDTYVDGKNIPQWETYIRDYMANPSQYPNGYVFDEDGNLFLMRENDMFADMMDNYGFMQNHSFSVSGGSSRTNYRIGLGYTNEDGILITDKDRYERANLSSFLSVEVNKWLTTQLDIRYANSTQNKVEQGGRNGIWGSAMQLPSYQNISPYEEDGIIYPAETSATYIRYGEPRIVKKTDLRALGRIIISPLKNLKITGEYTYNRVTNYNRMYVNQYKYIGMNFTGVLNNTENTRYALTQGFTNYNAINIFANYDFSIGNHHISVMGGFNQEENHAESQWTERKDVLLSNLPSISGATGTTTATDTFNEYALRGLFYRVNYSYKDRYMLEANGRYDGTSRFPKNNRFGFFPSFSAGWRISEEPFMTATRDVLSNFKFRASWGSIGNQIILLADGSPDNYPYIPEMAPGLTNWLVDGQRPTTLSTPPMVSSAFTWEKVYTLDFGVDFGFFDNRLNGTFDWYRRDTKGMLAPGMDLPWVVGVAAAKQNAANLKTYGWELELNWRDRIKDFNYRIGFNLYDSQSEITKFNNETNLLGTYRKGQKIGEIWGYVTDRFYREDDFNADGTLKEGIPIPKGVGKVYPGDILYKNFDDDASTIWSGKGTADDPGDQRIIGNSTPRFHYGINAGLSWKGFDLSVFLRGVGKRDFWRTDQIAWPTGTWGSLFKETLDFWTPEHTDAYFPRVYANNGVNTASNRWKQTKYLANAAYLKLQNITLSYTLPKTWAKQICFDEVKVFFSGENLHTWDHLPEGLESDMLSKGAWEYPFMKKFSLGFNVTF

SEQ ID NO: 18745 - protein, 438 aa, Bacteroides fragilis
MIRKHSLGFVASALALAVSAQAFAGTVTTDGADIVIKTKGGLEVATTDKEFSFKLGGRLQADYSRFDGFYTKNGNTADAAYFRRAFIELGGTAYKDWKYQINFDLSHNTGSSDNGYFDEASVTYTGFNPVNLKFGRFDPDFGLEKATSSKWVTAPERNAAYELADWINTHQDGMGAQVNSTLADMAYLSAGVSAKDADDSDGDSVKQFNFRGVFAPMHEAGNVLHVGVNYAYRDLDDTAFDSRIRPRLGMRGIATSGGNDAGDNGNRATFGGVSNSPAGSYKDDSVWGLEGAWAMGPFSAQAEYLARKLKADDNAYKDIKAKGYYAQLAYTLTGESRQYKLEGAKFDSVKPENKEIGAWEVFYRYDNIKVEDDNVVADTATREVGDTKAKAHNLGVNWYVNDAVKISAAYVKAKTDKITNNNGDDDGDGFVTRLQYVF

SEQ ID NO: 18746 - protein, 593 aa, Bacteroides fragilis
MNSIMKYQLYTAVIMVLSVSSVCGQTPRNTETKRPDTLRRELTIVNDQTVEMEHADPLPAAYKAIEPRLKPFRPEYNKRTFGFVPEVSSSGRNNLPNILPTEGHMKHRGYLNIGIGHTLNQRMDAGYRLIDAEQERLNLFLSYRGMKSAFNTGDFDGDRKDRRMMAGVDYEQRRPSFVLATGLYYSNHYFNHYGRGATTNVGSIPQLSTPVTPQMDNGTHNVRVYLGAKNDVIDARIDYRFFRSIPYLGTDPMKALTEHTPELNVTMSNELSDDIKLGVEVRTGGLFFAKNSEMIQTGVLSETDRNLYYVEGAPTIGFVGDSDNMQWNIQAGVGISSHFGTKGRLFFWPKLDASLSIFPSWRVYAKAFGGVIRNGLADVMQEEMPYLMPNTIVLPSRNALTAQLGVKGNIADVVRMEVYGDFSKLTGVPFYTPTLPLYNPSDLYQYNVSFLPLYADGSRWRAGGKLEYSYRDMLRFLVDASYGKWNLDGGLVASMQPDLILKAEVGVHPIAPLDVRLRYTQLNGRYRYSFGSAGSEALGIGNVHLLSADVSYKLKKNLSLYLKIDNMLAETTELIGYYPMQPFHCFAGFSWTF

SEQ ID NO: 18747 - protein, 807 aa, Bacteroides fragilis
MNKFLFLFILFICFSTSELVAQHRLTGRVIAANDSTHVAGCTVTLNNGAFITSTDSSGRFHFKDLENGTYVVNTYGIGFIANEQTVVVNGKNKHINVLLQPEHTDDVIDITSTTSNSHLEDVEDMAIYAGKKSEVIILDSLVVNAATNNARQVYARVPGLNIWENEGAGIQLSIGGRGLDPNRTSNFNVRQNGYDISADALGYPESYYTPPVEGLERIQVIRGAASLQYGTQFGGMLNFIIRKPVPDKRIQLVARQTVGSYGSKPAFSNTFVSLSGTQKKLSYYTYFQYKTGNGWRPNSDFDVYNYYGNVNYQISKRTSIGFDLTLMSYLAHQPGGLSDAMFKADPRQSNRERNWFQVNWRMAAIHFNHKFNDSNEVNVRVFGLLANRYSIGFRPNRVATIDDGTTERDLIKGAFKNIGAEARYMKRYHIAKQYNVLLVGGRVYYGNNVSTQGQGSKGSDADFDYTPTNFMTYDYMFLNHNVSLFAENIFYLGNKVSVTPGLRYEYIYTSADGYYGSIAYDLAGNIINQTRTDEFRSSARQFILGGIGVSYKPIPKMNFYGNISQNYRSITFSDMRISNPSSVIDPDMKDEKGFTTDIGLRSEGTKRFIYDGSFFILNYNNRIGEYLTADASNRVVRERTNIGQAVMMGVECYLEYDVLKAIVPVAKNWTGILFTNSAYIHSQYVASGITAVQGNEVEFVPKFNFKGGARASYKKFKASFQYSYLTEQFSDATNAVDGGVSGVVGIIPSYYIMDLGFSYEYRIFKLEANINNFTNQYYFTRRATGYPGPGILPSDGRAFYLTLQVKI

SEQ ID NO: 18748 - protein, 1132 aa, Bacteroides fragilis
MKKKAIPCHKAGRITSFFLLISIFLLIPSITTPVYAVETYTQQTVFTLHATNKTVKEVFEYIEKNSEFVVLYSKDLLPVLQKKVSVSIDKQNVESILNILSKEAGLKYNINDRQITITKATAEAPQQEKKIKITGQVLDENGEGIPGANIVIKGNSTLGTVTNVEGNFTLMAPENSTLVASFIGYTPVEIPLKGKKIVVFKLVPDAQSLEEVVVVGFGTQKKASVVGAVQSIKPAELRVPSSNLSTSFAGRIAGVISMQRTGEPGADGANFWIRGAATFSGTTDPLIFIDGVEVSAGDMNAIPSEAIENFSILKDASATALYGARGANGVILITTRTGKDLEKARINVRIDNTFTAPTRTLKLADAVTAMKLRNEAILTRNPDGTPAFSDDKIQGTLEGRNQYVYPNVDWFDYMFKDYSMNQSANLNVMGGTKKVDYFISASINNDNGMLKKDPNNTFDNNIQNLRYSFQSNVGAWLTSSTKVNVRINSQIVNYNGPSTSMDNLYKYVMEAPSMYFAPVYPNINREDHTIFGNKSGGPIGSGGFSIYRNPYASMVQGSSKQSAYTINTAFELEQKLDFLTKGLNFKALVSFKNWSKTTVNRSFSPYFYELQNPQEQEDGSYLYDYNSISKGRTALETSTSTTGDRLMNLQATLNYQRMFGDKHDVGAMLVYLQREYNLNNPDNNYYNTLPERNQGLAGRVTYAYDGRYLAEFNFGYNGSENFEKGSRYGFFPSLAVGYLISNEKFFEPLTKVISNLKIRASYGLVGNADIGSNRFPYLTKVDLGGAGFVFGDQWQTSSNGATITTYGAEKVTWEIGKKYNVGFDLGLFNKLSLNVDFFREDRKDIFLRRNTIPAESGITGDLRPYGNLGKVRNQGVDMSLDYNHAVSKDFMISAKGTFTYAKNQYMEIDEPDYEYAYMSQVGRPLNQYKGYIALGLFKDQEEIDNSPKQILTGVVQPGDIKYADLNNDGKIDGNDQTYIGNPELPQISYGLGVSIQYKKWDASIFFQGVGKRSIMLSDIHPFGGESYGVMQFVADNHWTEANPNPEAMYPRLTNGKNNNNNPNSTYWLRDGSYIRLKNVELGYSYKFLRAYISGQNLLTFSKFKLWDPELYTSNGLKYPTQIMGSIGLQFTF

SEQ ID NO: 18749 - protein, 680 aa, Bacteroides fragilis
MKRCKTALLSATILTSATLMTAIPALAQDFTEIGTPLGRIVLGVGGDGNVAIDTPQAVTVITKEEIDRENATTLGELFDVVPGVQVTGSERIAGESFNIRGIGSFDQSSESRIIVTVDGATKFYEQYRLGSFFGDPALFRRVEVLRGPASSTLYGSGALGGVVVVETKDASDFLINTDTAIQTRLSYGNNNDEIKSSVIFATRPSDNFETLVSLSYRQAGDYTTGDGSVVASEFDAISGLLKSRLTFGDDNPQALTFSYSRGESDLDDTQLSQTNSSAFFGTVDRNLVDQTLAIRYENPMLGNNLIDLDVVLSYSDTQNEQSNPSLGFLCAIGNFEVLCPSEYGYETASLKVENVSEITGDNYVAYITAGVQLSYQERSAQNSLGTPSFHPEGTDEKVGIYVQGEFIFNDSLTLIPGLRVDQVNLTPADGTTLAESSETSFSPKLALHYEIDDTFSVFGSVSRTERAPTLDELFSSDADEPNTPNLVSETATSVELGLSASYAGLLTSDDVLDFKVTTFYSEIDNLISRDSTAATPFYNQVDASKIYGAEVEVAYQSDAMFARAAYSDVRGEDSATGVILSSIPARSLNLTIGGQNQDLGLRYGWQGNLVDGIEYAATEFSGYAVHDLFVDWSPQQGAMEGFNVGFRVNNVLDRQYQNSLAGDAGKGRSYEISLTRGFEF

SEQ ID NO: 18750 - protein, 739 aa, Bacteroides fragilis
MQRLIIGSLLLASVTAHANELDTISVTGNKPALESQPVALNTHITASELATINTADSEDVIKYQPNLVVRKRFIGDQNGLLTFRDMHTFQTPRALVYSDGLLLSNFLGANFATAPRWDAIQPREIDSVDILYGPYSARYSGNSLGGVVAFTTRMPDQFEAHLSASAFLQAFDAYGTEDDYPGNRLNAMVGNHSGKWRVLMAASQLRNKAQPQTYGITGSPQGSNSGTPVTGAAPYSPGGYVYNAGPSEDITEQNLKLKFGYDLTESLQARLTLAYLNRRSDSLDPESYLHDNQGNPVYDGTVNIDGADYTVFGQRMNTTDRQDLLVGLELEGDLGQGWDIQTAISTYNLLDEDIRISANNYQLATRGGPGAQIEDLGTGWQTLDLNLGHRHNHRWLGQRLAFGYHFDRYQLDLASYATSAWRTALNPTLTSRSRGQTQTQALFIENEWALTQKLALTLGGRQEWWHASQGSLTLPGLMADYPERHETRFSPKASLSYRFNPSWLSTLSVGQAYRFATVGELYQGNLDNTGNFNAAFDPNLKTEDGLSKNLMLKRFFPEATITINLWENDVDNTIFRQTNAFTGITNYQNIDRVLSRGIEFIGHWPRLLLNDLTVDFNLSYTQATIKNNATLPSSRGKQFPGVPRWRANLQALYQATRQVALSSGLRYASDAYDTLDNSDGEAEGFGFTDDYLVLDLRGRYQIDEQFSLALGVDNLTDARYYAYYPYPGRTLFAELHWNY

SEQ ID NO: 18751 - protein, 767 aa, Bacteroides fragilis
MKKYIFFLMGVVCFLLSSLAAHANELNKSDANIIGHVLDESTKEHLSFISVSLKGTTIGTMTDASGHYFLKNLPEGEFTMEVSAVGYKTVSRKVTLRKGKTLEENFEIEEDLIALDGVVVSANRSETTRRMAPTLVNVMDVKVFENTNSSTLSQGLNFQPGVRVENNCQNCGFQQVRINGLDGPYTQILIDSRPIFSALAGVYGLEQIPANMIERVEVMRGGGSALFGSSAIAGTINIITKEPVRNSGQLTHTLTGIGGTSSWDNNTTLNASLVTDNHKAGLYIFGQNRERSGYDSDGDGYTELPKLKNQTVGFRSFIKTSTYSKLTFEYHHLSEFRRGGNKLNRPPHEADIAEQLQHTINSGGAKFDYFSPDEKQRLSVYASAQHTGRDSYYGGGQDVNAYGATTDFTWVTGSQYIYSFDKCFFMPADFTGGLEYNQDNLTDDMWGYNRYTRQEVRIASAFFQNEWKNKQWSFLLGGRLDKHNMVDHVIFSPRANLRYNPTENMNLRASYSFGFRAPQAFDEDLHIENVGGTVSMIELAKDLTEEKSQSLSVSGDLYHRWGDFQGNLLIEGFYTLLSDVFALRQIGERDGIIINERYNEKGAKVYGLTLEGKIAYRSLLQLQAGVTMQKAEYKQARAWSDDETVPMEKKMFRTPDTYGYFTLSYNPFVPMTIALSGTYTGSMMVEHKAGFIDKDIAVNTPDFFELNLKAGYDFNLYKGITMQVNAGVHNIFNAYQSDFDRGAKRDSGYIYGPGMPRSYFAGVKLSF

SEQ ID NO: 18752 - protein, 357 aa, Bacteroides fragilis
MKRIIAAGVAGLMVTSTSWAQSSVTLYGSLDAGIAYVSNVGGHSKWMEEQGNMQPDRWGLRGVEDLGGGLHAIFQLENGFYTNTGNFAKAGTLFNRQAYVGISSDQFGQITLGHQTPFNFDMLGPLSTAYLAASWFAFHPGNIDELADTGVVPFDNSVKYKSISYAGFTVGAMMGLGNTTNFSTGKTLSFGVNYANGPFKAAAVYSNEHNRTPSIITTGINTFQNIPASTYSADKVENMGAGLSYQFGNLLVHGLYTRVKLQSNGFSDTYQSWDAGANYQFTPANTLAGGAATTTLAGRRWTQFEIGDIYALSKRTQVYVNVLYEHANEDAHAAFFTAGVSSGRNQAIVLTGIHHSF

SEQ ID NO: 18753 - protein, 386 aa, Bacteroides fragilis
MNKQVFALAVSTAVSAAFSTPASAQTSVTLYGVLDEGINYTNNAGRGHVYELASGYAQGSRWGLKGAEELGGGLKAIFQLENGFDVSSGRLNQGGRMFGRQAFVGLSAERYGVLTFGRQYDSVVDYLAQTTANGNWAGSLFSHPYDNDNTDNSFRLDNTVKYTSPSISGFQFGGTYSFSNDRNFGNNRAYSVGGQYAYGGLLVSAAYLQANNPGNGANGAITANDASFIAARMRVFGGGITYNFGPATAGFAYSKSSYLNPTGNGYLGITPLVPPGVLLNSLKYQNFELNGKYQISPMLFVGAQYVYTIENFDASSGGVKPKIHSFGLMADYNLSKRTDVYIQGEYQQVTGDSTYSILDEAFIPGAQAPSSTSKQVVVRAAIRHKF

SEQ ID NO: 18754 - protein, 380 aa, Bacteroides fragilis
MNLYLKHTLFYLLGISYALISSAQSNPDKLQCKVTGRMLLDGGVYLKNDNNFGNGVEFNDLRIGAKVAYQNWDMKLEIGYTGNKATIKDAFAKYTYKNHSIQVGQFYEPFSLEMMCSTFDIRFNQSPGAVLALTNGRRMGITYSYRNKRYYMSGGAFMDNEVNNLKKASHGYALDGRVVYRPVLDSKKLIHIGFAANYRTPNESLNEEDKNIFIYKSPSVSTIDNRNIAMATIDHAAYQIKFGTELLVYYHRFCLQSEYIRTHVERDNAFKNYVAQGAYLQCSWLLSGETYLYDESVACAGRPEGKSLEVCSRFNYLTLNDEDAAIWGGEQKDISIGLNYYINKYIGIKLNYSYLMPGASIKEISRKNFSVFQGRFQFIF

SEQ ID NO: 18755 - protein, 768 aa, Bacteroides fragilis
MTKKRVLTFFTFFFFFLNFQCVIAQGNQEDKILLSKLVPKIQKQFDVVFSYVDNTLDAILVTPPTENTSLENLLDGFESETNLRFTIINGRYIAITVFKDQIQELDEVYLTEYIASGISTNRTGQITIKPKNFSILPGVTEPDVLLTIQALPGISSINETVSNINIRGGTNDQNILLWDNIKMYQSGHFFGLISAFNPYFLKKVTVTKNGTSAQHGDGVSGMIQMELDAHPNDSLIAGAGMNLIHIDGFAKVQLNKKMEVQVSARRSITDLVETPTYAIYFDRIFQDSDITNNNQATNNTTTTNRDFYFYDMSTKFIYDISKTDNLQFSFLNIFNDLSYTEEATLNNQRQAVNSGITQRNFATGLTYTREWSPAFSTQLQFYTSNYNLEATNFNITDNQRLFQENDLADSAIKLHTKYRINENFTIESGYQFSEIGITNIQDVSNPQFRSDRKEVMRNHAVYSEVHYFSDSYRTMLTFGIRGNRYGKIDTFRFEPRLNFRQQFSNHFSLLVLGEYKSQAISQVIDLQNDFLGIEKRRWTLANGTSVPLIESKQASVGVQYNKNNLLITAEAYVKDVDGITTRSQGFQNQFQFVNAVGSYTTHGIDVLFNKKWHDFNTWLSYSLSKNDYEFTSLNNGEQFPNNLDITHNLTLGGTYSWNDFEFSLGTYFRTGRPTTSVGDPSVVNGEINYNSPNAENLEDYFRTDFSTTYRLTLSKKKKIYAKIGLSVWNIFDQQNVLNEYYNLDNQVVSQIQNRALGITPNLSFRVDF

SEQ ID NO: 18756 - protein, 749 aa, Bacteroides fragilis
MKRIVWMAVALLGAGITVHAQTSAKDSMRVVNLQEVQVVSTRATAKTPVAFTNIGKAELKKVNFGQDIPYLLSMTPSTLTTSDAGAGIGYTTLRVRGTDGTRINITVNGIPMNDAESHNLFWVNMPDFSSSVKDMQVQRGAGTSTNGAGAFGASVNMQTEGASMKPYAEFNGSYGSFNTHKETVKVGTGLLNNHWTFDARLSNIGTDGYIDRASVDLNSYYLQGGYFAENTSVKLIAFAGKEKTYHAWGYATKEQMEKFGRRYNPCGEMYTDANGKKYYYDDQTDNYLQKNYQLLFNHTFSTAWNLNVALHYTKGDGYYEEYKDGRYLIEYGLKSFTIDGTEVSKSDLVRQKKMDNKFGGGVFSLNYMANRLNASLGGGLNQYRGNNFGRVPWVKNYVGSLSPDHEYYRNKSKKTDGNIYLKANYDLTRGLSAYADLQYRHINYTIDGNNDKYDWSKNALRPLAVDKKFDFFNPKVGLNWNITSNHRVYASFSVAQKEPTRNNYTDGDPDSYPKAEKLLDYEAGYTFANQWLTAGANFYYMDYTDQLVLTGALNDIGEALTENVPDSYRMGIEIMLGIKPCKWFQWDINATWSKNRIQDFVESLPGYHYNDDGSSTSLPTIQIKHKDTHIAFSPDFLLNNRFSFNYKGFEAALQSQFVSKQYMTNAEVEELTLDKYFVSNLNLAYSFRPKKVLKEVTIGFTVYNLFNEKYENNGWASSDYTDTLENRGNYAGYAAQAGTNVMGHVSFRF

SEQ ID NO: 18757 - protein, 682 aa, Bacteroides fragilis
MKRHSLAWTLGLSLVPAIGASEPLELESTVVSASALAKKPHEMTTPAEVLEGDELVLRREATLGETLEGLPGVRSASFGAGVGRPMIRGQQGARVKMLSDGVDVLDASNISPDHAVSSEPLMAERIEVLKGPATLLYGGGAIGGVVNVIDKKVPTHVPENGYEGELELRANSVANEGSGVFGITAGSGNFAVRVEGVKRQADDYEIHGSPSKQDGSYNDTDTFSLGASFVGERGYLGVAFTEQNNRYGLLGHQHADCHLDGPAWHCGEHEDEHEEEHEDEEHEDHDEHDHEHEGEGVPYVDLRQYRWDLRGELQDPLPGFELARLRVAHSDYRHEEVEGGQVSTRFDNDASDARLELTHQPLFGWRGVLGGQTLRRDFRASGEEAYVPPTITRNHALFLLEEYTDGAWRYELGLRHEWQDIEAEGRPDKDHRGTSFSAGAVWSFAPNYSLGFSLSRSQRLPSAEELYADGPHAATRTVELGDPELDEETSHNLELTLRKFAGRTTFSFTLYRNQVDDYIYAADTGRDIGSGYREIEYRQQDALFTGVEGEVRFQATDATALTLFGDHVRGKLLDGGGDLPRIPAGRLGVRLDHGFTSSLDGQLEFYRVNHQHRLADFETETSGYSMLGASLTYHGALRRADYQIYLKGDNLLDEKARDHSSFIKDDVVQPGRNLTLGLRMTF

SEQ ID NO: 18758 - protein, 785 aa, Bacteroides fragilis
MKRVTTILFLMLLICVHTAAQQKVKLEVLEKGTEQPIIAANVIYADNEALRNPQYAITNTSGQAELKLPSKGICYYKVTYIGYVPVTGKIGGTQDEKVIYMKEDDLGINEVVVTGSRTARPIKMSPVTTQVLGGKALVDAGYSNLQQALQQETPGLNIQKVGFGNEISMQGLDARHVLFLMDGERMTGDMAGNLDYERFNLHAIDRVEIVKGASSTLYGSRAAGAVINLITKKTDKPLSIDAGIRYGQMNERNYKHPQPKDFLYMFEQNADRPNLQSWVSAGFKAGKFTSQTDVWYSESDAFYMYQAENDKKVYTKEANPFLPHDITVVSNAVRPPMGIEGKEHITVSQKLYYNPNPNLSVLVYGSSFFMNTYDLIQDMTFSQARDWTAGTKVTYHVKDWFSVTGSLHADFYDRFKRHERIDKRQKDYESSIYQPRLTVTSNYFNGHSLILGMEHTSDELTSDRFSGNANHDLKTRALKETEYFLQDEWTINPRWMISAGIRTNFSKAFGFMGMPKVAAKYSPDKHWSLRANYSMGYRSPSIKELFFNWDHLGMFMIRGNENMRPEKNNYFSLGAEYSNDRLFVSGTAYGNYFRDKIEGVWRIYDMQYNFEYTNLSQQRLLGLEVLARWSVLDCLTLNGTYSFVDVSKNKGIQVNTTSPHAATASMDYKYMKKNYRLNAVFSASYMGGKKFDVQDRVFVKEENKSYDAYFRCDLPQYVLCNLSVSQTFWNKVKLTLGMDNLFNYVPKTLGSGITMFNVPATAGARGWVQVEFMLDDVINSLKKKK

SEQ ID NO: 18759 - protein, 1123 aa, Bacteroides fragilis
MLLSYAIKQREIIQILRIMKCTVLLLFLLILQAHASVSSQNARVNMSRNQLPLKEFMAEIEKQTDYLFIYSDAEINASRQVTVKKGTHRVADLLREVLSKNNISYNFADNYISLHVRKEADAQSLAVSPQQKKNTVLVSGTIVDTAGDPIIGANIKLKGAQGTGTITDVEGNFKLEVPTNGVLIVSFIGYQQQEVAVNGKTMLKIKMAEDAEMIDEVVVTALGIKREEKALGYAVQKVGGSKLSTVKPVNIATSLTGKVAGLNVTNSTEFNTAPTLKLRGETPLLVVDGVPYSNISLNDIAADDIESVDVLKGATASALYGARGGSGAIMVTTKKGSQEGLNISVNSSTMFNAGYLVLPEVQHGYSTGQGGKYTAADFVWGDKLDIGRTAVQYDPYTYEWKEMPLVSKGKDNFKNFLETGFITNNNISISQTGKYGSFRSSLSHVYNKGQYPNQRLNKITYSVGGDMKFGKLSFEGGAIYNKRFYPNGEGAGYGGGGYIYNLLVWTGTDYDVRDYKNYWRKKDEEQNWMNDVWYDNPYYLAHEMTSSNDYDKVNTYLSGKYDIMPWLNFSMRAGADAYASRTEKKNAMSARGGWDKNGYFYTSKSTGFSFNGDALLSANHSFGDFAIDGFVGGTIYYYYDDAISSNTRNGLSIPGYYSLKASVDPIASSSSYKQKQVNSIYGKFSASWKSTVFVDVTARNDWSSTLPSETRSYFYPAVSGSIIMSQLLKMPEWLNFWKLRGAWTVTKSDLGIYDTNQAYSVSTNVWDGMNTAVYPEMIRSTTLEPTAARSYEIGTAFNVWDNRLRFDISYYNKLKYNLTREATISGSSGFTKTLVNYDEEQVRRGVEVSLTASLIQTKDWNWEVNANWARDRYFYAKVDPVYSTQKPWVAAGKRWDWYGIYDWERDPQGNIIHENGYPVQSKYQSVMGNEYPDWIWGLSTTLRYKDWTLGISLDGRVGGMAYSRTEQTMWNTGVHPDSDNKWRYDEVVNGKKNYVGQGVKVVSGKVEYDTTGKIVSDTRVFAPNDTQVSYESYIKNYNPWSGGKVYQNVHDCTFLKLRELSLLYTMPKSVCEKIHMKGVTLGLIGQNLLIWMKEFKYADPDVDSDDLNSPSMRYVGFNVKFDL

SEQ ID NO: 18760 - protein, 1154 aa, Bacteroides fragilis
MRRHHVRGFVSRLFWSCAIFALTATSGTSQTLGQITGRITDSSGAAVSAAKVTLVNTATNAVRSTLSTEDGDYTFPSLPPGVYNVRTEHSGFRIAAANHLEVQVQQSVRQDLTLEVGQVSESVEVSASADLLQTENLAVGTVVENRMLTELPLSGRNYLSLVALSSNVDTLSPSAGQAGSRQGGDRASQSISAAGQRIMFDYYTLDGVNNTDPDFNTYVTLPSVDAIQEFKVQTGIYPAEFGHQATQINVVTKSGGNSYHGALFDFIRNDKLDAVPYQFGTVHPVKSPFKWNDYGFELDGPVRIPKIVNGRNRLFFMANDEWKTQRSHSQANYTLPTAAEERGDFSALSATIYDPTTGGATGASKTPFPGNIIPTNRLDPISQRFLNYYAAAVLPTSTNNYPFVTSAPNNRDGFTLRMDFVESSKSQWSGRYSWGDENQSSNGLGGIGAKILTNYEQYLGTNTRTLNPRLVNEARFGYTRIYNSTGTLSAGANNAVGALAIPGLNPGDSATWGIPAISLNGDGFSGIGDNTDGPYVIQDNSLQFVDNLSWTRGKHQFRAGFEFNRQNFNQVGNQFSRGNFVFQPNATQSPTHTGGDAFAEFLLGDLYQSTVAVAIANAEYRRNTMGAFVDDTYRITPKITLSLGLRYELTPPWVDQLGNDFTVALPGLYFGPQAPRSKWPYFVRQGNCTDPYQGLAINWTDTTGAAGSHASPAPVCSNGAFPDALLKTDRRNWAPRVGISWSPDTKLVVRAGFGIFYNQDIGNAYFDMARNIAGRVTQTSGQNGGTVGVPNLFYSNAVPGGSGAVAQIPPPYAYAMSYDHRTSYTMQYLLNVQRQFGSRTVIEAGYLGNQSHHLYGFQDANQAIPYGYLGDGTSTPVSTRLPYLNYGVIQLVHDGGNAAYHALSLKITRRFGEGLSIVSSYTFSKSIDDSSGIRTQGFDTLFPQNSDCIRCERGLSSFDVRHRSVTSVLYDLPFGKGKRLNIRNSVLNGIAGGWQAGGIVTMQTGVPGTLSIGGVDNAATSDGGYDRPNSTGASVFAPNRTPSRWLNPAAFTEAPPGFFGSVGRDTIEGPGIFNFDMEVHKQFHMPYRESHVLQFRLEAFNVLNHPNWGMPNLNILSGAAFPGQPGTNAHQNFGVINGTQTAMRQLQIGLKYSF

SEQ ID NO: 18761 - protein, 1125 aa, Bacteroides fragilis
MNTSSMIRIVISSLLMAIFSQTCPAQVAVEIKGTVRSVTGESLPGATVIVEGTARGVITDVEGRFTLKARKGQMLKVSFVGMKPRLIKASSGIMNIILQDNVQEIEGVVVTGYQQIKNRVFTGAAASVKLDEIKLNGVSDVSRMLEGRIAGLSIQNVTGSFGAAPRINIRGGASIMGNVQPLWVIDGAVYEDLVSLTLDQLASGDAVTLISSAVAGLNASDIEDIQVLKDASATSIYGARALNGVIVITTRSGKRNAPNRFSYSYELSMRSIPSYTNFDLLNSQESMSVYQEMGRKGYFSLQNTLYGRRSGVYYQMYKALNTIDPATGQYYLENTDDVKRAFMREREYANTNWFKELFTHRPIHTHTVTFSGGGENSAMYASIGFYDDRGWTLADHVKRITANIKNSFYWNEDKIKATISAQGNLRNQNSPGTIPQRRNTVIGTFERDFDINPFSYALSTSRTLRPHNADGEREFYRNNWAPFNILNEYENNYLKTEVLDLKLQGELSYRLNDHIEVKGLAMVRHAVTKSSHFIAEASNVVQAFRANETPYVARENIYLLKNKDDPMQLPGVALTHGGIFNKTETSLRSYLGRLALDYNRQLSEHNIRAFGFTEIRYADRSMNPFQGYGIQYDRGNQVFSNPLIFEKLANEGDTYFSLTERYERGVTLSGSATYGYAGKYIFNGVFNYEGANTAGKYSRSRWLPTWNIGAKWNLDQEKFMRKHTTISRLALRTSYGLTAKMNEQAVNSTTVFKHVMVNRTLLKDRENALRILHLENRDLTWEKMYELNFGLELGLFGNRISATFDVYQRNSFDLIDLIRTSGVGGQYYKYANFGDMRTRGVELAIQTQNILTDKFSWSTTVTISGMKQKITRLLNTPNTFDMVAGTGRGNIVGFPRGSLFSFNFQGLNSNGLPTFDFGLYPSNKGANSEISGADFLDAQYSKSYLIYHGPIEPQYIGGISNTFKYKNWEFSCFVTMQAGNKIRMNPSFDPAFADLNVFSKEYYNRWLNPGDERKTNIPVIPSQDLIRNIGKENIEKAYNTYNYSQNRVADGSFVRMKNISLGYCLPQRFLSHLKIKQMNVKVNVTNPFLIYSDRKLNGQDPEFYRSGGVSLPTPKQYTMTLNVEF

SEQ ID NO: 18762 - protein, 743 aa, Bacteroides fragilis
MTNRKPLFIILFSLGYSGIYSQEQQVKKDSVYQLQEIVVSSQQILGSKFKARNRTGSAYYISPEEIRRLGYTDINRMLKAVPGVNMYEEDGFGLRPNISLRGTKAERSERISIMEDGVLAAPAPYSAPAAYYFPNVARMEAIEVLKGSSQVQYGPFTTGGAINLVSTPIPNSFSGKANISYGSKNTFKSHTSVGSSWKHFGYMVEYLRYQSDGFKKYEDHAAKGFKRNDIIAKIRVKTDHVKGVNHALELKFGYADENSDETYVGLSADDFKKTPFLRYAGSQMDKLKTDHRQWVATYLLTFSNKLKITTNAYYNYFHRNWYKLNDVRAGITSKEKRSIADVLVDPETNIRYFDILTGKTDREEEALLVRANNRTYRSRGIQTRAEYRFNLNEFFFDLEFGLRYHADEEDRFQWDDSYSMKNKKMVLFMEGIHGTNANRVTSANALAGYLLAKLRYDAWTVTAGLRYEDVDLLKKDYTKEDLARSGKVRIETPNHARVLIPGVGLHYQLMPAASVFFGIHKGFAPPSAELYQKPESSVNMELGTRVAIGNFRAELIGFYNNYSNMLGSDLAASGGAGTLEQFNVGEARVKGAEFLVQYQPLPKNCNVRLPLQVSYTYTDTEIRNSFESHSWGNVVRGDEIPYIFKHALNMQLGIECKWFYANIGARYNSDMRTSPGQGTIAEREKVPANLIFDASLNVFVNKYLTVRLNAINLTNRVYLTSRHPAGLRAGHPFGIYAGANVQF

SEQ ID NO: 18763 - protein, 431 aa, Bacteroides fragilis
MIKRKILAVLLLITCAANAQEINKQEVKNEVLRILDSINKAKLPDTKSGGGVEEHWYDRISLRGYAQIRYNGLFSTNDKVSCEQCDKSWGTTSTAPDAKANNGLFIRRARLVFSGQVHPNVFFYFQPDFASSPSTGIQNFVQIRDLYFDLSFDKKREYRVRIGQSKIPYGFENMQSSSQRLTMDRADAINSSILNERDLGMFFYWAPAEIRERFNMLVKDGYKGSGDFGVFAFGVYNGQIANKLDGNRDLNVVARVTYPFVIGSQIIEPGIQAYTGKWAFTGEISNGVTVNDPQYVKDQRVGATFVLYPRPFGIQTEYNIGTGPRYNTLTNTVDETDLNGGYVLLNYKWDIKKQHIYPFAKFQYYDGGKKYEKDARSYVVRDYEFGIEWQPIKAFELTAEYVIADRTFEDSALPINRQQGNVLRLQAQFNF

SEQ ID NO: 18764 - protein, 183 aa, Bacteroides fragilis
MNNSIISSSIFVALLASSSVYADSSEYLKAGTKEFNLQGLVDFDADDSYSVDLNSKYGYFIKDNWEVGGSIATDLSKSYKSFGLGIFTEYNFTNTTNFVPYIGIATELVKADYDDKLNDLESKSFDATAMNFKASLGVKYFIRANIALTAEFNYNIATDNLKISGGHAKDSFTKFFIGTSYYF

SEQ ID NO: 18765 - protein, 763 aa, Bacteroides fragilis
MKHYIVMLVLACVSMSSYAVNPIKEGNMIAGHVIVKGTEESIPFATVMILGTNRGAVSNEEGQFEFRKLAAGKYTLRVQVMGYKTQEKTITVSAEATSVVHFQMEEVSFTTDEVVVSANRNEVSRKAAPVVVNVMSAKLFETVNSTDLAKSLNFQSGLRVENNCQNCGFPQVRINGLEGPYSQILINSRPIISALSGVYGLEQIPVNMIERVEVVRGGGSALFGANAVGGTINIITKDPINNSFQVASTMSNMNGKSWEQYMGGNVSLVAKDNSYGIALYETYRNRNPYDADGDGFSELGKLNMNTFGMRAYYRPNYFSRINVEYHTTNEFRRGGNKFNLQPHEADITEQTKHIINSGGVSYDRYWGEKHKMSVYGSIQHTDRNSYYGAQKDMNAYGKTNDLTWVVGGMYVGNMDRCLFAPATFTGGVEYQSNSLHDVMTGYHRDMQQDVRIAGGFVQNEWRLNRWTMLVGARLDKHNLIDHPIFSPRVNFLYKPSDNLQARLTYSTGFRAPQAYDEDLHVTAVGGEGVQIRLADGLREERSNSFSGSVDWSFPMGHWQSNILLEGFYTDLHHVFVLEDIGEDQNGDKIKERRNGSGAKVYGVNLDAKVAHGREAQLQLGFTVQRSRYNRAEVWTSEGEEEQTTKRMPRTPDYYGYFTFTSAPLKNFDFSLSGTYTGKMIVPHMAGYIEKSRMEHTPQFMDLNLKLNYTFVLKDHIKMQVNGGVQNIFNSFQKDLDKGEFRDAGYFYGPTQPRTYFVGIKIMN

SEQ ID NO: 18766 - protein, 914 aa, Bacteroides fragilis
MKQHRIICIPTLTFALLLMFTPSILQAQDKPVFPIDSLITVGYATGNKKNISGSVEKITELGMNKDQITNPLEAIRGRVPGLTIQKGTNGPAALDAVRLRGTTSLTSGNDPLIIVDGVFGDLSMLTSIYPTDIESFTILKDASETAQYGSRGASGVIEITTKKGIRGKTKVSYNGSFGISSVYKNLEMLSGNEFRNLARQQGVAILDKGNETDFLQEIEQTGLQQNHHVAFYGGTDASSYRVSLGFMDRQGIILNEDMKNFTSNMNMTQHVFDDFLVCELGMFGSIQKNHNLFDLQKTFYSAATFNPTYPNHRNPETDSWDQITNASQITNPLAWMEVKDHDATSHISTHARLTFNLFRELKLILFGSYTYNIVENSQYLPTAVWAHGQAYKGTKKMESLLGNLMLTYKKKWNKHYFDVLALAELQKETYSGFYTTVTNFNTDQFGYNNLQAGAIRLWEGTNSYFEQPRLASFLGRFNYTFADRYIFTVNARTDASSKFGANHKWGFFPSVSGAWVVSEEKFMKRIPLVDNLKLRIGYGLAGNQSGIDSYTTLNLVKPNGVVPVGSSQVVTLGNMRNTNPDLKWEVKRTFNAGVDLGMFGNRLLFSLNYYNSKTSDMLYLYNVSVPPFTYNTLLANIGSMRNSGTEIAVGLTPLKTQDMELNVNVNVTFQQNKLLSLSGMYGGENISAPEYKSLASLDGAGFHGGYNHIVYQMVGQPLGVFYLPHCKGLIADGNGGYTYDIADLNGGGVSLEDGEDRYVAGQAVPKTLLGSNISFRYKRFDLSVQVNGAFGHKIYNGTSLTYMNMNIFPDYNVMKKAPGRNIKDQTATDYWLEKGDYINFDYVTVGWNVPVTKWKKYVQSFRLAFTVNNLATITGYSGLSPMINSSTVNSTLGVDDKRAYPLARTYTLGLSINF

SEQ ID NO: 18767 - protein, 355 aa, Bacteroides fragilis
MKKVLFGTTMLVAAGAFAGAAVAADPITLKLGGKQEQYFGGVASTKDGGREDGFGIDTDTEVYFSGSTTLDNGITVAARIELEAEADNANNADKQWVTVSGAFGKIEAGQRSGVFDEFMVVAPTVGSVSLDDSKSWLGAGNGINGSVTQLYLDQSLDDDDAKVTYVTPQFYGFSAGVSYTPNVGGPRANNSSIVAPTKKNRDLVQMAVGYDAEFGDVGLKASAAAATQSNLWIYQGGVNVSYAGFTLGGAYTEYDDQSAAAVASWDADASEGRVWTAGLSYAVGPYSVGFTYGQTDNDSKSGVDAAIYKIGGDYKMGPGIDLVGNVFYGETGIGSSNVDASREGFGAVTGIVLAF

SEQ ID NO: 18768 - protein, 1089 aa, Bacteroides fragilis
MKKTIFLILCILCSLGAMAQKKSITGVVTDASGESVIGASVVEVGTTNGVITDIDGKFTLSVDPNGKIRVSYIGYQPQVLDVKGKNSFNIKLKEDSEMLEEVVVTGYGGKQLRTKVTNSIAKVKDEALKVGLFSNPAQALSGAVAGLKVTQASGSPGAAPKVTLRGGTNFDGSGDPLVIVDGQLRDGMQDINPEDIESMEVLKDAGATAIYGARASNGVILITTKTGKEGRREINFKAKMGLSYVNNPYDFLGAKDYINVLRTGYSKSGFTTSDGEYVSIAPLGNLTSASPFGTGNTLNDKTIWNIMNKTADNAYLLQKGWQEMPDPLDPSKTILYKDTNPADYNLNNPAISQDYNINMSGGNDKGTYYAGLGYNRQEGLPIKTFYERYSFVLNASYKITDWLTSSSNFNYNRANWKNMPGSQTSEGNYFGRIMSTPPTVRFQDEDGNPTLGPVAGDGNQNYQPDKWWNFNQSDKFTMVQAFQIDILKNLSVKGTANWYYSESLAESFTRDYENTPGQFVRTRSSSASFSRNFSQTYNVVLNYNQTFAKDHNVAVMLGMEYFDRYSRSFSASGSGAPTDDFADLSLTDNGEGKRSIDSGHSDYRILSYFGRLNYDYKGRYLLSAVFRQDGYSSLLGDNRWGFFPGVSAGWIFGQENFVKDALPFLSFGKLRASYGVNGNATGIGAYDLQGSYNSQKYNGNVGFLIGALPNPGLKWEKTRTAEVGIDMSFFENRLNANFTYYNRLTSDKYANLSLPSTTGFSSIKNNNGKFRNSGVEIELSGKILKTKDWSWDLGGNISFNKNKIVSLPDNGLIRNQQDAAQIYSGRQLSDGTYEKIWVGGNQEGYEPGVLIAYKADGLYRSWDEIPGDLVVTSGNYFGKKMYGPEAWKKLSAAEQKNALPIQPGDVKWRDINGDGMIDNYDQVVVGNTNPHWIGGFNTTLRWKNFQLYGRFDFAFDYWIYDNTTPWFLGCMQGTYNTTKDVFNTWSEENPNAKYPRFVYADQLMNANYYRTSTLFAYKGNYLAIREISLSYSLPKAWANKAYCQKVDVSITGQNLGYITSANVASPEVSSAGSGYALPRTLLFGLNVTF

SEQ ID NO: 18769 - protein, 1109 aa, Bacteroides fragilis
MKKTIFLILCILCSLGAMAQKKSITGVVMDASGESIIGASVVEVGTTNGVITDISGKFTLMVDPNGKIKVSYIGYQPQVLDVKGKNSFNIKLKEDSEMLDEVVVTGYGGKQLRTKVTNSIGKVKEDVLQKGLFSNPAQALSGAVSGVRVLQTSGDPGATPTIILRGGTDYNGTGSPLVLVDGQVRGSLSDINPEDIESMEVLKDAGATAIYGARANNGVILVTTKRGKEGKGEVSVKAKVGINYYNNPYEFMNAGDYIYWMRTAYQRSGQIYKDSKGNWVGTADMNSLNNATPYGTGNLYFDPSTGAVLDGNKDVRAVWSTMKYTDDLAFLLKQGWQTMTDPVYGDQIIYKNTDPASFNLHTPSLSQDYNISISGGNDKGNYYAGIGYNNTDGTATGNWYKRLTFTFNADYKIKPWLTSSSSFNFADATWYGLSPGSRGEVEYFNRMLSLPPTFRGYNADGEMLLGPNSSDGNQSFNLSKFKRDNNTDKFTMVQSFDIKLMKGLNLKLTANWYFDEAKYEAFNQDYLSSPNNMNTSRSTSAEFDRTLNQTYNAVLNYDYQITKDHYLAAMLGFEYYDAYQKGFNASGSGAPTDDFGDLQFTSNEEGKRNIDSWHSRQRIMSFFGRVNYDFQSKYLVSFVLRKDGYSKLAKDNRWGVFPGISAGWVFGKEKFMESLQQVVSFAKLRASYGLNGNVNKDWVGNYTVQGSYGSNKYNGNTGYLLGSLPIPYLQWERSQTFEVGMDLSFLENRINTNMTYYNRRTEDKYATIPLPSSSGVSGITSNNGKLQNQGLELEFGFKVLEKRDWKWNINLNAAYNINKILELPYNGLERNRQNAMEVYTGRKLDDGSYEKMWVGGYQEGQRPGDIYAYKAEGLYRSESEIPGNLIDKSTGNNSSNNKILYGPEAWAKLTDQEKSKGLPIQPGDVKWKDVNNDGVIDVYDQVKVGNTTPKWTGGFNTTVSWKDLTLSARFDYALGFTVIDWKTPWIMGNMQGTYNTISDTKNTWSPENPNAKYPTYTWADQLGKRNYARSSSMFTFNGNYLALRELSLAYRLPSQLIKKAGMNDVSFSITGQNLGYLTEAEHMHSPESSSNNGGYPLPRTIIFGVNVSF

SEQ ID NO: 18770 - protein, 1083 aa, Bacteroides fragilis
MKKTIFLILCILCSLGAMAQKKSITGVVMDASGESIIGASVVEVGTTNGVITDISGKFTLMVDPNGKIKVSYIGYQSQVLDVKGRNSFNIKLKEDSEMLDEVVVTGYGGKQLRTKVTNSISKVSEESLKVGVFSNPAQALSGAVSGLKVTQSSGNPGSTPTIVLRGGTEWDGSGSPLVMVDGQLRDGLNDINPEDIESMEVLKDAGATALYGARASNGVILITTKTGKVGKAEINLKAKVGMNYINNPYDFLGAKDFITAIRTAYDTTPWASKSSLDGASAYGTGNKYGSDLVWNLLVKDSGNEFLLNKGWQQMQDPLNSSITLLYKDIKPSDYNLNNPSLTQDYNVNMSGGNDKGTYYAGLGYNKSEGLPISSFYERYSFIFNGSYKLADWITANSNFNYNRANWRSMPGSQDNEGNYFGRIMSLPPTVRYEDEDGNPVLGPNHSDGNQSYQPEKWLVDNQTDKFTMIQSLEIRPMKNLVIKGTANWYYSEGVYESFTKDFETAPGKFNTTRASSAKFERDFSQTYNVVLNYNNTFAQNHNIDVMLGSEYYDKKTKGFSASGSSAPTDDFADLNLTDNGEGKRTIDSWHSQYRILSYFGRLNYDYQGKYLLSGVFRYDGYSSLLGDNRWGFFPGVSAGWIFGKEDFIKNAVPDLSFGKLRFSYGVNGNATGIGAYTLQGSYNSQKYNGNVGYLIGALPNPGLKWEKTRTTEVGLDLSFFDNRLNANFTYYNRLTIDKYADLSLPTTTGFSSVKNNNGDFRNSGIEMELSGTILKIKDWTWKMGGNISYNKNKVVTLPDNGQPKNRIGGQQIYTGRKVLDEAGNQVDEVIFVGGKQERQEPGILVGYKAEGLYKSWDDIPENLIVKTGNYQGKYQYGPKAYAALSDAEKAKALQIAPGDVKWKDINNDGTIDAFDQVVMGNTTPHWFGGFNTTLTWKGLTLYGRFDFALDYWIYDNTTPWFLGCMQGGYNTTTDVFNTWSEENPNAKYPRYVWADQLGTANYYRTSTMFAYKGNYLAIREISLSYSLPQNIARKFYCQKLDVSVTGQNLGYITSANVASPEVSTAGSGYALPRTLLFGVNVTF

SEQ ID NO: 18771 - protein, 182 aa, Bacteroides fragilis
MKKTIFALTIASLLSAPALASKDGFYIGTDLGSNRLDSESFDTGIGLVAGYNFQITQQIVIGVEGEYRSYGKDKVTIIDGWSAELKAHSFGINVKPKYYFNDNFYAGAQLGLHSVKEEFKEDILGDVEKFSDSDTGLSYGLEAGYDFNQNVTIKAGYKAISVEPLGVDSDYSTFYIGANYKF

SEQ ID NO: 18772 - protein, 464 aa, Bacteroides fragilis
MKTNLMKLALTGTLALSAVGVVQAQSDSKSSGSNTDQQNGSAAAPAGLLPVPDYSTDIWTRQYLTGDWGGARTNLANKGVQLGVEWNQYVQSVVDGGRERATEYGGSFDYRLNLDLMRMGVLPGALIKFRAESRYGRSVNGIAGPILPVNSDAFFPNTGKLDQDIALAITDLNYTQFFSEHLGLFAGKLDILDADPNEFASGRGTSQFMNANFLFNPAVTLRLPYSSLGAGVVWMPIVPGTNGGVTIISMVINTADSSTTTGFNDFGKGQTWITEADFQYPLGHLPGGMNVGALYSFNQDFPKIRSRLVFLPGQGLVVPTQNYTWAVFCSGWQYLYTKESSYRPVDLLNGEPDRQGIGLFSRFGFADKQTNPTEWAVSVGVGGRGMIPTRDDDAFGIGYYYNNIQKLRLSGFLGLRNSAQGFECFYNVAVTPSCHATLDLQLVESGQSRVNTATILGLRASVDF

SEQ ID NO: 18773 - protein, 678 aa, Bacteroides fragilis
MNILRLPKLLYSCVAFCCCQALTVSLSAQQQKADTARTYSIPEVTVAEAYHTREVRAMAPTQVFSKEELKSLNVLQVSDAVKHFAGVTVKDYGGIGGLKTVSLRSLGAEHTAVGYDGITISDCQTGQIDIGRFSLDNVDRLSLSNGQSDNIFQPARFFASAGILNIQTLTPQFKDNRRTNLSASFKTGSWGLVNPSLLLEQKLSRKWVLSANGEWMSADGHYPFTLHYGEDNDLTSREKRKNTEVKNLRAEAGLFGNFSDTEQWRLKAYYYQSSRGLPNATTYYYDYSSQHLWDKNVFVQSQYKKEFSRQWVFQTSAKWNWSYQRYLDPDYKGSEGKTENSYYQQEYYLSASALYRVLSNLSFSLSTDASINRLNANLKDFAYPTRYSWLTAFAGKYVNDWLTASASVLATVINEEVRQGSAAANRRKLSPYVSASFKPFASEEFRIRLFYKDIFRLPSFNDLYYGQVGNTNLKPESTTQYNLGLTYSRSINELIPYVSVTADAYYNKVKDKIIAIPTKNLFIWSMVNLGKVDIKGIDIAGNISLQPWEKLRVNLSGNYTYQRALDMTEPGGKTYKQQIAYTPRVSGSGQAGIETPWVNLSYSFLFSGKRYMLGQNLRENRLDSYSDHSVSVSRDLRIRNVNTSLTVEVLNLLDKNYEIVKNFPMPGRSVRVTMKVRY

SEQ ID NO: 18774 - protein, 411 aa, Bacteroides fragilis
MDFLRLVQCAILQSATNNESLAWRNNSMKKLALSTLSLALLGAAGAAQAQSSVTLYGVIDTSITYVHGNDGKANNAWLMGSGNLQGSRWGLKGTEDLGAGLKAIFQLENGFNSNDGTLGQGKRMFGRQAFVGLQHDQYGTLTLGRQYDPLVDLVQPVTADNYFGSLFATPGDVDNNDNSLRVNNTVKYTSPVFAGFQFEALYGFSGIAGSPGQGQTWSAAAAYNNGPIGVAAGYFYTSNPSPTAGSRSTWSGSSDAIFDGAINSGYTSAKSIGIAQVAGQYVFGPVTVGLGYSNAQYKPDGFSGFSSTEKYNTGRGFVRYQATPALLLGLGYAYTKASGDTDAKYHQVSIGADYALSKRTDVYLAGAYQHASGTQRVDATTTQTAQASIGSYGVNGTKSQEMVALGLRHKF

SEQ ID NO: 18775 - protein, 1131 aa, Bacteroides fragilis
MKNNTLSGSYYPKNPQIKHFFRIMRITLFLLMACVFSLYAGNSYSQNTRVSFAMDNVGLNKVLEEIESQTDYLFIYNSQINVNKLVTIKANKQTVSKVLDQILQNTGIEYKLEGSHIILEKKVEEVHNSSSAVQQQQTKKITGKVVDKTGEAIIGANVKIQGTDKGTITDLDGNFILEVAPKDVLAISYIGYLDTKVPMTGQKQIHVVLSEDNKMLDEVVVIGYGTTSTRKMASAVTAVKGEKLQDLPFNSVAASLAGRATGVIVQSSGGEPGSAPSISIRGGGAPVYVIDGVISDAWDFNTLNPNDIESLSILKDAASLAVYGSRAANGIVMVKTKQGGKGKTAVNYTFNAEFSQPTKLLKKTRGYDYAYNQMLAGINDGLDEADLPFNQEVLDIIKNQSDPYTSGHADTDWLGEGLKTVAPQYKHTVSLSGSGNKVNYYISLGMLNQGSIYTSNALNYDRYTVRSNVNTTFDKIGLKVSLNLNGAYEKKEYPSFSAAKIWEDLYNQSPLNPAYNKDGTYAAVTDHPLAEMDKRSGYNRNYGKFINTQVAADWTLPWLKELTLGAMFNYRLNDSHVKKFSTKAPQYYADGAVYPIGKPTLNEEGYWGESYNFEVSAAYVKTFAEKHTIDAKFVYNVAENTGWNFNAYRGEYLSTVVDQLFAGAADTQQNGGNSDEGGRMGLVGRLKYDFMNRYIVEGSFRYDGSDNFTPGHRWGFFPSGAVAWAISEEPFFKEWDQHVFDLLKLRASYGQTGTENGVNRFGYLSTYSLDEKKIVIGGKLQSGFSEGALVSPELLSWYQVNSFNLGLDMAFFNNRLKGTFDYFYYVTKGGLMSPGDRYTTPLGKPLPQIKSNSEQRREGVELTMRWSDTTPRKFTYGVGFNMTYFNSLWKVKADEALSDLMNPYKRQTHQTDYYGLGYIDTGLYQNKEDILNSPRRLGSTQTKLGDIGYTDVNGDGKIDGEDQVRIGKPTMPHFTYAFDFSLGYEGFTLSGLLYGTGERYMTFGNRYQSGEGKYLYYENQLNYWRPDNTGADFPRISISSGVNGNNNKAGSTFWMRNASYLRLKDLQLSYDFKYKYLKKCDWLQTCRVNLSGSNLFTISGVSKFFDPETSSTSGDGYPVQRVYSIGVTIGF

SEQ ID NO: 18776 - protein, 209 aa, Bacteroides fragilis
MHRIDTKTAQKDKFGAGKNGFTRGNPQTGTPATDLDDDYFDMLQEELCSVVEASGASLEKGRHDQLLTALRALLLSRKNPFGDIKSDGTVQTALENLGLGEGAKLNAATATLGRTGFIAIPVMIGGIEQSVIIQWGWNAAKASASGGDGNTVVFPVAFNNACVAVVANYDNVSAPINAVATGGYTTTSFLLRCAAQTGSYYYNWIAIGY

SEQ ID NO: 18777 - protein, 286 aa, Bacteroides fragilis
MKKSVIVGAISLAMTSLLSAETPKQEKAIKTSPTKKGERNAAFIGIDYQLGMLSTTAQNCSHGNCNGNQSGAYGSNTPNMPTASNPTGGLTHGALGTRGYKGLSNQQYAINGFGFVVGYKHFFKKSPQFGMRYYGFFDFASSYYKYYTYNDYGMRDARKGSQSFMFGYGAGTDVLFNPAIFNRENLHFGFFVGVAIGGTSWGPTNYYFKDLADEYRGSFHPSNFQVLVNGGIRLGTKHQGFEIGLKIQTIRNNYYTASADNVPEGTTYRFTFHRPYAFYWRYIVSF

SEQ ID NO: 18778 - protein, 726 aa, Bacteroides fragilis
MLLSSICCVQTLSSAARAEDIPVEENASNDETAEKNTSPTPRSHSKEKISQSVTSKDIEVVASRKDLLGKTSTASEGSITAKEIQLRPAYRVGQILEAVPGLVVTTHSGEGKANQFLLRGFNLDHGTDLATFVDDVPINGATNAHGQGYTDINFLIPETLGGVDYTKGPFHANIGDFGVAGSDHMKLADDIPRQVSFSGGTLGDYRFYIGGTTHFKNGDRWVNALSLQHADGPWKYPDNARSIRAMSHYTHGDNLDGFDVTAMYYRGKWRATNDQPIEAIETGMISRYGSLDPTDGGFAERYGISGHYRKSGSNWKFVTSAFATHSRMTLWNDFTHYLDDPVNGDQHSQHEARTTFGGSAVYSRNDYIGDFKTDTQVGLQGRYDILYVNRRHTYHRQALEECPGSLNPSGRYLCNGDNINLGAVGFYVENTTHWLPWLRTVVGFREDYQGGTDDNLVDGSTTKKHQWLFQPKGSLIFGPWKNTELYFSGGKGYHSNDFRSVSGSYSADQFAQNSVKVPLMTAAVSGEIGIRTTPIKNLHMQAAIFLIDFDSELSYDGDAGVNTPGPASRRKGVEFSAQYNPLSWLEFNTDLSFAHARYRTKDPSQYGIDGLYVTNAPKFVWAFGILADSHKAWYGSLQVRWLGSYPLNEDNSLRSKGYREVNLSVGYRVSKRLRFEASIFNLFNNHGYAAQYAYDYRLTPTSAVSTGATGHSIEPRSARFSVIGNF

SEQ ID NO: 18779 - protein, 687 aa, Bacteroides fragilis
MMKVKLALLLTLIGTLPLAAQNVRQEQDTVSYMNDDPFNLEQIVVTATRTEKKIKNTPVITQIITSKQIEERGTGNIQDLLTQEVPGLNFQEVGYGTSIDIQGLGSKHILFLIDGERIAGENGGNIDYSRINLYNIDHIEIVKGASSALYGSQAMGGVINIITRKAKKKFEASAGIRYAGRNQQNYKDTPKDHSQYKYRIHLDKPNLNTNLSLGLNLGKFTMNTDVLYKSFDGYQLFDKKPLVKYFPAYNTTITEELSKTPTSISGYEDVQVAHKMDYRFSKRLKVQLKGSYYMLNKYDFQADNIFEKSEDYTYGGSIDYTISDKSSLVASVHTDHYNRYDKYELKSGRRLEYKNNIIQPRIVYSTTALDKQTITAGLEYYRESLFSDKFETGVKENKSQWYATAFLQDDWSINKQFSVIAGLRCDYHEKYGTNLTPKASVMYKIFPFTVRFNYARGYRSPSIKELYMNWDHLGMFWIYGNSKLKPETNNYISLSGEYVNSWININANVYSNWFRNKIEGMWSNDQTELHYINIGKSRLAGVETMCKIQINRHINVHGAYNYLYTSKDADGVRLSSSSPHSGNIRAEYNTRIPRYATVVNLSGNIMGKKKFDVLDELEIDGKKVEAYYQAKVNPYCLWDLTVSQYIMQNLRITAGITNLFDYTSDRVTFNTSTSPGRNYFIACNYTL

SEQ ID NO: 18780 - protein, 1129 aa, Bacteroides fragilis
MQNYFSIQFLWVVKSLWLTSKKIPLSMRLLVLFLVCSIGLTYAADSYAQKALISIDVRNQRVEDILKEIEEQSDFDFFFNNKHVDLNRRVSVSADKSNIFSVLKEIFSGTNVKYSVLDKKIILSIEAQSPEQEKKITVSGTISDAQGEPIIGASVLEKGVQGNGTITDIDGNFKISVSSSKAQLDISYIGYQSQTVAVQPGKNMKIILQEDSKQLDEVVVVGYGTQSKKTLTGAVSMVNMGDVEMNTVPNVSRALAGKAAGFRVNQVSAQPGGEAKFRIRGEASTGAGNEPLFVIDGFPVSSTSNLSSGNGFYESGNIDNVLESLNPDDIESISVLKDAASTAIYGARAGHGVVLITTKRGKSQKPRVTYSGMGSVQVARSNYKMLDTRMYMDMYNKQMHEEWLKLNGMGIYEGYVEKQDTPPTQYKPTFNNDEILTASGTDWLDAVMRNGYTQQHNLSVNGGTEKTRYLASVNYMNQEGIVKNNGVSRFSARLNLDQELSEYVSFGLTATYSQNKYDNVPLGDNANEYSGVLTGAIQSNPTIPIYDSEGNYFIDPKRPFVANPVSLLDIKDNTVKDRIIGSAFVSVKPLKDLEVKLQLGVDRSFQKRSSYLPKTTLQGKTKNGRADISQETSTAYLMELTAQYSKNFGDHNVKAIGGYSFQKFKNDGLSAGNEDFLVDGFGYNSLGSGNYKKPSVGSWASINSIASLFARANYSYKGRYLLEATVRADAASNFAPENRWGYFPSVSAGWMISEENFMKGASNWLSMLKLRTSYGQTGNSNVGYRIYDYYEVGRSAIIGGAESTGVYASDLGNRSLTWETTTEFNVGVDLGIFNNRFKLTAEYFKRKITDLLVTNKPLPFYNEINKIAGNIGSTQSQGVEITVNTVNIVTKDFEWDTTLTLSHYNDRWLTRDPNWKPKPYEKENDPIRAWWEYEALGILQPGEKVPDAQKDLVPGMMKLKDRDGNGVLGDEDKVYMGNGDPKIIYGLNNSFRYKNFDLNIYFYGEAGRKRGASYYEGWTRMDNGINVSTYALKAFNSNNLTATDPTFVRGGSGWGDYYVKSIYYVRCGSITLGYKVPISQKIAKNLRVYVDVNNPFVITNWTGLDPETDNGTYAYPNVTSYNFGVSISF

SEQ ID NO: 18781 - protein, 684 aa, Bacteroides fragilis
MKKIPHRKHDALAHATLLALACLGGVTLSQSALADQQDTALPTVTVTGEKINRSLKDTTTAVTVLRDADTGEIKSVYDAAAATPNASLNGAGIVNIRGVEGTGPGTGYNTLVSGSRPRVSTTVDGMSESWNGQRYVDASPWDVEQIEVLRGPQSTTQGRNTMAGAIVVNTKDPTFDWEGALRAGYENRDGKVTLAGMISGPITDELAFRLTAEGLNGHGFIDYPGQMPWDGSQINHSSYRGKLLWKPSALPGLTAKLTVSHRKDRGEYLNYVDGNYFDYQYHRLSTQARYQDSFNNTVSTDLQYQFNDAWTAHLLLGHSDNVSTFKDTDTPPLNMRLDEKSNTVEARLAYAPQNGWLSGMMGVYYYDRDQNLHTFRFPNLLAKDRLKTEALYGETTLALSDKWSLNLGGRIEREMQRRNTAFNPDVGGQSQANYNMGETLFLPKAGLSYRYSQDTTLGLTARKGYNAGGSGLDDNYVYYTYNKEEVTAYELSSRSTFLDNRVSLNANAFFNQYTGYQAMQQTNGSSRFTNIPKGESYGLELEGKARVTSMLTISAGLGLLNTKVTATDAAHPGILGNQFNYAPHTTINLGFKQRLPHNFYVGGSLNRVGSYYSEITNDPNLKAGDYTVVNLNTGYEDARWGVRAYVNNLTNRGVLYSQIASRSNNLGVVGAPRTVGVTVDYRFN

SEQ ID NO: 18782 - protein, 936 aa, Bacteroides fragilis
MTKKILIITMLLLLSGVVIAQKKTVSGTVLDEKQQPLIGATVLEKGTTNGTAVDAEGKFTLNVSENAILQVRFVGFKTQELSVSGRSTFNIVMAGDAALDDVVVVGSRGVPRIEVDTPLPVDKIGAKELIATGQTTFDKALQYSIPSFSTVQTPVNDATSLLDPYEIRNMGPSRTLILINGKRKNLSSLLYVQTSPGRGETGADISAIPVDAIKRVEVLRDGASAQYGSDAIAGVINVVLKDQTDAPALTLRGGVTGAGDGEFFGVSFTNGSKFAGKGFINYAIDLSQQGLSNRPGTVNAAGEAMDFGADINFVNEFLSRKPDAGNINGAPQTTAAKFLINGGINLSKNTEVYGNAAYVYKKVNSFANYRTPYWRTIQDFPYLANFFPGNHPTNPSGYDGYVPSFDGNLADYHATLGIKGKLGEWNHDASLTVGGNQQGYTVNNSHNRNFVYSPSTWLDANSNGTVDTGELTQGSLLYRENSPITFDVGGTRFTHTVGNIDVSRKIGEKLSLGVGTEFRSETFTVIEGSLASYDGGGADSFAGNQPENSGKFNRYNIGGYIDLLYDITDNFLINGTARVEEYSDFGEAFVWKVSSRYKFLEDKVILRGSVSTGFRAPTLHQIYTQKAQYSFVPGQGIQVGGLVNNVSPQAKLLGIKPLEAEKSQNFTAGIALKPKKGVSIAIDYYNIEVRDRIILGTEIGPTTAGNTPLDALLTANNLTDVSFFSNAIDTRTSGIDFVGAIRYLALGAGTLSINLSGNVVLENKRINNVKNPAIVESANQSVANATQEALFFTSRPETKWILGLNYELGKVTFMVNNTLFGKTTFKQQGLDNNLRTEFEPRVVTDLGVTISPTDNLTISLNANNILGILPQWKFVAENPAGQAIIDDTSTNAFGLTPIQIQSNLITFNQRYSQMTYDGYHFSQLGFLFNASVQLRF

SEQ ID NO: 18783 - protein, 1089 aa, Bacteroides fragilis
MKEKTNLFPSLIRLRETSRLKMAIAASIMLWCATPQQATADTNEEHAIEAVQQAKVKVKGTVVDETGEPMIGVAVKVLANNTGTITDLEGKFSVEAPLGGAIQISFIGYKTVTVKASSEPISVTLKEDSQQLDEVVVVGYGSQKKVNVTGSVSMVDSKVIESRPVQNVSQALQGVVPGLNMSVGNSGGALDSSLSINIRGAGTIGEGSSGSPLVLIDGIEGDMNTVNPNDIENISVLKDAASSSIYGARASFGVIMITTKSGKSGKTRVNYSGNVRFSDAIQIPDMVDSYTFAQYFNRANTNDGGGLVFDEAALERIKNYQTGKYTDPNTPEYYGAKAGNDGKWQNYTGSFANTDWFKEFYKNWVPSTEHNLNISGGTDKLTYMISGSFLDQKGLLRHGEDQFNRYTMNAKISAKLTDWATLNYTSKWTREDYDRPTYMTGLFFHNIARRWPTCPVRDPNGHYQQKMEIIEMEDGGKQTSQKNWYTQQLQAIFEPIKDWRIVAEGSMRTYTRKQSWAVLPIYAYDADNQPYLLGWGDNAAGYSEVQDSRESEDYFSTNIYTDFAKTFGDHNFKIMVGFNGELYRPSGLTGFGTDLISPEVPSLGLTQDNKKASSWASEKAIAGFFGRLNYNYKERYMLEANLRYDGSSRFIGDKRWGLFPSFSAGWNISREAFFEPLTQVVGTLKLRGSWGQLGNNNTSETNAWYPFYQNMPTGSASSGWLINGKKQNVAGLPGIVSSLMTWETIESWNVGIDWGLFDNRLTGSFDYYNRYTYDMIGPAPTLPSVLGASAPQINNCDMKSYGWELELSWRDRIQQFNYGVRLVMSDNMQKILEYPNKTLSLGEKYYTGKTIGEIWGYKTIGIAQTQEEMDKHLANGGKPNWGSAWGAGDIMYANIDGKDGVNSGANTVNDHGDLKIIGNSTPRYNFGLTLDGSWKGLDFSLFIQGVMKRDYMLDGPYFWGANGGMWQSCVFKEHLDYWRPEGDPLGANTNAYYPKPYFSSNKNQKTQSGYLQNAAYCRLKNAQIGYTLPKAWTKKAAMESVRVYVSGDNLLTISGISDIFDPETLGGDWGPGKLYPLQRTISIGLNVNF

SEQ ID NO: 18784 - protein, 1083 aa, Bacteroides fragilis
MKKHKYLFVACLSLFPVMAVAGNDTLHEIMEVPSATNINKNRLYKGKVVDDRTSEPLVGATVKVKGSTIGTITDIDGNFALDIPDNISPIVFEVSYMGYASKEAAPAKTTGFTIRLAEDSQTLEEVQIIAYGKQSKMSVTAAISSIDTKELLKSPSGSVANALSGAVTGLSSIQPSGQPGAENPSIYIRGTGSLSDELSKPLILVDGVERSFFQMDSHEIESITVLKDAASTAVFGVRGANGVVLVTTRRGVSGKPVISLNSSFGLTQALRNLKGVDSYTYATLYNEAQLSDNPSLTESQLGFSPFVIDMFRTNEDPIMFPNVDWNDYLFKNLAWQTQHNLTLSGGGERFRYFVSLGYLLQDGMLKQLGESYDPNYQYKRFNYRSNVDIDITKSTLLKVNIGGHVGAKREPRTDELWRKVLWSTPFSSPGIVDGKLISNIYSNRYISIGERSCPLDYYYNYGYNVDTDNVLNLDLALEQKLDFITPGLSMNIKGAYNTNYNVKASRTPSGADSMCTPIYLGSIETPGMDFWDPRFDRTIVYQTDGVSGLHEQMSYGEEVGRGRNWYGEFSLNYSRSFGDHDVSALFLYNQSKKYYPETKIDGKVFYMDIPTAYVGYVGRMTYAYKKRYMVDLNAGYNGSENFAPDKRFGFFPAVSAGWILSEEKFMKKQKVIDFLKLRASYGIVGNDKMENARFLYMAGAWSGYNTVAKGQGSWQFGKDGGTGLLPDAKENTMGNPDVTWEKVAKQNYGIDLKMFDSRLSLTADVFFEKRKDILSTRNTLPAITDINLPKINLGKVNNHGYELSLGWNDRAGKVDYWLKANVSYAKNKIIYMDEVVPNEPYMAETGRSTGLTYGYIFDRFLQKDDFDADGNLKKDENGRQILPQMALGTPRPGDALFKDLNGDGVINGDDKTRFGYAERPDYVFGFLGGLKWKNFEFSMQWTAAMNASRILDGEYRNAFGSTNSRMLLKFLADGRWTEENPNSRFPRLTFMNKSHYLQTSDLWLMNGSYLRLKTAEISYTLPQKDFLKKVGIESVRFYCNGYNLLTLFSDLNDIDIDPEGVTDGGNNNYPNIRIYNFGVNISF

SEQ ID NO: 18785 - protein, 1136 aa, Bacteroides fragilis
MKKCNLRWFSPQKIKRQLAFVLAICLVCIVPVTTYAQILKISMKRTNVSIQNVIRELEQKSGYTFFYNDNQVKLTKKVSVDVTDAPIENVLDQIFNNSGYTYKIIDNQIVVSAIKAEIPKTSSLQQQKSVRITGQVKDTTGEPIIGASVVEKGSASNGTITDVGGNFKLTVSGNEIQITYIGYIPQTVKIHPGVTDYSITMKEDTKTLDEVVVVGYGTQKKVNLTGSVASVSTDEIKDRVQTNVLSAVQGTVPGVTVISRPGQTPSINFRGRGNLGTSSPLYVIDGAIADATFFSNLDPNSIESISFLKDAASSAIYGSRAAYGVVLVTTKQGKSDKMNVSYSGYVGLSNPTYKPEYVNSTQYAELYNEALYNYNPKGGKYQGYTEEEIGYFRDGSKPDLYPNTDWNDLVLDKNVLTTQHSLDFSGGTDKIRYFIGLGYVYKDNMIPGQDSQRYNLNTNLSSDITKWLTVKAGVKYIRNDSDRDCGAPSLASFSMVPVTFVAKQSNGDWGTVNGGQTATSNFITGNPLRALSKKDWSKSKSENTMYDLGFDIKPVKGLIISGQGVFKGYEYKSKSYTALQPNAINYFSGEEIAGTGVTKNKMSMDWQSTNTMLYTATARYDWSNDKHAVGALVGTSYEHYKYERLAGSREEFPSDALTDMEAGSTSGAGYTNGAGSSEYKMLSYFARVNYTLMDRYLFEVNMRADASSRFHKDHRWGYFPSFSAGWRMSEESFMKDIEWINNLKIRASYGTLGNINNVGNYDYFQNYSSGNHYNFSDSPVIGIGESKPANETLGWEKVALTDIGLDFDIFNGLLGVTADYYIKNTSDILLGYNVPTETGITAAPSQNIGKVKNTGFELALNHRNKIGAVNYSIGANIATNKNKITNLGGSDNIIQTSSYIVKYILKKGESIGSFYGFKTDGLYTQADIDAGHYYTLSGVVPNAGDIKFVPQRDIEYKQEITDEDRTILGKDVPDFTYGVNLSLQYKGFEFSMFGQGISGTKVAFDVYGVHPFYHGQDSPRKYHLKRWTEENPNPHAAYPRIYSASSVHTTYNRNFSDYHLFDSDYFRFKTLSLGYTVPSATVKNWGLQSLKVYVTGENLFTVRADKKMEDFDPETAGGVIYTLGTKSVAFGVNISF

SEQ ID NO: 18786 - protein, 805 aa, Bacteroides fragilis
MKKCFCLLLTLLCISYSAVAAPGFRIKGKIVDANNNQPIDFADVLLFREGDVNPVFHALPDRDGTFRIADVKDGKYNLLVRLVGYDLYNRPGIVLDAVSKAVDLGTIAMKPLEVGLAEVEVVAQKKQVIYKLDKKVIEASSNLLAGGGSAVDILENTPSIRVDAEGEVSFRGSTGFTVYVDGKPSVFSGTQALEQIPAGHIENIEIITTPSARHDTGGDVGIINIVTKKHAQHGFSGMVNLTGSTVLSRGVDFLVSQQNKASRWYLGGVWSDRLRKSDFDQEKTTIISDTATTSHSNGPRKSNNFNYSMKAGWMYTLPHTTLNADFEGGYGGRTRNGDLDYKEKRLAGGATFGEGDYYSRDDYDLHETYFQGTIGFDHKFDDKGHQLMGSFYLKYGGNAMEYFQSDLFNKNNEREKGHRAWEDEHRWTVRGNLDYIYPYSKTGRIEGGYQYFSYLEDGDYTMHFWDPVKKEFYNRDDIYNTFYFQHGINSVYAIVADSYKSFDFQAGVRGEHTHRVLRSSIPGKDRTYNKFEFFPSLHLGYTFPKEHKLLVSYSRRITRPELFFMEPYITYRDFYSAEIGNPDIRSEYINSFELNYKKNIGEHTVSATVFHRNRKDKIERLRVPYEAGVTLDSMANVGHDYSTGIELSGQVQLTRWWNMNLNGSLYHYKVKNRYKTGSEKETSTNYDVMWNNSFDVFKYTRIQVDGNFVGPSVTTQGRTDAFWYVNLAVRQQLMNRRLSATLSFRDVFNSARYVSKIITSDLQSITRIRPSYPLITLTLSYTFNNFKAKSSQKKEDHDLFEGTNH

SEQ ID NO: 18787 - protein, 223 aa, Bacteroides fragilis
MNETNKTMVKILMGMALLSSLQATEAELDEKSKKPKLADRNTFYLGVGYQLSAINTSFSTESVDKSYFMTGNGFGVVLGGKFVAKTQAVEHVGFRYGLFYDQTFSSHKSYISTYGLEFSGLWDAFNSQKMFLGLEFGLGIAGATYMPGGAMHGVIAQNLGKENSLFQLLVKVGFRFGFFHNEITFGLKFPFIPNKRTEIVDGLSATTLWHRLPVAYFNYIYNF

SEQ ID NO: 18788 - protein, 1055 aa, Bacteroides fragilis
MKKISILFLILLCSCTFLYAQQFSITGVITDKKLKEPIIGASVIVKGTTNGTVTDLDGNFTLQVSKENVLVISFIGYITQEIKVNENQSSYNIQMSEDTQTLDEVVVVGFGTQRKANLTDAVATVDTKVLDSRPVSNLGQSLQGTVPGLNLSVGGLGGQLGQTMNVNIRGTGTISTGSKAATLVLIDGIEGNMNNLNPDDVESISVLKDAAASSIYGSRAAFGVILITTKKGKAGKASISYSGNARYAGPNHLPDLMNSYQFANYFNEGSINGGGKAIFDEDTMERIQQYMNGEITTSTIANANGNWQFHEKANDNVNWYKTHYKWAWSQEHNLNINGGSDKSQYYVSANYLDQDGNLRYGNDSYERISTNAKFNAQPFKWLDIEVNTKYVYTKLDNPLYSDMNGLFYHDVARLWPTMPFKDPNGHYMRNGKLGQLTNGSRSITSNNNVYLQGQLVFHPLKNWNIYANVGLRLIDQVQRQNLNKVYEHNVAGEALELAYGGEYAVGQTGAMQYWTKANHLTTSLYSDYSFSFDEHQFKVMAGVNTEKYNNRYLSVKRMDLITESVPEIGTATGEDKINEASAYTWATTGFFGRINYDYSNKYFIAGNLRYDGSSRFLRKDRWGLFGSFSLGWNMAAEDFFPVDENIINQLKPRVSWGTLGNQNTNSYYPMYLLQTVKTNGGSWLMGDSKPTVAGMPGTISSSLTWETVQSLNIGFDLGMFRNRLNVNFDYFIRKTLDMVGPASEVASIYGIGMPASNNTDLRTKGWEVAASWRDRIGQVNYNIGFNMADSRSFVDKYPNKSKSLSTYYKDQELGAIWGYVTHGIAKSQSEMDEWTKDNKPSWGSGWGEGDIMFEDLNGDKVINEGANTVDDPGDRKIIGNSTPRFRFGLDLGVEWKGIDFSMFWQGVAKRDLWLDGPMFWGISGGEWQSTGLKEHLDYYRPENTTSVFGPNTNAYFPKMYMSKDMNQKVQTRYLQNGAYARLKNIQLGYTFPTQIINKLHMQKLRVYVSAENVLTITSLPSGFDPETTYSNYSDGNSGKTYPLQTTISFGLNATF

SEQ ID NO: 18789 - protein, 706 aa, Bacteroides fragilis
MKQQFKRRPIALFCGALFAFGLYTSAFAQSSQSTVIVTGSRFEENLNEVPANVQVITRDEIANSTSSNIPDVLSQIGGLNVRSTNPGQLNLDATVDMGGYGVGANSTTLILVDGQRINSIDSTSISWESIPIDSIDRIEVLQGGASVQYGNGAVGGVINIITNGNTSKLNQASVSYGSYGTLVNNAILRDSFEDTTYQLTANTSNTQGWRQNSAANAYAFDAKITQKFGGIDKIYTDFFYGYTNAQNPGGVVGQVGEGNPQSAKFNNIGSNTTTNNAGVRFGGTKGLGDGYIGELDASYTNRTVFYYNPFYDSDAALNVTPYPIVGASNSNLSGWQLNLTPRLKADLGPLGTGIVGYELNKAGQGGTNAFGSAATNILTQDYYISNPNGLPYNSQHASVLNQSFYAILKLPITKELSLDGGARHQMQQASTYDSNIYSPNGAVTADQTYSANAGDVALNFNYAGKQKVYVKWNQSYRFPNIDEFWGFDPNTYNRVFNGILRPQIAQTYEVGGNWMWSSVRVNGSIFSSSSQNEIMYDPSSGLNYNSQYNVNRRGVAMDTSSNITNRLSLAGGGKFQHSYYADGPYAGNAIPVAPNLLLNARASYSIDENWSVGGVVNYVSSQHYDASQIYYSSLALMPSYTAGDVYINYKTGNFDAKFTIKNVGNASYASYGGYTNVMAANGTFSNNYYYYPSDGRAFYITGKYNF

SEQ ID NO: 18790 - protein, 1045 aa, Bacteroides fragilis
MKNMMLFLMALLMSGHMMAQQTIVTGVITDANDGSPLIGANVLVKGAGTGSIANVDGKYSVNVPNGKNVLVFSCVGYKEQEITLKPGQKVLNVTMKEDTELLDEVVVIGYGSMKKSDLTGSVTSIKSEDLMKTNPISINQGLQGRIAGVQVNQNDGAPGAGVSIQIRGANSFSTSTEPLYIVDGIPFTSSGMPGTGKDGMMQTANPLSTINPSDIESIEILKDASATAIYGSRGANGVVLITTKRGAKGKDNISFSANFGISKVVKKLDMLDGYAYAMYRNEAAQMFNEYENANEAIPYPGTSKVDPNTGESVYSPGPEDYRNGTYPSVNWQDEVFETAFSQEYNLSVNGSNDKGYYAISGNILDQSGIIHNSGYKRYSFRANLARKVHEWIEIGTNMSFTNSLNKLAKTNSVSDGIIRGALFYPATAPLDDETNNAQLNWFSSNPYVYTRAAKDELTTNSFFSSSFVEITPYKDLKVRQNVGFSYNINERDVYYNRETVEGKDPTNGYASKADNWSKNLVLETMATYNKTFNRNHSLNVVAAFSYERGDYGNKAMVATGFPQDLTEDFDMSAAVNPQKPTSGRGMTSLVSFLGRANYNLMNKYLFTASFRRDGSSKFAPGNKWSNFASGAIAWRASEEQFIKDLNVFSNLKFRASYGQTGNQAIGAYATRDYLTVANYPINGALASGFANLTWRGPANPDLKWETTSQYNVGVDMGFFQNRINLTIDLYYKKTSDLLQNIQIPQSTGFSNMTTNFGNVTNKGLEITGKFYAITGKNLNWDFDANISFNRNKISGLPGDQFAQGWSKADNVFLQRNGMPIGTIYGFVEDGFYDNIAEVRADPFYAKESEAVCKAMVGEVKYKDFDGVAGITNADRQVIGDTNPDFTFGMTHNFTYKNFSLSFFLQGCVGGDIFNANLLEVTMSGIGNIPLNIYESRWTPENRESAKWPKAYAGYGRTMKLSDRYVEDGSYLRMKNINLGYKFISPFKGIESINLFASVSNVFTISGYSWYDPDVNSFGSDASRRGVDLFSYPSSRTFSFGLQCTF

SEQ ID NO: 18791 - protein, 312 aa, Bacteroides fragilis
MKKSTVLVTMMSAFFGTDYVAAAQISPDFSADSMSVATSVGILGGKSKELVYDASNARKISQLDWKIKNVAIIKADFSWDAYSFLTLNARGWTSLASGSGHMDDYDWQNSNQSDWTDHSSHPGTDVNYANEYDLNLKGWFLQGNDYKVGAVAGYQETRFSWTATGGSYSYNNGASVGNFPNQRPGIGYSQRFSMPYIGLVGQYRINDFEFNALFKFSDWVRAHDNDEHYMRSLTFREKTSDSRYYGASVDAGYYVTRNAKVFAEFSYSKYEEGKGGTQIIDTISGDSASLDGDAAGISNKNYTATVGLQYRF

SEQ ID NO: 18792 - protein, 1030 aa, Bacteroides fragilis
MKNKIAIWLACGYLGLCIPQLAAHEIIVPVQLKGVVLDETGNPLPGVQIKSEKDGDEFLTDQNGAYNIELKDGSKYLTVSYVGFVNRKISVERAAREKNIVLQGSSEILDEKIDLGYLTVSRRALTGAVSTVSGEVLDKSPESNLGKTFAGRFSGMITMEKDAELGQGTKSSTSNAITLLVRGLSTINGVKPLILIDGVISPNVNYVYITPDEIESVTVLKDASTTAIYGIQGANGVISIKTKRGLVGKAKVNVSFDQSLQQTTRKPLFVNAANYTRMRNEAGVNDGLGSYSQFTKEQMEHYERGDNVAYPDNNWYDQFIRPVTWMTRAGVSVRGGNERVCYYSNINYMHQSLPFKTADEATTKYDPTPKNDRFNFRSNIDVKINDYLSGFMRLSGNINLNKTTGYANADIYNHIFNLPPTMYGPLTPSIDADGNLLENGGQVVTHDSEKTPVYGMLNRSGYIKNLVTNINAQAGLTADLGMLVKGLSVTGLMAYQTNSANQTKTTQDFERYVMNGDPTDLNFILKGTNTNSALQYAKNSTSYYNLNLYANANYNHMFGAHSISALAYIFYQQLETESLQGAQMLPYKRRSIGGSATYGYKERYFVKADLGYSGSEQFHPNHRYMVTPSISVSWIVSDEKFLKHLRWLDLLKLRISYGVTANDQLGNARMLYEDYMDVKGNEGLKGNPLLSAEKMKKQNYGFDLGFFKGLTVSFDWYKSICDNMLVSSGELVPEYQGIALENYPKLNKGRMENQGFELSAMYSKLLNKHWSFYLGGAFSYNKNKVIDVMEAENVGYTYPYKTQGYSRGQYWGYIIDYSNGNGMFNFRDELEKSGLSYAFGTPRVGDFIYKDLNGDKVIDEKDKAPVGYSKYPRQYYNLSGGLRFKNWELNFMFQGAGKVTTVIEGVGAYESAYQGVFNDIHLNAWTEERWNNGETITYPALSLKESTNHQPNSFFIMDASYLRLKNAEIAYTLPVHISQKVMAQRIRISLSGQNLFTIDNMRSKYIDPEIANLGTFQQYRVFNFGVNLTF

SEQ ID NO: 18793 - protein, 859 aa, Bacteroides fragilis
MFVKSAMGGGRKFVISIAVLFYVANLSAVDTNNQYVLSEVNVDANHTSTKSSGVLVKTDSFGGKKTITRGLIEATPAGNGDITSLLRTNPAIKFSNANRQSTTMGEIDPAEITINGAKSYQNNFMIDGFNMNNDLDPTATRGYGRSVTGSAIQNVGASVSQGMAIDSDFIDNVDVYDSDISAKYGSFTGGVVNAKTRDPKAGFHGKISMSHTRDSWTKYHISGDSEDFENSTNADNQPYFKKYTTRLNLEGFLTNDLGLMFGYTNTRSKIPLRQFTSKYAGNGYEATKVNQRRNIDNYFLKGVWYATDRLAITPSIIYAPQENKAYHDQSKDSFQYYKSGGLSLNLKADYEFDFMKVMQQLGYSKLETSRDAETKNHFSWRPSNLKSWGIGSSQNSSNEGGWGDIEQIQKTLSYNLDLEFNEFDLLGSTHKIITGVELKKQDAKFEIKEDFVIGSNSRSLRGVRCAAGDILCSQDDSNGGLGQYLATKTEYSKGKINVDLFSWAYYIEDEIKFGNLKVRPGLRFDGNDYMDKKTIAPRFSTSYDVFGDENTVVSFGKNRYYGRNIFGYKLRDGKEVLQQAYTRNANVYSTNWTAVRQAGNLSKFTQLDMPYDDETSFGIKQNLDSVALAVKYIKRKGRDQIIRSKAADIGQVCPAGYRNTCYMYSNLGKSDTKVWNVTLSSLEPFKFLGTSHTFEFAYDHMDKKTNNNYVSDDFANGVTAELVHYKGNIIYYDELPLSDYYRPWTATLTVVSKVPQVNLTLSNFFTYKANMNTIARQGTVRINGTSYNNYEEVNLGKSYSWDMRIAYTHKLPKDISAFINLDIYNVLDRSNKATTVSENSTALTYEAGRQFWLEAGLRW

SEQ ID NO: 18794 - protein, 116 aa, Bacteroides fragilis
SQLIPNISPDSFTVAASTGMLSGKSHEMLYDAETGRKISQLDWKIKNVAILKGDISWDPYSFLTLNARGWTSLASGSGNMDDYDWMNENQSEWTDHSSHPATNVNHANEYDLNVKG

SEQ ID NO: 18795 - protein, 1060 aa, Bacteroides fragilis
MKRKLMLLLTCLFMGIGLVTAQTQKVTGVVISEEDGQPVVGASVLAKGTTVGVITDVDGKFTLSGIPSSAKTLQISYIGMQTAEVAIAPVIKVILKTDAKALDEVVVTAMGISKEKKALGYAVQDVKGDKLTQASSSNLSSALQGKVSGVEISPSSGMPGASSKMTIRGSRSFTGDNTPLYVVDGMPISSSTDLDTFNSVTGSDYANRAVDIDPNDIESINILKGQAASALYGMRASNGVVVITTKSGKGARKGKPEVTINTGLSFDKVSTMPDFQKEFAQGFNGAFSPSDSRSWGPLISELANDPKYGGNTDNSYTQKFGKHQGQYYVDQRAKAGLDPWATPRAYDNAKDFFNTGVTWNSSANVAQSLDKGSYSLSLGSTTANGIVPSTGMDRYNAKLTAQAQLSKNWSTGFNGNFVYSKIKKQTGANNGIMATVYGAPSSYDLGGIPSHIDGDPYTQNTYRSTGGFDGAYWAVENNSFKERTQRFFGNAFAKYSTDFGTENHKLDVKYQLGTDAYTTNYTDTWGYGHSNGTGSIEEQSVTNNEINSLLTVTYDWKITPELDLNVLYGNELVDNSSKYKYNLGSNFNFPGWNHIANASIYSSTGTYHRERTVGNFGNISLAYRNMLYLNATVRNDIVSSMPRNNRSFTYPSVSLGFIFTELEALKNDVLTYGKIRASYAEVGQAGTYYPSYYRTPVYGGGFSSGTPIQYPIGSISSYIPYYKIYDPNLKPQNTKSYEIGADFSFWNGLISLNYTYSRQNVKDQIFEVPLATSTGYNELITNGGSVHTNSHEITLSVNPIQTKNFNWDFAFNFSKIDNYVDKLAPGVSSIMLGGFVDPQVRLSAGDKFPVIYGTSYQRNEEGQIVVDENGMPTLGENRVLGNVSPDFRMGFNTTFEFYKFRLSAVLDWKQGGCMYAGSVSTLDYYGVTQKSANYRKADHFYFEKPAVKQLADGSYAPNDIKISGENAYNYFDRLSTISEAGVYGSSFLKLREIALSYPVLNKSYLGVTVNVFARNLLLWSEMDNGIDPESSQGNNNMAGAFERFSLPGTSSYGFGITVKF

SEQ ID NO: 18796 - protein, 993 aa, Bacteroides fragilis
SSAKTLQISYIGMQTAEVAIAPVIKVILKTDAKALDEVVVTAMGISKEKKALGYAVQDVKGDKLTQASSSNLSSALQGKVSGVEISPSSGMPGASSKMTIRGSRSFTGDNTPLYVVDGMPISSSTDLDTFNSVTGSDYANRAVDIDPNDIESINILKGQAASALYGMRASNGVVVITTKSGKGARKGKPEVTINTGLSFDKVSTMPDFQKEFAQGFNGAFSPSDSRSWGPLISELANDPKYGGNTDNSYTQKFGKHQGQYYVDQRAKAGLDPWATPRAYDNAKDFFNTGVTWNSSANVAQSLDKGSYSLSLGSTTANGIVPSTGMDRYNAKLTAQAQLSKNWSTGFNGNFVYSKIKKQTGANNGIMATVYGAPSSYDLGGIPSHAEGDPYTQNTYRSTTGFDGAYWAVENNSFKERTQRFFGNAFAKYSTDFGTEDHKLDVKYQLGTDAYTTNYTDTWGYGHSNGTGSIEEQSVTNNEINSLLTVTYDWKITPELDLNVLYGNELVDNSSKYKYNLGSNFNFPGWNHIANASIYSSTGTYHRERTVGNFGNISLAYRNMLYLNATVRNDIVSSMPRNNRSFTYPSVSLGFIFTELEALKNDVLTYGKIRASYAEVGQAGTYYPSYYRTPVYGGGFSSGTPIQYPIGSISSYIPYYKIYDPNLKPQNTKSYEIGADFSFWNGLISLNYTYSRQNVKDQIFEVPLATSTGYSELITNGGSVHTNSHEITLSVNPIQTKNFNWDFAFNFSKIDNYVDKLAPGVSSIMLGGFVDPQVRLSAGDKFPVIYGTSYQRNEEGQIVVDENGMPTLGENRVLGNVSPDFRMGFNTTFEFYKFRLSAVLDWKQGGCMYAGSVSTLDYYGVTQKSADYRKADHFYFEKPAVKQLADGSYAPNDIKISGENAYNYFDRLSTISEAGVYGSSFLKLREIALSYPVLNKSYLGVTVNVFARNLLLWSEMDNGIDPESSQGNNNMAGAFERFSLPGTSSYGFGITVKF

SEQ ID NO: 18797 - protein, 979 aa, Bacteroides fragilis
SSAKTLQISYIGMQTAEVAIAPNIRVILKTDSKALDEVVVVAYGTQSARTVTASVSTVRADALKDVPSVSFDQMLQGRASGVSITTPSAGVGQAPIVRVRGVNSITSGTSPLYVVDGVPIESGNLSYLANANALADINPADIVSMDVLKDAAAAALYGSRAANGVILITTKQGQSGKVKVSYDGFVGFSNATDFYEMMNAQEYVDFKNLAVKNRYGTDELSLTTGYVSPYGNKAFNMMKDANGNYVDTDWKDAAFQNGLSQSHSVAVSGGSDKVRYYLSGNYTTQEGIVKGDKYDRLGVKANINVQATDWLKVGMNTNVTTGTTSYVDAARRGSNFAVGGFPRLALINAPNLPMYNEDGTPYYLAQGLGYGGNTVFSTFSNPAAILSLGNGLSSDVTRFIGVFYAEATPLKGLSLKTQYGVDYARIEEQRFWSPLHGDGVNSKGLANAYNTKNNRWTWTNTATYNFSLGQNNFNLLAGTEASERNNSRWTAQRKDLQDDKFVVFQGPFGSATAGGSLSNNTMVSYFGRINYDYASKYIVSLNYRRDGYSALSEKNRWGNFGGVSAAWRVSEEGFFKPLRNVVDDLKIKGSYGVVGNTDIYDYASKSFYSSYNYGINGTYGLAQIADPNLKWESSEKYSIGFNARLLDRISVDFDYYYTKSSDLILDVPQSPSKGIPGNIITTNAGKMKNSGIELTVSADVIRNSQFTWETSFNITTNKNKVISLADGVENILKGDNGGLEITNITVPGKSIGRLYLYPTAGVDPKSGRRVFITPEGDRTLLMFEKGGWFYEDGTEYAGEFEPVDCGNTLPTWYGGWTNNFKYKGFDLSLFFQFSGGNKIYNGTKASVSDMRYWNNSKDVYKKYWTPERTHAEYPMPIYGDNYSNGSALPISDLVERGDYLRLKNVSLGYTFNTKNWSKAVGISALRLYVQAQNLFVITGYSGMDPETLTNVESATLSGGTDKNTLPQARTYTIGVNLTF

SEQ ID NO: 18798 - protein, 736 aa, Bacteroides fragilis
MKYRIKPVTAAVAVALSAFAVQQTQAQTTLGEVVVKTSKIRDAVTPEEIGSAEIAAQHAITRDTASLLRDVPGVHLYGAGGVSSLPVIHGLADDRLRITVDGMDFISSCANHMNPPLSYIDPTNVAKIRVYAGVTPVSVGGDSIGGTIIAESALPQFAAPGQRSLIKGEIGTFFRSNNNAIGGNLSATLANEFFSINYSGAITTADNYKAGGNFKTTTATGRPGHTLPLDEVGSTAYKSLTHTVGVALRADNHLLEAKLGYQNVPYQFYPNQRMDMLDNEQKRVNVRYLGQYDWGTVDGRVYYEAVDHYMNFSDDKQLVYGTALNGMPMYSRGRTLGFNLKGDIDLTSNDLLRVGMLYQHYTLEDWWPPSGTGAMSPLTFENINDGKRDRIGVFAEWERRFGSQWTTLLGARYEHLETDANNVHGYGNMMGNQIPDTNAFNARGHKRTDDNVDVTALARYTPGDMIDLELGLARKVRTPNLYERYAWSTWSMAAIMNNFVGDGNGYVGNMDLKPEKAYTASLTIDLHAVDREWEVKATPYFTYVNDYVDAIRCSSGPNCTVTNATTGNQFVILQYANQSAHLYGLDLSGRTVLAKTSLGEFGLRGLMNYTRGENKKTGDELYNMMPLNGKVTFTHQYSGWSSAVELVGVARKSSVSSVRNEIHTGSYFLTHLRTSYTWKNMRLDLGVENLFDRLYALPLGGAYTGQGMTMGINGIPYGIAVPGMGRSVYAGLNIKF

SEQ ID NO: 18799 - protein, 978 aa, Bacteroides fragilis
MKTRTFNKTKLATSLSLVLGMSSILPAHAADEVSDENIEVISVTGIRGSLIKSMDVKRSSSGVVDSISAEDIGKFPDTNLAESLQRITGVSIDRSNGEGSKVSVRGFGPDYNLITLNGRQMPVTTGSRSFDFANIASESISGVEVHKTSQASDSTGGIGSTIDILTHKPFSSPGLKATFGVKAVDDQSTDNGSVTPELSGLYSNTFADDKFGISLSASYQERESGNQQAQVGTGWRSFPGSADNSDWGGVAKDSTQVNRPGDSDIYSVPQTTVYRFEEQQRTRTNGQLVLQYSPVDSVVASVDYTYMRNDIDTQSNDVSAWFNFVPSENVWSDGPIASPLIYSETYDSPADLSMAAGDYGVRNESGSLGFNLEWQATDNLKLTFDAHNSVAENKPNNLYGSNNNLSTAAFVRTSAATDFSGDLPVLAVGGGNAVTPADMMLTGSVFGNARNKSEIDQYQFDGEYLFEDAGSIDFGVALTNVNNHSQSVNVQRNDWGGVGSAGDFEDAWFPADTIHDKFDANGGDFSLSDGNFDVLDTIFMWDFASVRDFAAANYASAVSGDCGNGFCPSTNYAAETDRYTEEESQAVYVQYNYDNEIAGMPYDVHFGLRYEQTDVTSTAAVAGYNGADWIAETEIALVGTGEQVFETKTGDYDYLLPSFNFNIEVVEDVMLRAAYSETIGRPSYTDIQGGTVLATLANRSNGGGSAGNPTLLPLESENIDFSAEWYYAPSSYVSVGYFRKDTKNFISSETVKTTNGIYNPASGDLYKAAVAATGTTEAGAVRDYIFANYADNAAVDVTNQIISGSAANNDELLNFNISTPSNSSNNSVIDGWEFAAQHFFGESGFGVIANYTLVNSDQAYDNFSFDAQSALIGISDTANAVFVYENYGFQARIAYNWRDEFLNSTGQGTGANPQYTEAYSQIDLSVSYDVESVEGLTVFFEGLNITEEYIRVHGRADEQVLNLTETGARYSLGARYTF

SEQ ID NO: 18800 - protein, 352 aa, Bacteroides fragilis
MKKMIAATLVGALCASAHAQSSVTLFGRIGGGVRWVNGLPGGSQVGFNNNIIAGNEFGIRGREDLGNGLKALFVLDGAFNSGNGALKTSGTLFSQAAYVGLAGDFGRLTLGRQFNVAEDLGIALDPLGGRGQSLAVEPGVLFDGNFFTLDSRFNNTIKYLGQVGGLRFGANYSPGGVAGRSHAGTSYSTAAMYTYSDLMGGVSYAKTYSPDGSQSAQTIQAGGTLQLGRARFYLSYASLNVRANKAGAPSRRDDIPSFGVVVQPLPSVQLSAAAFYDRARNLGNVSGADGHKLTTYAIAEYFLSKRTELYVEVDRNGMTGAYMRDPATIAALNLRRGASATTGMSIGLMTQF

SEQ ID NO: 18801 - protein, 1058 aa, Bacteroides fragilis
MKKNRVYTVNSLLARIGGNYKFWLIALPAVTMLAQAPAVYAHAETITVVQQNNATVRGSVKDATGESLIGVSVTVKGKEGVGTITDVDGNYSIVCSAQDVLVFSYVGYATQEIAVKNQKQLNVVLKEDTKVLDEVIVIGYGTTTRKSAVGAVDQVKASMIEDRPVANMTDALQGAAPNVVIQQRSSNPNDRKTNFNIRGISTVNDNSPLFVIDGLVADGGSFDKLNPNDIENISILKDAGTAAIYGSRSSNGVVLVTTKKGKKNQRATVRLSGMMGWQNPDILFSPVKGYQNATLRNLAATNAGEAPLYTPDQIRDLAAHQNEESWFFDQIVRTALQQNYNLSVSGGSDKTTYMVSMGYYDQESNYVGNSDFGVQRYNFRTNVSTEVGRLKLNAILAYTRNNSVSTTGGSLEVDAARVPTYYYYKMKSEDGRYLLNDVLTEFNPLGALEAGGRNKYRNNYLNANVNAEFRLIDGLKLRGVLGADVINDMRSTRNLGVSYYLNEEATEPRPVKDTDYRTSNWNHTAYLINSQLLLDYNKTFGKHNVSGLFGVTNESFTSSSNEIEKKGVDPDLGIGTDITNSTVGNITGKTFVDESNRTSLTSLLGRVGYSYADRYYTEFSFRYDASSKFHKDYRWGFFPSVSLGWRLSEENFMQAYKERVGDLKLRTSFGILGNQSIGTYDRFTVYELYNNSYAYNNQTVSGAGFKLGKDNLTWEKTKTFNVGVDASFFNNALNVTFDYFYKRTSDILMKPLVPSVFGTDMAMDNIGEMQNQGWDLSINYRLKTGAANHNFNFNLGDSWNEVLKYPGHERISQIEELSRITREGCPLESYYGYKMDGFFQSYEEIEASAIPVGGKVQPGDVKFVDRNEDGVIDSKDKFILGNAFPRLTFGFNYNVEWKGFDFGMFWQGVGKRDMMLRGELIEPFHANYSYNIYKHQLDFWTPTNTDARWPRLTAPGSTSNRNNYGNGQGSDLFLMDGKYLRLKNLQIGYTFPKTWSRKVGMEKARIYVNGQNLLTFSNNSFIDPESSEFDSKMGNSGANSGRNYPTLRYYGFGIDIEF

SEQ ID NO: 18802 - protein, 1137 aa, Bacteroides fragilis
MNKNRSIRVAAFCLGLMLAGSLQVHAQKVTFRDGTVSLKQAFEKIEASSKYKIAYNDSHLNVSRKVSLNQKETEVLEILATILKDTGYTYKKNGNYIVIVPVEQKPASKVKKVKGVVKDANGEAIIGANVLVKGTATGVITDMNGSFELEVPGNAVLQITYIGYVQQDVAVKNRDQLAVLLKEDTKTLDEVVVVGYGTMKKKDLTGAVASVKMDDTPLSTISTVSHALAGKAAGLQVNTISAQPGGGTTFRIRGAASTGAGNDPLIIVDGFPVSNAGNVSVGYNSDNGTTDNILASINPNDIESIEVLKDASSTAIYGARAGSGVIIITTKRGKEGKPKVTYSGSATVQTMATKYEMLDAQDFMIQSNRWFKEKWMYDNKVGIYGGKNESEAGSAYHPKYSDADIANPVNDTDWYDRITRTGFQTQHNISINGGTEYTKYLISGNFFNQKGIVKNNGMSRYTGRVNLDQKLSKYAKVGINLTVSRNTLDNVPLGAGQNEYASILVSAAQFSPLLSVKDENGDYSLNQQAAYIPNPVSLLEISDQTTKERFLATPFVEIKPINELTLKASFGIDRNYQRREVYMPKTTLYGEKADGRADIGQYDRSDYLLELTANYAKRLGDHNLNALVGYSFQRFTSKYLNAGNQGFLTDAFLFNNLGAGTYEKPWVGSSASKSEMASFFGRVNYTYKDRYLVTATLRADGASNFAKNNRWGYFPSVALGWRFTEENFARSLNLDKVLSNGKLRLSYGQTGNSNIGDKSVTYYGTGYNKVFGNKEYTGVYVSQIGNPDLKWETTTEWNVGLDLGFLNNRFNVTAEYFHKVVSDLLSSRSVLSYNEVGSIAANIGKTQSQGFELTINTKNFDTKDFSWNTDFTFSFYRDKWKERDENWSPNPYDMYNAPLRGYYMYLSDGLIQPGEEVSWMPGALPGQVKLKDIDGYAYNEDGTYKTDKHGIPLRTGKPDGKIDYADAVFKGCSDPGYLLGLNNTFRYKNFDLNVYFYGQLDLLKSGSYKDYWIVGSGTMTGVNNLYRGYNMPTSAKEVWSHDNTSGKMPGYFQYMSNYGYGDYFLEKSWFIRCRNITLGYTLPVKSAKKLVSNVRIYADVNNLFTITPYDGLDVETDDSYWAYPNVRSFSIGLDITF

SEQ ID NO: 18803 - protein, 659 aa, Bacteroides fragilis
MFASRLKIGGIAVLLFMSTTAWSATSVNDEAVFTLGEVIVTAEQQSVNLATTVTEVSTQDLRDRGAENVAEALQFMPGVDVQTGGKGQSYVSVRGFEQSDLKVLVDGVPVYEQYFRSLDLSQIPVDSIAKITVTKGASSVLYGANTMGGVINIITKRGTATPQTDITTSFGDYGTQNYSISHGGSTDKFNYWMNYSFRESDGFRLSDDFDEHGKFGIDSSLGEDGGKRDDSGYIKQSVNAKLGYTPTDATQVYLTMNYINDEKGIPDSDWYFDNWQQWMVSLVGEHRFNEQLRIKARTFYVDHEDTLKDTDYASSDWFYKSAYDNYTVGGEVQAFWDLGSYSFVKMGANFTRDNSKQQEVLAPGDSWQDAGDFESDTYSLSLEDEITVNDWLSLVLGTSWDYYDPRKADDQPVPDSDAVFNPQLGMVFTLSDATSIHASVGKKTRFPHLKELYSTMSGGNPDLKPQKTIAYEIGITHEFTNRINGSVAYFYNDVEDLIQKTGDKKLNTVHYSNVAEARIHGVEATLNANLTERFEAVFNYTYMRTEDKQNNRELEGRPRHRANLDLRYNFPFGLLVSTQASYTQRQFYIYQESRKSPEIWTKAPDYFLLNLRLEQQLPAFAGIDSSLFLQVDNLTDKDYINVGNLMPGRNFLVGMHAKF

SEQ ID NO: 18804 - protein, 1056 aa, Bacteroides fragilis
MKMIVLFLFVFISGVFAGNANSQETKVSISKNNKPIREILGEIERQTDYLFVYSEKEVDVNQRKTVNVSQQRVADVLSSLFRSTNVGYAMEGHNIMLMAKTTQTDAAQQKRHITGVVKDIKGETIIGANIMIKGTGTGVSTNIDGEFSIEAAAGDELIVSFIGYLTQTIKIDSQKTLNIKLLEDTKTLEEVVVVGYTVQTKSAVTGSVAVVKADKLKDVNTLEVGSMLQGKVSGVYVSGSSGEPGHASKIRIRGKGTLNSSVSPLWVVDGVIVGEDPGLNPNEIDNISVLKDGSATALYGSRAANGVIVVTTKRGEYDANKYSVSINAGVSLLSTGRLEMMNSQELYDYQKSWNNQSWFTEELLKHNTDWFKEASKPGLYTNANITYTGSSGRMRSFVMADYYREEGAIKDFTLDRFTFRSNNDVKFTDRFTMSTKISGSLSRTDSQQRSVYNTYLYLPWDFPYNEDGSIRSGQEQDWRGRDGINDMYDLQWNWSRSKKLTVDGTINFNYQITDWLRFESNNYIRYISNRSESYTDKRSRSGQSDKGSLSNSNSLLTKQFTNQMIRFEKSFGKHKVNALGAYEYTRHFYESTSAEGRGIQPGREILDVTTGIKSIGGYKDAIATQSALFNANYDYDNRYMGQVSYRMDESSCFGKNNRMGHFFTVSGGWNIQNETFFESLRESVNQLKVRVSYGSLGNTPGAYYGHYPLYSSMMYNDEVAYFPSQMGNADLSWEKCYTTNIGIDARFFDRFGVTIDLYNKNTSDLLYYAPLPNISGYTGQYKNVGAINNKGLEISLNADVIRTSKFQWTSDFNIGFNRNRVTELYGGKPELKGLKRLEEGRDMDEWYLREWAGVDPANGSPLWYTTDENGKRTTTDSYNKADRVYCGSAAPKFTGGWMNSFSYKGFTLTANFDFVYGNLLYNQSRELLDSDGAYADYNSMKLKSGWKRWEKEGDIATHPKAINGGNKNSNKSSSRYLEKGNYFSLRNLSLGYSIPEKLCGKLGLQQVNVSCSADNLFTLTPFSGVSPQLSDSSTDGYAGTIYPLSRRIVFGLNVSF

SEQ ID NO: 18805 - protein, 1130 aa, Bacteroides fragilis
MNEDRKKRGLANSKFFTAVAISALFLGSGNAMANQVASDHVSEVTEQLQSINVTGLVVDAAGEPVIGASVVEKGTTNGIVTDVDGKFTLSVKPGAILKISFVGYQPQEVKATPTMKIVLKEDTELLDEVVVVGYGTQKKANLTGAVTTVDLNKTMSGRPQQDVTKALQGAVPGLSITTENGDINGSAAMRIRGVGTLSNSEKSNPLIVVDGVPMDDISFLNTQDIESISVLKDAASTSIYGTRAAFGVILINTKSAKPTEKVTINYSNNFAWDQATYLPNFPDVPTQLRAALEAKANANQYEVELFGMYFDKLLPYAEKWAQQNGGRKLKYGEMRPYQSDSNVGDYNIIDGTPYYYADWDVQDIYYSKAAPSQSHNISVQGSSGKTNYYLSFGYDEKEGIMKVRPDELKKYNVSVNVTTNLYDWLQVGARVNYSRKAYQRPDIYSSTYQTLWRWGSFFIPSGTIDGYDTRLMSMRKQASDRKEITDLTRLNGFLKAEIVKGLTLNADFTYAIQNLNSGSEDFSVYGIDWSGMPTPKYIVTKSNSAIWRDNSKQNTWTLNAYANYAKTFAKSHNLNVMVGANAEEVDYTYLYGYRKGLYDEAYPELNLASQDGQQINWSHTSRASAGYFGRINYDYKGIYLLEVNGRYDGSSRFPHNDKWAFFPSASIGYRFSEEAYFAPLKKVISNAKLRASYGEIGNEAIGDYMFEALISQRENTSSTGYIYWVDGNGANANRLTQYNMPKLVSKSLTWERIRTTDIGLDLGFLNNELTVGFDWYQRENRDMLAPAQVLPNSVGATAPYDNAGTLRTRGWELNLDWHHKFGEFNVYANFNLSDSKTKVTKWNNDTKLLSSYYSGKNYGDIWGFETDRYFEESDFTGQNADGSWNYKPGIAGQSALERAPFHYGPGDIKFKDLDGSGAIDGGKGTADDHGDLKIIGNSLPRYEYGFHLGGNWKGIDLDLFFQGVGKRSDWTISSLNFPMMRAADLAIYDNQKSFNRVFYTDDWKTITGYDIDQSNTYPRLYPGNEAKGTVSGIANGSNNYYPQSRYLTDMSYLRLKNVTVGYTLPKEWTRKAFIEKARIYFSGSNLFLLYKGSDLPVDPEISTGDGLTYGGWGRTTPITRTFSFGIQVTL

SEQ ID NO: 18806 - protein, 1019 aa, Bacteroides fragilis
MRNLKAILIVLLCLCGIHVQAQQLEIKGLVTSSEDKQPLIGATVAVKGVPGRGVVTDMDGRYTLKIEPSDKILVISYIGMKSSEVKVPKNGVLNVVLQPESLNLDEVVVTGYGNFSKSSFTGSANTLRADMLKNVPVLSVEQKLQGMTTGVNITSGSGQPGANQSIRIRGMGSFNASNEPLFVIDGIPVTSGSMGAGTGADAAYMNNAKTNVMSTLNPADIENITVIKDAAAASLYGSRAANGVILITTKKGAVGRTKVTLSASGGFSNAAVNFRPTLNGEQRREMIYEGLYNSAVDKGLQSPEAYANANIDTYAGIPELGYTDWRKELIRTAHNQNYEVTASGGNERTTFYASLGFNRQEGLVENSNLDRYSARLNMTHKIGSRVEVGGNMMFTQISQEMNEERGSNINPFLCVAVSATPSMPVRDASGNYVGSYAGTNVNPLRDIRTDYNRSRMTRMFSTGYASVDIIKGLKLKETLSYDYTVQKDSRYLNPLSGAGPKSGSDAQTSKGFTEYGKLLSSTSLNYTHTFAAKHHLDILAAYELESYQSDKAMGEKAKLPSDVLLEPDNAAVLKSFVSSTQAYRMISYLSRLNYDYDNRYYIAGSYRRDGSSRLAPESRWGDFWSVSGMWHLSSEPFMEAVKPVLNDVKIRASYGVNGNQPGAFYGYMGLYSYGQNYMGAAGSYESAQANPKLKWEKNYNLNIGLSLTFIDRIFVNLEYYNRDTKDLLYNRPISSTTGFLNYLANIGQLNNKGVEFELRTINFAGPDFNWTSVLNLTHNRNKIVALDGDIKQSVEGSWFIHKIGLPYNSFYVKEFAGVDPSTGKGLYYLNTQDEKGNYNREMTDDASEAQAIPYKSADPKISGGFTNILSYKWFDLGLTFTYSLGGYSFDKTGTLIETDGSKEKSYNLPVYALDRWQKPGDRTDVPRFVLEQGAGPQNSSRYIHSTDHIRLKNLTLGFTLPGRWVQKALIENARVYFSGSNLLTWAKWKQYDPEVPVNGEVFCEAPPMRTFNFGVEITF

SEQ ID NO: 18807 - protein, 792 aa, Bacteroides fragilis
MKTKNIMIALTLLTTGTAWAEDFPKDSLKVVDIEEVVVIATPKENRKLRELPVATTLLSQKDMQANQVHSVKNLTGIVPNLFIPDYGSKLTTSIYIRGIGSRINTPSVGLYVDNIPYIDKSAFDFNYADIERIDILRGPQGTLYGRNTMGGLIKIHTKSPFTYQGTDIRMGAATYNDYNVSLTHYHRISDRFAFSTGGFYEHTGGFFENAARNNERIDKSNAGGGRFRGIYLPTPNLKVDMTLSYEYSDQGGYPYKYTGVTEGEETRPEYIGKIANNERSSYRRGLLNSGVNIEYQARTFILNAVTGYQNLNDRMFLDQDFTEKDIYTLEQKQRANTISEEIVFKSKPEKRWQWATGVSGFYQWLHTSGPVDFRQEGVKTVIESNVNKIFEGLAGPKMRMTANNSILGVGGSFDTPILNGAVFHQSTFNNLFIKGLSATIGLRLDYEKIKMEYNSISNPLNFDFSLAMGPMNITSKGLEAISSFIGKESTDYVQLLPKFALQYEWEKGNSIYATVSKGYRSGGYNIQMFSDLAQGALKNSMLDALAADPNFSLMAERILGMKDELPEVKATTQYKPEYSWNYEIGSHLTLWEGKLWADLAAFYMDTRDQQISQMAESGLGRVTINAGKSRSYGVEAALRTSLTNELSLNASYGYTYATFTDYVTKQKDSEGNLTDKSYNGKYVPFVPKHTLNIGGEYAITCNPRSIFDRVVFQANYNAAGRIYWTEQNNVSQSFYGTLNWRTNLEIGDAMISFWARNFLNKDYAAFYFETMNKGFMQQGRPMQFGIDLRCRF

SEQ ID NO: 18808 - protein, 982 aa, Bacteroides fragilis
MRKSILWFVLLTLFEIPYVLAQNGFRVTGQIISADDNQPVIGVSIIEKGTTNGVITDVDGNYSIMVTKSPTSLQFSYIGMKTVEKEFTAATRFDLKMESSAEMVDEVVVVAYGVRKKGTTTGSMSVVKDKIMEAVPTPSFDQALQGQASGLQVLSSSGEPGAVANFKIRGINSINAGTEPLFILDGVAVSSEDFSAINPSDIESVSVLKDASSTSIYGARAANGVIVITTKRGRVGDNGKIAVRAQYGVSSLAYGKWDVMNTTERLNYEEEIGLRKAGSYDRELLERTNIDWRDVVYNDAASFYSTEIQTSGATQGGFNYFISGNIFSQDGIAVGSSYDRYTFRANLEAKINNWFKVGSNATFAYEKISEAQEGEYTTSTPISASRLMLPYWNPYKEDGSWASAADGSWTGSNVNPMEWQTTNWNDTNKWKVIATAFAELRPLPGLTLRTLGGIDFLDMRSNNETSPDFVGNQGEGAIGRGFSRATNLTWTNTISYLFDIKDDHHFNVLLGQEAVDNQSDAFSVIGRGQTNSYLVNLSAATRADIPTDSRSGSTYLSFFGRAEYNYLGKYFVDLSARRDASSRFGTNSRWANFWSVGTMWNAKAESFLENVSWLDNAQLLASIGTSGNSSIPDYDHLALVAGGPIYGLEGQVLPGLAPYSKGNEDLTWEKTTILNITMKLGFLNRFNLTAEFYNKYTSDMLMAVPVSVVGGYSTRWSNMGAMVNRGVDLDLNVNVLKFKDFLWTVSANASYNKNEIKELYEGRDEYELSTTGLFLKKGHSFGEFYTNRFAGVNPANGDALWYDKNGNLTNECLDEDKVLVGKSYIAPWQGGFGTSLSWKGLTVSTQFSWVADRWMMNNDRYFNESNGTFVNYNQSKKMLYDRWKKPGDVATVPRYGIAAQLDSRFLEDASFLRWKNLMVSYTLPANLLAPLKVVENIRVYAQGQNLLTFTKFQGMDPESSMNIYAAQYPMSRQFSIGLEIGF

SEQ ID NO: 18809 - protein, 420 aa, Bacteroides fragilis
MRNKIVIGCAALAGALTSTAGFAQSSVTLYGNLDAALLYTSKTLDSATGKNAGHQFAMTDTGMTPTTFGMMGTEDLGGGLKAKFQLESGFAVTNGAFAHSNGNFFGRQAWVGLDGGFGTLKAGVQYSPFLLALFDSDPRGFSHFGSGLVNYVDNVLVTGLFNPNAVSYTSPTIAGLTGSAMFAFGGKAGDFQAGRQYSASVKYEHGGFMINAAFYDGNDGTSPTPTPSTVAFVGRTIGAAYRFGPVTAKASFRELQGRRLVQQQRVRRRPRLSGDAGRRPEQRRVVHPRSQRHGESLAARGARRDLQSVEGDRAVRAGRDGRQPRRDEHRARDHQRALCGRRHDRRRERRDPAYVLTRGRRLCGSAAAARRSRVARRFRNACCDGTPSLRAARAVCQSVCGSACRSERKPERDMSIVGIA

SEQ ID NO: 18810 - protein, 1064 aa, Bacteroides fragilis
MNKQLIFSAMLGLCAFGSTAMYSVPAMAAVAQSPAIKVSGQVVDEQGEPLLGATIRVKNSSIGTTTDLDGNFQLEVPGNAVLLISYVGYKEREVAVRSRSVLGAVQLQSDDFMLDQVVVVGYGTQKKSDLTGSVAVVDTEALKQVSHSNISSMLEGKVAGVQVTSDGQPGADPTVRIRGVGSFGDTSPLYVIDGVPMGTSIRDFSSNDIETIQVLKDASAAAIYGSRAANGVVIITTKRGQKDQPLKVDYNGYFGVDNISKGVYDVMNADQYSQHIGLSCLNSNTPLPGGYSLDSATGKYHFQDDTDTDWFDEVFKTGIRQNHNVNLSGGGAHNTYNIGLDYFNQRGTLEGAGPNYERFTARVNNTMDTKFVKFQTSVVYSHSDQDNMSLSNASEYVQGLYGDVTNVLRGTLLMQPTIKAYDSSTWVLDDKVGAASDYNYDGYGYGVYYDDIHGDISASNPLLINNLLQRNTRVDRFVGTGSADVDLLKMFGVDSKNHKLNYKINLSYSKTHCKDFTWIPSWIQSNRVYLAKSNERLEKASRDYSDALIENVLTYDGTIGKHHINIVAGQTYEEENTDLLTGWGLNYTEPYFLQLQNGSDTYSSSYEYKHAILSYIGRVNYNYDDRYLFSATVRRDASSRLSSGIRWGTFPSVSVGWRFDKESFFPFNPDVVNMFKVRGSYGELGNENIGEYMYQATMSRNNMTYSFNNSPVTGSAISTFVDNNLSWEKKKTYNVGVDLAFFNNRLEFTAEWYKNSSTDLLYDVPVPEQAGVSNTTVTMNAASMENSGFEFSATYRNREHPFKYEISANLSTLKNRVTSLGFGTDYYLTGDYITYVGQEIGQFYGYVYEGIARTQEDLDNHATQEGANVGDCLYKDINNDGKVDTDDRVVLGSGLPKMNFGLNARFEYKGFDLSIATYGALNYHVSDDIYNSLNSCYGWSNKDVAMLDANRFSEDGTTYLSDVPRTYITNSASLAWNDLFSSRKIQNAAYWKIANVELGYNFPDKWFGKYISNVRLYVSAQNLYTFTGYHGYNVDYAGGTFTPGYNFCSYPTARTFMCGVHFTF

SEQ ID NO: 18811 - protein, 770 aa, Bacteroides fragilis
MRKKAGQVALFVSGLGVMPLADGALAETSSRSTNLPPIEILEPQARQRAASRPTSTAANPRRVASRPRARQAEAAPAVFPTPGVPQTGTVGQPPVPYAGGQVGSGARLGLLGNTSIFSAPFNITSFTSKLMEDQQARSIADVVLNDPSVRNDAPPFSERDSFFIRGFSVTNLDTAYDGLFYLANPRRSFLEGIERVEILKGPSALLSGGTARVGGTINLIPKRAGDEPLTRLTTGWMSDSQIWNHIDVGRRFGDFKEWGVRFNGSYRNGDTPLDLNSVEVGVASLGLDYRSEDFRASLDLNSSVQHINAPTSLFNSAAPNIVIPPAPNGRINTASRDEYIDSRYKMIAGRAEYDILPDTTLYLAGGGSIYNEDFLTSSYRITNFNGTATNTLAIQPQELQGYTGEIGLRSKFRTGVIGHQLNISAVEANNELYRGGTLGFTPYSYVTNIYNPVRPRPGAFQTSGFAQSDDRPLLSRLTARSVAVSDTLSLFNDRLLLTLGGRWQDIALSGFVTAAGPTQGTRSSYYNEARFSPAVGAVIRATDELSIYGNYIESLDSGPTAPATARNPNTVFPPMVSKQQEVGAKYDFGFVALTASLFQIEQPSAYTDPTTRIFSVDGLQRNRGAEFNIFGEPFKGVRLLGGIALIDAKQVSTIGGRYNGNDVPGVPTTSLTLYGEYDLPAWMASGVTLTGRVIHTADVFYDQANTQTVSEWTRVDLGARYTFVGPTGKPAVLRATVENVADTAYYLSAARGYLAVGAPRTYMVSATFNF

SEQ ID NO: 18812 - protein, 113 aa, Bacteroides fragilis
MRIFVYGSLRHKQGNSHWMTNAQLLGDFSIDNYQLYSLGHYPGAVPGNGTVHGEVYRIDNATLAELDALRTRGGEYARQLIQTPYGSAWMYVYQRPVDGLKLIESGDWLDRDK

SEQ ID NO: 18813 - protein, 411 aa, Bacteroides fragilis
MKKIYRTLLVVLLSAGVFSVKAQDTKKEMDDKYVENDVVSLAGKKGFSFSTKAGDFLFKPYALVQASACYNRYDDQGLESHYAKSVANSGFAIPNAILGFTGKAFGRVTFNLSLNAAKSGGALLQQAWFDVAIKESFRIRVGKFKTPFMHGYLSTLGETLFPVLPYSASQSVLLPYDVNYVIPNMSTGFDLGVQVHGLIHDKWNYQVGIFNGTGIDVNLATKTNCDDHKWLPSLLYAGRLAFMPKGEMPTSQGSPENLNDDKMSIAVSASYNAEAEFLTSSDTRVGVEFAWIKNRWYVAAEGYYMNMHFTKIMQKPDKNFWGAYAQLGYFITPKLQGALRYDFYDRNATDEGGLLNMPAAGLNYYFFNNNLKLQVMYQYLGRSGHATQNDRDEDAIGLARHSATAMLQFTF

SEQ ID NO: 18814 - protein, 804 aa, Bacteroides fragilis
MKQIYSTLLLLVLLIFPSLLFATEPESVDRVPAIRGVVYDETDTPLASATVQIEGTTIGTTTNSEGRFILRNLARKVYKINVSFVGYATQTRTVDLTSRSVAQLSFTLLPDDNLLSTVEVFGERYKQPKKLDAITRMPLRPSEQIQSISVISEKSITEQGALTVTDVARNVPGVTLFGSYGGVRESMSIRGYRGVPILKNGVRIDSDFRTGSALSEMQGVESIQVIKGSAAVTQGIGNDLGSAGGVINVVTKTPKFTNEGEVSLRAGSWGLFRPTFDVQSVLDKNQTIAFRMNGAFERSDNYRPVIHSNRVYINPSLEWRPDDKTSVTIEMDYLNDNRTPYTSSVNLSKDTEENLYDMPHNKFLGFKNDNVNNKTLTYAARITRQLTDNISVRAAYFGSSYKVDNTSTSVKTVVNKEYNMRRRTISRSLRDDRNSTFQLDFIGRDIFTGPVKHTFQLGFDYKNTDLSITNYTPVNIDTINVLAPSISNVLPVAVKFVPETPVESNSSSYGIMAQEVMTFNKYIKAILGLRYSYISSQDGTSAGPTTGDAWNPMLGIMLTPIKNINLFGSYTTTTSLLHAARRMENGDEIGPSKTRQFEVGIKSDWLNNRLRFNLTYFDILTKNLSYSTYHPGTTQPTGYFDKAGSLKRKGIETELSGSILENLQVMMGYAYLDAKYENSPAFKNGSAPMNTPKHTANGWIQYRFDKGVLKRLSAGIGVYFVGKRPVNDFAIKPDGHGSMTNEKPFDMPGYTTINAQLAYSIHKFTARVYLNNLFDALGYNSYYRGGYINQIDPRNFSAVISYHF

SEQ ID NO: 18815 - protein, 165 aa, Silicibacter pomeroyi
MKTEGFDISLNYLTPMTSTGRFGFGIDGTYVSKLDYRDSKGEPWTGQVGLYEDPAVVRWKHTANINWAYENWKLVFEQQFVRGYDDQNQIGEEQYDHHKVSDYTLYNISGTYKGFKNLELTAGIKNIFDEDPSASNVLDNFQYGYDPRYGDPTGRTYYLRGTYKF

SEQ ID NO: 18816 - protein, 685 aa, Silicibacter pomeroyi
MTRLVTRGAAVFAAMLLLLVFGGGPGVWAGEEETPEEKTEETRSTRNRVFSLGEIEVVGKMEESRNTTVEKIYDDEMRLFDRNDLADAVNLLPGVTLSETGARNEKMVYIRGFDIKHVPIFLDGIPIYVPYDGYPDLSRFNTFDLSEVIVSKGFTSVLYGPNTMGGAINMVSRRPVKEFEMNAGSGYASGQTYHAFGNFGSNQGKWYIQTGASYINRDHFDLSDDFTPTGVQGSGERVNSYQRDWKVNLKVGLTPNESDEYAISYINQKAEKGSPPYAGTDPSEWVRFWQWPNWDKESLYFNSNTAIYDKSYVKTRIYWDRFDNALSGFDDETYTTQDKKSSFKSHYDDFTIGCSAEAGTQLLPRNFLKMAIHLKDDVHREHNEGNPRQRFEDRIISVGLEDTIDLTSKFYSIIGISYDRLETVEAEDLDSATGRMPNFPLSATDAFNPQGGLFYKVTDTGTVHAAVAAKSRLPSLKDKYSYRFGTSLPNPDLNAERSINYEIGYKEVLFKRITVEANVFYSDISDFILFKTIPDPDNPGMTINQNQNIGNIRQYGVELGISGQILSCLKGGFNYTHIQYDNEDSTDRLVNIPHNKVFAYLQYFTPLDGLSLVGSVEYNGNRYSSSDGVRVAQEYALVNTKAIYEVYKGLSIEGGIYNITDEDYAIDEGFPLEGRNYFVNLRYKF

SEQ ID NO: 18817 - protein, 925 aa, Silicibacter pomeroyi
MTFAQSGLLTGQVTDQQKLSLPGAVLNLTPGNIHTVSDTYGKFQFLNVPQGTYKLTVTYIGYNIFTTEVTMTRERVVTVNVGMEEAAIVGKEVVIMGDRLRGQAKALNIQKNKMNVSNIVSADQVGRFPDANIGDAVKRIPGITMQNDQGEARNIIIRGLAPELNSVTINGDRIPSAEGDNRRVQMDLIPSDMIQTIEVSKTLTPDMDADAIGGSVNLITRATPNGERISATISGGYAPIREKPLYNGSFVYGNRFFDNKFGMVLSGSFNHNNYGSDNVEAVWKKDDFGNTFIEEQDIRKYDIKRIRRSAAAALDYKFNEKNNISFNAMYNWRDDKENRYRFQIKDLEPVYDVNDNITGYTGAINRQTKGGINNNRVDNARLEEQKVQNYSLNGEHVFGSKLDFHWSLNYARASEYRPNERYISYEASDVTFNSDFGPSRYPFVNPVMATALNDYELDEITENTDKTQEDEFGARLDFRVPLSAFANQKGRLRFGARLRLKNKDRNNTFTEYSPLNGDLDNLSQTNQQFWGSNNWQPDQKYQPGTFASKQYLGGLQLSNTSLFEAEDVAKEYLAANYNAKETITAGYLRWDQDFSTQLSMIAGMRLENTKIKYEGNLIQDESELEGTRRIENSYLNVLPGLTFKYVPLENMVIRAAATTALARPNYYTLTPFVNTVMDDSEISAGNPDLKASYAWNYDLMGEYYFKSVGIISGGLFYKKINNFIYQFRDENLTTAKFAEQFPDLGNPVPAGESWTLTQARNGEAVKVYGFEVAMQRQLDFLPGKFLQGFGVYANYTYTKSKASGIFNEDGEMRSGIALPGTAPHMFNASLSWENKKFSARLSLNYTADYIDELGGNDFEDRFYDKQVFLDANASYVIAKSWRIFGEANNLTNQPLRYYQGVASQTMQMEYYRSKFNLGLKFDLNK

SEQ ID NO: 18818 - protein, 1300 aa, Silicibacter pomeroyi
MEISNAPGTLDSPYVWATPDDNVTGQLIFNHSAGDYEFAPAILQNVAVVHAGVGATTLVGGNTYTGGTTLDAGVLGISANANLGNPNGALVFNGGTLRTTGFITMNRATALGAGNGAFDVASGASLTQQGIVSGSGALTKTGPGSLTLSGVNTYAGGTVIEAGTLRIAQSGNLGTGPLTLNGGTLEATAPLTLYADTWIDGSGTISTTSSLTLEGSINGRAGVKISSGPTGTVILNGAHNALPTAFVTGQSTLQVNGTLEAIIDIGGASRLSGSGTVGNTSIQHGSTLSPGQSSIGTLTVNGDLTLHDGSILDYQLGGPGTSSDPASGIGSRVNVTGNLTLNGALNLRSSSDTAQDGVPGLGYYRLMTYGGTLSGTGLSIGSTPVFSDPAHFEIQAGGGNVDLFIAALGHDTLQHWQGGDGAWNSANAQWLNRNGEVAAGWAGNQAVFKNQPGGFGGGTITVAGMQQFKGLQFVDDGYRLEGSGQLVIDGSERGDGNAEIRVLANSAEISTEITGSGGITKTDAGTLVLSGNNSYQGSTHILGGAVSIASDRNLGATGAGILLSGGTLATTADMAIGRNITLAGNGGFDVAAGTTLAATGPIGGTGALVKTGTGTLRLAGANLYAGGTRVRQGVLIGDTASIRGNIANDGEVAFQQATGGVFAGDISGSGLMRKLGAGSLALAGRNAQDWAVDTGPLRSAGSRFAGDVAIGANGIFVLDDAQAAAYAGALSGTGRFHKQGAGSLLLTGDSASFTGHATVSAGTLRVGDRHGGGVLGGSLDVQAGATLGGSGTVGSGAGSQVTVASGGTLAPGNSVGTLTVNGDLVLDKGSRFEVEVDPQGTRSDQVAVTGNTTIQGGAVAHVGATGQYQLRSTYTLLTTGGALSGRFDTVSSDFAFLTPELRYDYGAGTVGLALARNDRSFASMALTDNQYATAQGIDSIGVAAGHAVYDAVAQLPDDAPLVRASLDALSGEIHASAKTALIEDSRFVRDAAKDRVRAAFAAPGASTAAVSARAADGAPTAVAATHDGPAAWSQAFGSWGSTDSDGNAARLERNVGGVLIGADRLMGNWRVGALAGYSQTDAKARDRASSGRSDNYHLGLYGGTQSGALGVRTGLAYSWHDIRTRRSVDIPGLSDSLRADYGGGTFQAFGELGYGIELNDTTRLEPFASLAYVRLHTDGYRESGGAAALTTGSANTETTFSTLGLRAEHALGSGAAQGTVRATAGWRHAMGDTTPQARHAFSAGDAFTVAGAPIAQDSAVIELGVDLAVARNTRFGLSYAGQIAGSAQDHGVRADLSIRF

SEQ ID NO: 18819 - protein, 646 aa, Silicibacter pomeroyi
HMAVSQPKVVLAGDTVVSDRQGAKIKTNVVTLREKDESTATDLRGLLQDEPAIGFGGGNGTSQFISIRGMGHNAIDLKIDNAYQDGQLHYHQGRFMLDPQMVKVVSVQKGAGFASAGIGATNGAIVTKTLDADELLRNSDKDYGFKVGAGLSTNKGHSYHGSAFGKAQTGFGQVDALVSYNQVNDSDYKGGKGYTNLLGNDVVTRSALDKSSYLVKAGLTAGDHRFVVSHLNEVHKGIRGVREEFDFANRALTLDIEKNKKKRTEAELQAELDDKYAGKGYKLGSKTPDGKKYNVVDANGKLVDNLVGNNPTQRETYQKLTNLEWTAKNLGFANEVTANVYKLEHGRNSSSDKGNSYILRDVPNTINDNGDSPSNMHVSAKGANINFDKEFNHGLLKGFGVDHTLLKYGINYRHQEAVPPRGIRPGFQHQEKTDAGIYLEAVNQINDFTINTGVRVDRFDFKAMDGKKVGKTDINPSFGVIYDVNPNLSVSGNLIYATRSPRFADAILSRGFRDGVVSIADNAKAEKARNTEIGFNYNNGPYTAFGSYFWQRVDNARATADAVQHPTVTTAKITYLGNQGHQTNHGYELGVGYTEGAWRARAGVAHSKPTMHNVKFKANPEYAVRTGRTWTADVAYRLPNPSVELG

SEQ ID NO: 18820 - protein, 343 aa, Wolbachia endosymbiont
YVGAFAASAAPAAVVYNNEGTKVELGGRLSVIAEQSTSTEYDQKNQHGTLRNQGSRFHIKATHNLGDGFYAQGYLETRFVSDYLRDGADNFSEIITKYAYVTLGNNTFGEVKLGRAKTIADSITTAEDKEYGLLSSKKYIPTSGNTIGYTFNGIDGLVLGANYLLAQERDIDSQNYGVSHTQAGEVAIGSISNGIQVGAKYDANNIIVGIAYGRTNYKESTNARQTNSKKQELNGALASLGYHFSDLGLLVSLDSGYAKTKNYQAKHEKRYFVSPGFQYELMEDTNFYGNFKYERTSVDQGKKTREQAVLFGIDHKLHKQVLTYIEGTYARTRTAPNYSKEKV

SEQ ID NO: 18821 - protein, 185 aa, Wolbachia endosymbiont
YYVRLQYNGEILPLFTKIEGIEYKKATDIHNPLKASFIAGGGAFGYKMDDIRVDVEGLYSQLNKNDVTGAAFNPDTVADSLTAISGLVNVYYDIAIEDMPITPYVGVGVGAAYISTPLKDAVNDQKSKFGFAGQVKAGVSYDVTPEVKLYAGARYFGSFGAHFDKDTAAASKDKGELKVLYSTVG

SEQ ID NO: 18822 - protein, 718 aa, Synechococcus sp.
MRLSLNLVIASTFGAVAPASANYDLDSLLEMPLCSLAETKVVSATRTSQSLADTPASVYVITAKEIKRSGARSVADALSLAPGLHVAKYSNYDWGVTVRGNNETLNNKMLVMVDGRSVFNPMSSGVDWDLIPVSMENISQIEIVLGPVGTVWGGNAVTGIINVITKEADGVAKGKVSASFGNYDYREYQLYHAGSVGKYANYSLYGEFVDHMPWTSDDARVKPFQHFNVYTERFGGRLDYQKHEHTLSVQAGGIRSREDDNWGNFQPHFIMSGAEPMRTHEAEMTMQEYFVGGHHVFDRSNGDSWENELWLTYSSNDSTHANAQFLRTDLDSHYTFSDLWGTELTVGGNIRLIDEKFGTFSTYELVTMPYLRVAEDPDFLNQSYGLYMNWNIPVMDKTKLTLGNRWQYNNLTHDIDPQPQVRLSYELANNQRIWAGWGKAIVTPSRLELSTYMRENQYMQNVMFSDNNYYDYYYSTILKGNEDLDVESVSTYELGYRFWDEHRLQFSIGGFYTRHENIRVYKTESASQIIIGEGSSPGRVGTVVEQYTSQLVDPIWSESFGGEIAVKWQPRDDLQINANYSYKRIVGHCEGAICSSNDAVKRMIENEPNHFVNAQVMWDITPQWWVSVSGQYVSESELHEDYESALHPVSVANKDYSWPEVVSFDASLSWQYNDCMPEITASVENLGANQSKEFPNNYNSFANGTQYWLTLDWNYAGW

SEQ ID NO: 18823 - protein, 488 aa, Synechococcus sp.
MKFASFQGDSVRARMRPAACAAILACASFSSGAAFADVPVDAQPEAPEADLAIQAKPTNMWTGIWTRQNLLGDMGGIRPWLGKYGATLQITETSEYLANLRGGLNRGGAYDGLTTATLTVDTQKAIGLPGGTFNVSALQIHGTNLSTRNLGTLNTASGIEAQGTTRLWELWYQQSFLDKRVDVKIGQQSLDQEFMVSTYANTFVNTMFGWPALPSYDLPNGGPAYPLAGLGVRVRAQITPKLTALAGVFDGDPLGNNPSNLSGTNFNLHNGALYIGELQYALNQPSDGEMDTGRSNGLPGTYKIGVWYHNGRFADQNVGTDGLSLSDPASNGNAQQRHGNYSFYAVADQMIWRPDPTGPRSLGVFARVMGAPGDRNLVSLSANAGIVLKAPFEGRDNDSVGLGVTYIQVGNHVTDLDQTAQSFATGPYGVRTRETTLEATYQYQVNPWWIVQADAQYTFNAGAGQNPSDATQPLRNTFVIGARTTITF

SEQ ID NO: 18824 - protein, 1150 aa, Synechococcus sp.
MSMHTTRIKWLALLMAMLIATSAALLAQDASGGITGKVSDPSGAAVVNADVTTRDVDRGTVWTSKTNEGGVYNFARLPVGRYEVKVQAPGFQTALRTAFALELNQTARVDLALSLGQISQQVEVSDAVPVLQTQTTEVSTVMQSSAIANLPLETRNYNQLTLLVPGAVTISPASFNTGQKTFNAARPNLNGNREQANYYLLDGMENIEFVDNNVAYSPNVDAIQEFSVITNNPNAEFGQFLGGVINVSMKSGTNQFHGNLFEYLRNDFFNANEWSNNFNGLPTARQRWNEYGGTVGGPIRKNKLFFFADYQGSRFDLPATSTPKTTFTSRNLSGDLSDLGVALHYPGTSVTMPANLTQAAVCTAGQKMGVNPCINGVSATALKIAAALPKPSLPGLAGGTVNNLNNVVQNYTHGNQGDIKMDWAPSEKDHIFARYSQQHIDNPIVNSEVFQYSGNGSNVFPLQQAVLDYTRTIRPTLLNDFRLGMNYFPAEANVQALSTNAGANLIPGQPTPYLPGLSFASSKLGGQLNGPFAFGTTDGPEIFHQTAIQFSDTAIWTRNAHTLRMGLQMIRYRNNYVPATSSDGAAGQIGFNGTYTGYSEADFFLGLPSYMGYGLGFAGTVGQRNWAAGAFVQDDWRISQHVTINFGVRWQLFTPIYEVHDRMTNFGMYSGQIMLAGQNGNSRALYNQYNGIANFLPRLGVAWSLDNKTVVRAAFSRSSFQEGTGEFNRLATNAPWNVDLVGQWGGVGSNGGIPSNQVTLDQGFGALGATTGCTLQNVTSAPASCFAGVRLHATDPNYRPAVSNQWNLTLQRQVTNTLTVQAGYVGQHTDHLAAIYNMGQNLLNADGTASPGPYLGGNLALKNGGTGQQRLNTSTAIQNYNALQLTAQEQLTHGLVFRFNYAWSKCLTNNQGYYGRYGNAAPAQTTADVAFQSYVYNVHLDYGLCDADVTHAFNGYVNYDLPFGRGRAFGKNASKAVNAVLGNWRYDTIVTVHGGLPISMIQFGNDPTGAYFQPRPDCLAPSEATPYKNFVGGGYVWFNPLTMAIPGPGKLGNCPISSERGPGLRQIDMSLSKRFTISESKFVEFRFDAINAFNTPIFALSGYATDVFPGGGIDKSKYGVDPTYTAGIPTGVVNTSQGARNLQFALKFHF

SEQ ID NO: 18825 - protein, 518 aa, Synechococcus sp.
MNFFVKAGLVVTGANLLAIAPGQALSLDQLQKIDAVTPDGITSGQITSVNELSDVKPTDWAYQALQSLVERYGCIVGYPDRTFRGARPLSRYEFAAGLNACLDKVIEFAASKEDLDTLKRLTEEFQAELATLRGRVDALEARTKELEATRFSSTTKLRGEVIFGLDALANSNGNEVNSNGAVSFGNKVDLDLDTSFTGKDLLKTRLRARNIEPITNRLAPGFRAPGSVLDYGGNSNNTFFIDKLYYTFPAGSVRFTVGTVGVGVQEYGMRDATFSSGANEGKTFRKGPANIYESNGKAGVGFDWRINPNFSFQLGYLNRGADQVGVDQGGFFGQGTVGTAKSGWDVATQLRFETDNRKFRAALAYSLRNDRYVTDLGTTRAERPFGAANYNTNNLALTMGWAVSDNFTISGAYGIGFANVAGGSDSATIQTWNVGLTFPDLFAKGNSGVITVGQMPYVTSASQQSAEDTGSLGLEVNYKFQVTDNISITPGIYLFNNTNGLENGGTSYVPYLRTIFRF

SEQ ID NO: 18826 - protein, 1027 aa, Zymomonas mobilis
MKNFILILCLATFSQWVYAQNKQITGRVVDTKGEAAIGASILEKGTTNGTITDFDGNFKLTVGPKAVLQISYIGYKTQEIPVANKTKLNITMEEDTEVLDEVVVVGYGAQKKESVVGAISQVSSKELLKSPAANISQAIAGKISGVITSQTSGAPGADDMKIYIRGRASFAGDNQPLILVDGVEREFSQIAPDDIESISTLKDASATAVYGVRGANGVMLITTKRGKEQKPTVSLTANWQIQSPTRQDTYLDSYNSVVLLEEALANDGLPSQYSASDIEMYKRASAGQLSGIDALLYPNVDWYDTVLRNSAPAQRYNVNIQGGTKRMRYFTSAEYYNQQGLFKEFSQDEYGNKSNSSFKRFAFRANLDFLMTKDLTLSVNFGTRFEERRGPNSNESRDGTYSQAFYEMNHTPGWLFPVSYTVGEGEDQKTLYSGSSQYQNNIVARFAKAGFYRSTNTINETNFIVDYKMNWLTKGLAAKGMLSFDYDAYYRRAFNADFATYELNDRTNYNSIDAYTQFNTDTELAYLGNDQTTTYKLYMEFQLNWARKFGKHDITAMALYNQNDYRYQADLAERYQGLVGRATYGYDDRYLAEVNFGYNGSENFMRGRRFGFFPSFSVGWRISNEAFMKGTEEWLNNLKIRASYGEVGNDVYKVNGVKQRFLYQAVWTQIANDYHFGTTGYTGIYESQYPNYAVTWERAHKYNLGLEFGLWNGLLNGNIDVFYEKRNDILTPYLTRPQWVGVNMAAGNLGETNNKGFEIELKHANHIGKDFTYNASLTFSHARNEIRNMDEPATKTAYRKQEGHPINQYFGLVCDGFVTQADLNNPDFPVSTFGNVQVGDLKYRDMNGDGFIDSRDETFIGYSDVPENTYALSLGCEYKGIGFSIMFQGVDHVSRYYDAEAMYAFVNGGKVKEHHLNRWNPNQSEAYNLTHASYPLLHYDSYGDHNQRKNSFFLKNGNFLRLKNIELSYSLPARWIRKVAMNECRVYVNANNLITWDKLDGLCDPESEGSNRYPIMKTVNFGVNIKF

SEQ ID NO: 18827 - protein, 882 aa, Zymomonas mobilis
MRNPINLQRRQLATAVGAALMPMLAATTAQAQLEEVVVTATKQEASLQDVAVAVSALTEESLNQRGITNFSDYLIELPNVTAGGAGPGQSTMYIRGVASTTPNLTTSGVAGLSPNVAMYLDEQPLSQPGRNLDVYIVDMNRVEVLAGPQGTLFGASSQAGVVRLITNKPDTTEFSGNIKAGTSWMKDGEMNYNVNGTINVPITDNFAIRASIYADQKGGYIDNVAGTRSVSESARFRPGSTKRSNGTEVGFRGGFQAGADLSNVNFIDADNSALVEDDFNDTRYTGGRISALWNVNDDWSVRVGAMVQEIDSDGTFYADPNLGDDYKIQRFEAENIKDEYTSLNWTVEGRLGALDVIYTGAFTERETDQRVDYSDYLFIGQYIPYYICDYYVSYTSFAPGGVPTGNCYSPNLYTTNKVDSEFQTHELRFSTDQSARVRVTAGAFYSDMELTEQVDFSYPSNQLVDAWGAGSGNGFGFAPNSNYPYDGQGGYRPGEGPYPADTIFRNDILRTDEQMGFFGEVSYDLSDSLTVTGGLRYYDYEVDLAGSANSSFYNMSGSDYNKFGTNINDLYDGDQSIRWTYSGFFPYEASPVYTPNNLPDPSDPNYQRIVNSIYAPDVAEDDGVIGKVTLAWAPNDDSMYYVTWSEGFRTGVLNRPGGAVQKDTGYTVPFDVASDELTNLEVGWKLDMMDGTLRFNGALFLVDITDLQTTIFDTSIVNLFFSDNAADADVKGVEGDITWLASDNLTIGGAFSLLDTEVTSNNTTSTDVIVGSELAYAPNYQGNLWARYEWNIGDGWVGHFMPSVAFSDSSYSDIISINSMEIPSWTKVNLTAGITADRWMVEAFVDNLTDEQVITGANYVNDRERLALAPPTTAGIRVSMDF

SEQ ID NO: 18828 - protein, 671 aa, Zymomonas mobilis
MTERTQYWGRRRALRASSALLTLVLILPAGARAADDATTLPEVVVTAPAMEQPMVIETDTDNPRTPIPPADGAGYLKNIPGFSVARQGAIDGDPVLRGIGGSRLNILLDETPVLGGCPNRMDPPTAYIFPGSFDKLTVLKGPQSVVHGGSAMGTILVERTPPKFDKTEIRGTANALYGSNDRNDEVIEAVAGAKEGYLRAIGTHSSSDDYKDGNGNALHSRYWRHSGTAMVGWTPDTDTLLQFSFDKSQAQAAMPGKMMDGTQFDREGVNLEFTKTNISPLLAKLKFLAYHNYVDHVMDTYSMRYTTTTMMTAASQVDHLMQGGKALVELTPDTQTLVSLGVDYNRDEHTARSQSAAEYRNGVGLDSKMRVKDIGFDTYSGFGEVSRELSAVDRVIGGYRLTHVQATRHNVQPNLTDDRTLHSGFVRYERNVDVGLPLTTFASLGHVERAPDYWERNKVTASDRTFKLATEKTEQLDIGALFKRGNWRSSASLFYAYTDDFILVASADAKSIEARRWGGEGDIAYKFLPSWSVEANAAYVHGNNLTDGTALAQTPPLDTSLAVKYDDGEFMGAFHMRAVAGQHRTQAGWGSIIGQDIGETGGFAVFSLNGGWRVNDAVTFTGGVDNIFDKTYAEHISKTGAWSGADLAAYNDTVRVNEPGRTFWMRGSVKF

SEQ ID NO: 18829 - protein, 300 aa, Zymomonas mobilis
MSFQNVRRLHFASPAIRTKPMRSVKSLLAAGAASLISSMAFAADMPIAAPPPMYAPPAPPADFGGWYLRGDIGMTNQRAKSIEATVAPGFTKTTEGLGFDSSPLFDLGVGYRFNNWFRADVIGQYRGKANLHGADNVIGPGFVGSDNYSGSKSEWVVMANAYVDLGTWWCITPFIGAGVGGSYNKISGFRDDGIAYLAALTPTPSASVAYFADSGKWNFAWAAHAGLAYKVNPGFTVELAYSYMNLGDAAPGNFRLFDNSASGPTSIKLKELTSHDLKLGVRWDLNSPPAYVPPPLVTKG

SEQ ID NO: 18830 - protein, 241 aa, Zymomonas mobilis
MTRVTMHYKKFFSATALVTLLSLSNAAFSNPVGPIADEETSCYIRLQYNSEFLPFKTEIDGVTGAKKKNADTNVTTDLYKASFMAGGSAFGYKMDDIRVDIEGLYSQLSRDTFETAPAPAIADNLNALSGLVNVYYDVVIEDMPVIPYVGIGVGAAYLSNPLAIKVTGDKEYGFGFAYQAKAGVSYDVTPEVKLFAGARYFGSYGAKFDKPVVESGQQPTKDGIKVLYSTVGAEAGLMFNF

SEQ ID NO: 18831 - protein, 724 aa, Zymomonas mobilis
MTGFKSVGSLQRVRGWLALGLLAPFSLSAVAETVAAQAAEDNSLDLPALTIEGNRLYDMLPSEETGGYSVDAATVGTKTPAALKDIPQSITVYTQDYVKDRQFVHLDDLAKYTAGLRTLTNDSGRSSIYARGYEYSEFNIDGLPAPMASIFGTVPSLAAFDRVEIMRGPAGLFSSTSELGGIVNMVRKRPTAEFQGHIEGSYGTWDTNHEEIDLSGPLDEAGRVRGRFIASRDDTNGEVDYNANTSNTYYGALDIDLDDATTLSFGLMHEVKNITPHNGYPATLSGEVPDFSHSRFLGADWNYFDGKTTDLVAELTHRFDNGGYGRVAARGSHRDTNYLYAFTATNATTGANSERASARDFTQDTYSLDASYSQPFETFGQVSEFVVGSDYKNYDTEYLNGTTNLGAINVNTYSPKQFAKPSPNYSTETGMQEEEYGLYSKVTFRPVERLALIAGGRFSWYRGDFYTTTLSSGATTNDSKRVDGHFTPYGGLVYDLTDNHALYASYSQVFKPQSDTDSNGRVLKPREGEQYEFGLKSSYFGGDLNTRFSVFRLTDKNRATTVYDADGVATTDSVASGKTRVKGAEVEVSGKLTPNWELLAGYTWMETETVKGDAETTFFIMPRNQASLWSKYTISQGPLTGLAVGGGISAMSNFHSESGGVRIDAPGYATVDAMLSYPVTSKLTATLNVNNLFDRDYLSRVGSTSTFNFYGPSRSMMVGARYDF

SEQ ID NO: 18832 - protein, 371 aa, Zymomonas mobilis
  misc_feature (364)..(364): Xaa can be any naturally occurring amino acid
MGEIGHSGVKGFVSYSHARTDNWRGAGYDEKQHVDFKFLKEWGQDSHVSLLGTWNKGITSYYPQVDKQSWKENGISGSNNLASRYNVNNDAAGSDYWRLYRAPEEIFHLAAPIDVRLASNLKLKVTPYGQWDRGNVPAGSTLNNSGLWNGTEAIAGTINLPNATDGTATVRSNYTQRSARAGVNASATWSLKNHDLTFGYWFDYSADKEQNSFTPVDSNGYASNIWADRHSTLIKMPDGSPLLGTNNRTHTYVNAVYLGDHMTFLQYRLTFDIGFKEVIMTRHGYNYLPGSQHKANFSTSEPLPRLGLRYQIDSKSHVFFSASTNFRTADETALYNSYDPTSGDIIVNGNKNLKNEYSVSEELXIAIPMLW

SEQ ID NO: 18833 - protein, 1101 aa, Zymomonas mobilis
MRLCISVFSLLLLCLFPLDAQQEYAESYIHISASVSLAEALDEIESQTNYSFIYDARVINLSEKLRSPLSGRTVFEILNLLFKDRTIVYTVMNDQIILSKKETIIQIQQKLDGKIKGIVTDHEGEPIACVNVVEKGTKNGTITDVDGRFVLELPKETTLVFSYIGYRSREIEYEGQLFLNVQLEDDTRILDEVVVTALGIEKKGSSLPYVTQLISGEELVRTKDFNFMSTLSGKMAGLQINRTSAGLASSSRVIIRGSRSVSGNNQPLYVMDGVPILCVSSEQTSTAIGGAADAGNRDAGDNISNLNPDDIESLSVLKGASASALYGGQAANGVILIKTKKGKAGVRNIHFSSSLTVDQAISLPKFQNEFGRLEGAETCWGDRASLPVYDPVGDFFRTGITAINSLIFTAGNSHVQNYFSYANTTARGIVPKNNLSKHNFNLRESSSFFDDRLILEGQANLILQTIKGKPTVGGFYMNPLQGLYTFPRGMDMAPYKENFEVYNEKRNMNVQNWYTTITDFEQNPYWLVNRTENEDKRARVLALASASFKVTDWLTLQGRGNIDYVNDKYQQEIYASTSPGIAGENGRYIYYTCQTTLLYGDLMAKLNKSWDDFSLNAAIGTSITDTRTSALRLDSKTASLYYPNVFTIANINMSSSAYIEELDDARRQMQSFFAMAQLGYKESLYLDVTARNDWSSTLAFTERKSRGFFYPSVGLSWIIPKSFSMPSLISFGKVRASWSKVGNDIPLFVSNTVGHIAAGGIPQPNDTAPFGTLKPEMSSSFEIGTEWKFFDYRMDVDLTFYKTNTKEQLFSLPSSAGAAYKYYFVNAGNIQNMGVELTLGAVPILTNQFKWNTTLNFSRNKNEVKKLHDDLASFIQGNEGFSSSYAMRLVEGGSFGDIYGKAFERDKYGAIVYGRDGLPQEIGSGNTVKVGNCNPAFLLGWGNSFTYKDFSYYFLIDGHFGGEVLAQTQAVLDQIGVSKVSGEARTMGYVDLEGHHIYNIKGFYEQVGGRNGVTEYYMYNATNIRLRELSLGYTLPKRLLGRKQFVKKAELSFVARNLFFIYKKAPFDPDAILSVSNSNQGIDIFGIPTTRSVGFNVKLSF

SEQ ID NO: 18834 - protein, 553 aa, Zymomonas mobilis
MTKRFWNLFKVSPVIVAATFFVANSALAAEVNEQVTNAAQLSEAQDSNDMSQVTSVSQFSDVQPTDWAFQALQSLVERYGCIAGYPNSTYRGNRALTRYEFAAGLNACLDRVNELIATATADLVSKQDLATLQRLQEEYSAELATLRGRVDGLEARTSELEANQFSTTTKLVGEAIFAVSDVFGDTRAARGGNPTQDLNSNTTFSDRVRLKLYSSFTGTDQLETRLNAGNIVSNRGNDALGTGTGTNMSRLGFDGDTGNSVSIDKLNYAFNLTDAVRVKVDAIGAELYENVNNFNSDFASSGRGALSRYGRFSPIYRQGQGGSGVTVTFNPKGAISLSGAYLARTANDPTLNNGLLDGDNAIFGQLSFQPTKAFNIGLTYARTYQTNLVNNTVNNNLFQGTGSIFANNPFGNNTRTISNNYGVEATFQFSPTLAISGWGGYTTADAITGANAGTDADVWYWAGALALKDFGGEGNVLGIIFGQPPKVTGGSIKNVAGNTTFDDNTSYHLEGLYKYKVSDNIQVTPGLLVIFNPEHNDANDTEYVATLRTTFSF

SEQ ID NO: 18835 - protein, 248 aa, Zymomonas mobilis
MKRVFLGAVSLMVLGALAPAGAADLAARPYTKAPMAAPAPLPTWTGFYIGLQGGGGWGRSDETFFNAPNGFGFAGTQRYDINGGFAGGVIGYNWQVDNIVFGLEGDYHWADINGRSGVITAGLGDSYFTKLRGFGDIKGRLGWAAGPALFFVSGGAAVGDLQHRYDNPAFSTIQNDWRWGWTIGAGAEYMFAPNWSAKVEYNYLDFGKSTLQYNNPLVASNRSEWSDTVHTVKAGISYHFGGPGVSRY

SEQ ID NO: 18836 - protein, 268 aa, Zymomonas mobilis
MKAFWRNAALLAVSLLPFSSANAVALQAKQYGDFDRYVLALSWQTGFCQSQHDRNRNERDECRLQTETTNKADFLTVHGLWPGLPKSVAARGVDERRWMRFGCATRPIPNLPEARASRMCSSPETGLSLETAAKLSEVMPGAGGRSCLERYEYAKHGACFGFDPDAYFGTMVRLNQEIKESEAGKFLADNYGKTVSRRDFDAAFAKSWGKENVKAVKLTCQGNPAYLTEIQVSIKADAINAPLSANSFLPQPHPGNCGKTFVIDKAGY

SEQ ID NO: 18837 - protein, 663 aa, Zymomonas mobilis
MLNGIYSMRLKKRYLCTVLTLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 18838 - protein, 789 aa, Zymomonas mobilis
MKNFIKKGGFLFSFSWFFLQYPVEAATDTVSNTSNNDAIIVTGTRETHKKIRDSLSPIEVLNNRELLETGQTNVTSALAQLVPSITQPAVGQFVAAPTNFVSLRGLNPNQTLVLVNGKRRHNSSFLYIDGFADAATPTDLDLIAPELIDHIEVLKDGAAAQYGSDAIAGVVNIILKSDNHGGSARSQIGQTYAGDGLVGQAGFNKGFKIGHSGFFDVAFDFRHQNHTSRDGIDSRTQRHSLKVVGDPMATRYNLAINAGYDFGNGIEIYTTDSYSHRNSEVNQVYRTADRFPEVYPDGFMPIQKLSENDFSASLGLRGDNALGIHWDVNSTYGGNFIRNDLDKTANLGLYAATGSTPLSVHLNNYSTTQLNNTLDLSKELALPVIYSPLTLAAGFAHRYETYKTGAGDPASYLYGGTQARTGIIPAVAGSHSRNVYSGYLDLSAHLTKRWQVDLAGRYEYYSDFGSTLNGKASTRYDFTDQFALRATFSSGTRAPSLANEYFSTLSVGPDSASGTLGANSAAAKLLGAVPLKPEKATNITAGLVYSPLKNLHFTLDSYQIAIRNRIVSGPGISGEAALAALNAQGVTVASTLEAQNISAWFFTNGASTRTRGLDFTASYHSRFENFGIVDWDIALNINATTIRHVNQLANGMSALNAQTRAYLTSSTPKNRITFGGRWESFSKKWDVSLHEQRFGQTTDEMTWYQGPNAYSMTDFNRIHNHPRWITNLEIGYRPIEKLRVAIGANNLFNAHTTRIPAANGYYGSGKYDGAASQIGVNGGFYYLQTSYQF

SEQ ID NO: 18839 - protein, 1021 aa, Zymomonas mobilis
MRRKIYFLLFFFLCLTSIPLAAQDIEIKGMVTEATTNEPLPGVTVRVKGKDTGTVTDMDGKYSIKANKGNILIFSTIGMKQIEKAVTSGTPINVSMEEDNIALEQVVVIGYGTVKKSHLSGAVGSVSAKELNGQVASNAATALQGKIPGVSVASSSGDPNGSMTINVRGISSLSNNNPLYVVDGAFGDISMVDPNDISSIEVLKDAAAAAIYGSRAAGGVVLITTKSGRKDMPTKLDVNFFTGVSQTPKTLKVFNGEEYSRFARYYKLAGDGYGAENGATPFIGEGTDWQDVMLRTAMTYKANATISGGSKNGSYSSSVSYLNKEGILRNTDHESYNIRLKSDYSFFDNRLTIGESMIVNLTKGSGYIHQDTMFDIFQFPSVVPVYDPTNAGGWGTSNDINLPNPLAEMTVNDERTETTKIFLNAYLQAEIIKGLKYKLNVGIRKEHTKWRYYKDVYDLGTFGKNDKPDLEEKSSTWESWVLENTLNYDRTFGKHNLSLLAGYSAQKDKSYSLYGKNGDMPQFIETMPGNVDPSNLKASSSLNELALVSLFGRVMYSFDDRYLFSASIRRDGSSRFRSGHQYGAFPSASIGWNINREKFFKPLENVFDQLKLRFSYGKLGNQEMTSYYPTQSVVSDGMNYVMNNSPWFGSMPYVQAISPANLTWENTETYNIGLDVSLLNGRLTLTADAYVKNTNDVLLPIPSTASTGISGNSIQNAGQVRNKGFELAVNYRGAIKEKFNYYIGANIAADKNEVTKITLGGQNLMISGYSAHGAGGRGINMFAEGHPMSYFNLIETDGLFRSAEEIANYKNKDGELIQPAAQVGDVRYKDWNGDGKINTDDQHDVGSPFPDFTFGIRLGGEWNNFDFNLFFDGMVGNKIYNYPRYRLESGNFNGNMSTVLANSWRPDNQNTDIPRFSKTDGADNKWAYTDRWLEDGSYIRLKTLDIGYTLPKVLTKKIKLENVRIYTSMENLFTLTKYSGYTPDLGESSVAGVAYNVFSRGIDQGRYPLPRTISFGIQVNL

SEQ ID NO: 18840 - protein, 737 aa, Zymomonas mobilis
MKNRYEAWSLSLVLLATTAQIASAVPVNPSSNVQPDTWAYTALRSLVDYSGCVTGNPAFMGNQALTRQEFAAVLNDCRLSIEQQLNSNPNDLRIQQNRAGLERLLRDFAPELASLVPAGELETNPLVTPPSPTTPTNPQQTLQETRNVNSVVVETLPPEFSSGGDQGSEQINSPAIAPESVPLVVPPSPTSPTVSQALPQETRNVNSVVVETLSPEFSSGGDQGSEQMNSPAIATESLDIVNSDNDTMAQVTNVSQLRDVKPSDWAYEALRSLIERYGCITGYPDATFRGNQSLSRYEFAAGLNACLQQLEQQSNPNLTNMASQDDLVMLQRLQAEFATELADLRNRIDSLDGRTTQLEAQQFTGSGSYFPVVKFGGEVIIAPSIGFGGDPPGTGDANTSFNHLTRLQLVSTFSGFDRLRMELSTGNFTGFGFGNPNILNTNTALLSFQENTDNDIQLSMLEYRFAAFNNRTVFTVRPVGFSLNSVLTANSPFFDAGRGAISRFGEANPIFKIGNLDAGVGMDWLIGNNARLQLAYGANNGNNPDDGFLLGEDAHTAGLQFLLLPDDNLLTGLTFVYGYSPDGRLNTFTGSAIADASGFINQRSNIYAVSGTLQWRLAPQVTFSTWGGIVGTYAAKTDAFAVSTNYMFGLGLADLFQEGSLLGVMFGQPPKLVDLENFSVSSGLRENAESFHIEAFYRFKVNDNIFITPGVFLVTNPGNFADNNDIVIGTLRTTFRF

SEQ ID NO: 18841 - protein, 257 aa, Zymomonas mobilis
MARKWLNLFAGAALSFAVAGNALADEGKITVFAAASLTNAMQDIATQFKKEKGVDVVSSFASSSTLARQIEAGAPADLFISADQKWMDYAVDKKAIDTATRQTLLGNSLVVVAPKASVQKDFTIDSKTNWTSLLNGGRLAVGDPEHVPAGIYAKEALQKLGAWDTLSPKLAPAEDVRGALALVERNEAPLGIVYGSDAVASKGVKVVATFPEDSHKKVEYPVAVVEGHNNATVKAFYDYLKGPQAAEIFKRYGFTIK

SEQ ID NO: 18842 - protein, 728 aa, Zymomonas mobilis
MGMRVNKILWLITVVFSGVNSPLSAAEYSEGNGETMVVESTAEQVLKQQPGVSIITRDDIQKNPPVNDLSDIIRKMPGVNLTGNSASGTRGNNRQIDIRGMGPENTLVLIDGVPVTSRNSVRYSWRGERDTRGDTNWVPPELVERIEVIRGPAAARYGSGAAGGVVNIITKRPTNDWHGSLSLYTNQPENSKEGDTRRGNFSLSGPLAGDALTMRLYGNLNRTDADSWDINSSAGTKNAAGREGVTNKDINSVFSWKMTSQQILDFEAGYSRQGNIYAGDTQNSTSNAVTKSLAQSGRETNRLYRQNYGITHHGIWDWGQSRLGFYYEKTNNTRMNEGLSGGGEGRITNDQTFTTNRLTSYRTSGEVNVPVIWLFEQTLTVGAEWNRDALEDPSSTGLTVNDNNIAGISGSAAHRSSKNKSQISALYVEDNIEPMAGTNIIPGLRFDYLSESGSNFSPSLNLSQELGEYVKMKAGIARAFKAPNLYQTSEGYLLYSKGNGCPKDLPSGRAGCYLVGNKNLDPEISINKEIGLEFTVEDYHASVTYFRNDYQNKIVAGDKIIGKSSSGAYVLQWQNGGKALVEGIEASMVVPLMPDRLNWNTNATYMITSEQKDTGNPLSIIPKYTVNTSLDWTITSALSAGVNWTLYGKQKPRTHAESRSEETKGLSGKALGAYSLVGTNVNYDINKNLRLNVGISNIFDKQIYRSAEGANTYNEPGRAYYAGVTASF

SEQ ID NO: 18843 - protein, 907 aa, Zymomonas mobilis
MKNMTFRKSLTAAAVAASLGFPALAIAQDAQTDVNAEEEVERIQVTGSRLNRTDMEGALPVTVIDRVELEASGDISVADYMRDTNFNSFGSYQSTSGSSGGGAAQVSLRGLGAGRTLILIDGRRAPTSPILGSGQDLNSIPMAAVERIEVLSDGASAVYGSDAIGGVVNVITRKDFEGVSVTYGVGRPTNDGGDTEEMSIVIGSSNAKSRVLLGASMNKRDVIFTRDRDYWYDPENPPGSNYSNNFGIKDPVTGHAPSVGANNRLEHPEFGTAVPGLCTNGDDSDLFFMKPNDNCGFNHAASSANLTSVKNTSLFGRGDYQINNDWNVYFSGSLNKVESFGRFAPLPSSPWPGGAIEITPDSPNHPGNLDGYNSNAADPYYQSIADETLSLYHRFAALGPRDNNVENTTTSFDGGFKGMIGNVGLDFGARYVTSRAINLGNNYVVAGLAQPLIADGTYNIYDPFTVYDPDTGNAVEGDPSALGMTTTTSRDMFSTVKELYANTNFDMFEMAAGVSSAAFGIEYREEKYQDKYDLLSAAGQVSGSSGASAGGERDVTALYGEMLFPVLDSVDIEVAGRYDDYSDYGSDFSPKVAVRWRPTDSVLVRGSWGEGFRAPTLSDLTSEPAFSAAYTNDEATCIAQNGAPCTGDSSVQVNTYSLGNVNLESENSEQLGLGIVWEANDWLNMSVDYYDIEITNSISSIGLQQAANCLRGEGTLCPSGISQFQQGTTIPDPSLGVGVAFAGNDVDNAIVGAQLGMVNIGSVETDGFDFTTRTNFDLGFGTLTNNFQASYVNNYSANGGENDAGKYGAPELRASLNNALAVGDFSVNWNIQYTDGTTYIDTYNIPSWTVHNVQVNYATPWDATVSFGVNNLTDRAPADASLFGTSYDSEIYNPWGRVPYLRYTQNF

SEQ ID NO: 18844 - protein, 889 aa, Zymomonas mobilis
MLLSRLFASSPCVPVSAFVNPLRRSSLSAAVRRLLMGGASLACVASLPAFAQEQPAPAQQQTPPQTSPSVSTLDEIKVVGYQASLGKALNVKRNADAIVDAISAEDIGKFPDTNVAESLSRLSGITVDRQFGEGEKVSILGTDPALNRVLLNGQTIASTSWGGDPNDPDSRSFNYSTLAPEVVGLMEVYKTPEARIDEGSIGGTVIVHTRKPLDLDRNTLTGTVSYGYNDRSDEGKPNASALYSWKNQDQTLGVLASVMHSQRVLRRDGVEIFGYDNVQGAGFPPGVVGNNTGVFPTSINTALFQQTRKRDGVSAALQWKPDSDFELNLTGLYVKESFDNYNQSRYGYWGSTPGDAQALGFENGIATSGTFGDQSNTYLDGYLRNSQVSTGSIHLRTDWHGDGWNASSQVGYTSSQGGAERIYGIQFRNLAGYSYAIDGRRTAMDYSIDPTNAAAMQLNNASASHSPQYDKERYLQLDFDHAVEWGPFTQILTGIKLTNHATGQSSYSRTWTPNDGSTLAAFSPGTTPSGYLDGLSTSTDMQRWSTINSGAIGRYIGGLEGNDGLPISYAGNYSIQEQNRAWFLQGNFSGERYRGNIGVRYVHSRDSTDGYSYAPGGGYTPVNFLSSYGKWLPSFNIAYDLRDDLMLRFAASKVIARPRYTNMTPYVATDDTTLTASTGNPGLSPYESTNLGASLEWYFSDSSLLSGEFFSRDISNYILTTVQDRVFFNNATGGSSTYQTSVPTNAGDATVRGVALNLQHNFGNGFGVVANYTYSDSNTDGDYSLPYNSRNAYNISPYYEQGKWSARVNLGWRSEYFTQIGRLNGQQMTDAFTQVDASFGYQATERLRVALEATNLLDETYFSYIGNKNQPYYIYKNGRSFMLSLNFKL

SEQ ID NO: 18845 - protein, 811 aa, Zymomonas mobilis
MMKTLKIYFLLMLLIQTISISAQSVISGKITNNDSSPIVGATILLSNGMDSTYITGTTSDLDGRFKMINVKSGNYFLSLSMIGYKKANIPLQIKESMNLELGDITLEEDSYILSTVNIIGKRPPIKAEPGKMTVNLSSALLSTDGNILDALRKLPGVIVQNDGTIILNGKSGANVLMDDKVTYLSGENLINYLRSIPASSIENIELISQPSSKHDASGSSGIINIQKKKIKEQGISLTASSGLEQGKHTKGNENLTLNFHHNKLNMYADYSYYWGKDFIELSVSGHYLDPMTLKPLELRKDFDSDINRQYKGHYIKTGVDYDLSEKIAIGTYFSSSWLNRNKQEVTVSDFFNNDKTQSDSTLTALSTPDYSYTNIIGGANMIYKFAKTGKWDASFDYQLFNQEDNHLLKSFFQTGIHPVKGDTLSGITNGDIKIYSGQTNLSYDISDKFGITTGLKSVFVHISSDALYKNLIAGDWREDSDLSSSFAYHENIYAGYLQLNAKWSARFSTEIGLRLESTYTKSNYNSAVQDSVFNQSYVHLFPTLMVQYQLSENHNLSMAYSRRIVRPNYRNMNPFVEVRDQFLYEQGNTELRPELIDNIEISWLLKKRYSFNVFYSHRSDPISLSFLVEDNNRVLLMPQNLSGNNSFGVRAGLNNLKPFQWWTSHINGSLTYKKFSWATLGKTLKNEVTTPMLHISNQFTLPYGWDAEALGFYSGEMIEGQTRVKPLWTISLGVRKNLCNNKFSLYIYAHDIFHSNRPHVSMETNYLYYASQEKNDSRMIGISLSYRFNRGKEIKKSQNENRIEESKRIGL

SEQ ID NO: 18846 - protein, 270 aa, Zymomonas mobilis
MIITQADLREWRIGAVMYRWFLRHFPRGGSYADIHHALIEEGYTDWAESLVEYAWKKWLADENFAHQEVSSMQKLATDPGERPFCSQFARSDDHARIGCCEDNARIATAGYAAQIASMGYSVRIGSVGFNSHIGSSGERARVAVTGNSSRISSAGDSSRIANTGMRVRVCTLGERCHVASNGDLVQIASFGANARIANSGDNVHIIASGENSTVVSTGVVDSIILGPGGSAALAYHDGERVRFAVAIEGENNIRAGVRYRLNEQHQFVEC

SEQ ID NO: 18847 - protein, 969 aa, Zymomonas mobilis
MNFKSNKLRDAVVLALVLGTGNAVLSATAVAQTKPADEAATLDAINVTGSRISTPGLTTSSPVTSIEREDFMRTQPVAVEEFVKQLPSVSPTVGPGTNNGATGAAELDLRGLGSNRTLVLVDGRRPVPYDLSGVVDTNTIPVALIQSVDLLTGGASVVYGADAISGVANFILRRDFEGVEVQSSYGQSKYGDGARQRIEATMGANSSDGKGNVVFSVGHTKVDPVFQGDRAWGKVSRSSANGRPQGSGTTVPSLIVGPPGVWGTPGDDGTLDGRGQIDPTTGQIVSDVQTYNFNPINLFQTGLDRYQATALGRYEINEHAEAYGQVNYTRSRVEASLAPSGLFQEAFDMPIGNPLIPEPARQQLCQAYGIDAANCVPGNATMIEGLTIGRRLTELGPRTDRFDTKTFQVTAGLRGAITDNWKYDAFWSHGESERLAESRNWGSLSKTRQALMSLDGSTCVDPSNGCVPLNVWGPEGSVSPEALKFINLSAFSIQNVEQDNAALNVSGDLGGFKSPWSEYPIGVAVGAEHRRATAGTRSDGPSQIQGEVMGTGAPTPDSQGGFTINEAFGEFIVPLIDNAPGVYALSLEAGYRYSDFKTSSNTSDEYGSFKYGINWAPIESLRFRGMFQRANRAPGIGELFAPQVTSLDNLETDPCAGGAISAAQANVPGTLSNLCVQTGVPAGSAGLVAQPNAGQVNVLTGGNLLLTPEQADTQTIGLVWNPTSNFAMTLDYWKIEMEKTISSQSVDDVISGCYDPAFNPGLTFNSNCALIGRSPLTGTFNGTTSRGISLILSNQGTLKTDGFDLGLKYGFDLPGSMGRLNLAYDATLVTTLESQATPESENRDCLGYYSVSCTPNSKYRSILRSSWSYNDLSVSLAWRYNSKMEVEPETGTWFQSYREIPSYSYFDFGVNYKLPFNAEVNLSVANLTNKKAPVVGNTIGDTTQNSGNTFPNFYDAIGRFYTLGMTFSF

SEQ ID NO: 18848 - protein, 524 aa, Zymomonas mobilis
MAQMPAVADLEAQAPRLPAPDQSLGMQRTIPQVTSVSQLSDVSPTDWAYQALASLVEKYGCIAGYPDGTFRGNRAATRYEMAAALNACLDVISDRFATKEDLATLQRLMDEFRAELATLRGRVDRLEARTAQLEAQQFATTTKLRASVVFNVSDVLTGTQAVAAPGRGPTIQDNPVATYRARLNFDTSFYGKDVLRVRIQAANMPNYGAVTGTNMARLGYDTNTGGVFALADLYYRTPLTQRLFLAFDAAAGNFDKNVFTFNPLLQSDETGAISRFGRFNPLYRFGGGNSAGLTLRYTLLENKEQGTNLVLNLGYQAPFANNPIPNAPNTNGLIGGAYAALAQLDWRPVKNLALGFTYVRSFGVGVDGAAGSSGFPGSAANPIGNNANAAADNFGFQFTYRPIPKLNIAGWVGYSSVYQVQGFAGPRAEAEVLNWAATFGVPDLWRKGDLLGLIVGQPPQTISVRNVLGAPAATFNSYHIEGVYRIPISRNISITPGVIALVNPNSNSNNAPIVLGVVRTTFSF

SEQ ID NO: 18849 - protein, 529 aa, Zymomonas mobilis
MLIDPKPFKMIKENLMTQSQKVRFLAPLSLALSLSFNPVGAEEDGGFMTFGYELGQVVQQVKNPGKIKAEELAGLLNSTTTNNTNINIAGTGGNVAGTLGNLFMNQLGNLIDLYPTLNTSNIHQCGSNGTAASGSTTTAATTSNSPCFQGNLSLYNEMVSSIKTLRQNISNNIFQGNNNTTSANLSNQLSELNTASVYLTYMNSFLNANNQAGGIFQNNTNQAYGNGVTAQQIAYVLKQASITMGPSGDSGAAGAFLDAALAQHVFNSANAGNDLSAKEFTSLVQNIVSNSQNALTLANNANISNSTGYQVSYGGNIDQTRSTQLLNNTTNTLAKVTALNNELKANPWLGNFAAGNSSQVNAFNGFITKIGYKQFFGENKNVGLRYYGFFSYNGAGVGNGPTYNQVNLLTYGVGTDVLYNVFSRSFGSRSLNAGFFGGIQLAGDTYISTLRNSPQLASRPTATKFQFLFDVGLRMNFGILKKDLKSHNQHSIEIGVQIPTIYNTYYKAGGAEVKYFRPYSVYGVYGYAF

SEQ ID NO: 18850 - protein, 704 aa, Zymomonas mobilis
MALCCTPALAQQQPDANAVELDAVNVRGERVETSTALSGFGATRLLDAPASIALIDRQQLLDRQARVLSEVLRADASAGDAYAPIGYYENFVVRGYSLNAANSYRINGMSAVGEQSIALENKQQVQLLKGLAGLQSGVNEPAGLIDYRTKRPEHVRSVTLGTDEQGSRYLAADLGDWFGAERTLGVRINAAREDIDSDVDHADGYRNFLSLAGDWKITPQALLQLDVEYQHRQQRSVPGYQLLGGTQVPRDIDVHRLLGYQPWARPVEMDSLNAQFRYAYQFNDDWRATADASRSRSTINDFSAFAWGCYGAASCADFATPNFFSAQGEYDVYDYRSPDDTRVHNQLRATLEGRVATGALEHRLSVGGEWLRRTIDRFGSVNAFVGSGSIDRDPEVFAQTDVPLAPKQRRLDSRQRALVLADRIGLGAQWELSLGGRYVQLDERSFDRDGLLERRMRKDTVLPQAALLFKPQQNVSLYASYAKSLAAGGTAPWFADNADEILPPTNAYQLETGAKIDLHSLRLGAALFDIRQAYQFTQPQADGGLLYVQQGRLHNHGLELSADGAATRQLRLFASIAAIRARAEDTDIAEYEGHQAINVPKLRASVQADYSVPGVDGLALLAGVQYSGRKFADRLGNASVPAYAVANLGARYATALGGLATTWRLNVDNVFDKRYWRDSGEYQGDAYLFPGAPRTARLTVQVDF

SEQ ID NO: 18851 - protein, 185 aa, Zymomonas mobilis
MKNFIFSTLVVTTSVWVVNVAQADTNALSVGYAQSKVQDFKNIRGVNMKYRYEDDSPVSFITSLSYLYGDSKASGSSEPEGIHYHDKFEVKYGSLMVGPAYRLNDNFSLYALGGAGTMKATLKEHSTQDGESTSGKISSRKTGFAWGAGVQMNPMENIVIDVGYEGSNISSTKINGFNVGVGYRF

SEQ ID NO: 18852 - protein, 987 aa, Uncultured bacterium
MKKPMTFSISPVATAVSLVLTAGLAFPVYAQDQGQDNEEKAKEESIEVINVSGIRGSLARSTDFKRQSSGVVDAISAEEMGKFPDTNLAESLQRITGVSVSRNDGEGSQITVRGFGPEFNLITLNGRQMPGTGFSRSYNMEALSSEGVTALEVYKTARADTPSGGLGATVNIVTTRPFQHSGQKFVIMGKALHDSSVEKGDSVTPELAAVYSNTFADDTFGIAFSVSQQRRDFRQQYANIQGWQANVGLPDLDEGDYVDPRPIGEDGERIGNHFFPKDMNYGFTDVQNERTNGQVTLQFAPTDTMVLTADYTGSRRTSGRVGFGWGIWNEFGGNINSYILDENGTAVYADIAGNDASFTANWDTTEIEADSVGLNLTWDITPDFRLWVDAHDSSNSIDNGADPGLGSNGQIIMGSDQLQTKFYDYRNGEIPQASVLWNNGTSVLAPNEIGSNFGQFIHSPGESNVKQYQIEGTWYNSVLDIPLVSVKAGISRTDQDMSGYEAWSGLRGGPGFSPSFAEIFPDGMFEYHDTSGFLDEFEGGGSDLAQNYYYTYDYNEALARHVAYLTEDLMGADEFVADAYYDGIDSQSYVREKTDAIFLQTSWEFSLGAFPTELNVGVRYETTDVTSTVRQRVEQQVNWVSASEWIMQYEEGDATFLTQTGEHDVFLPMLDLKVNFTDQLIGRFSTGKTISRAPLGALAGGRSLSASPKPGARTGSSGNPNLLPFESTNLDLAIEYYYGEGSYASVGYFKKDVDNFVQTTITETTVEGLRDIFEGPRYQQAVADVEARGEQATSTAIFEQMIANGYGNADGAIEPNADDPLIVWSISRPSNTDSKSVDGFEIAAQHLFGRSGFGLAANATFVDGDVRFDVTSLEQQAPLTGLSDSANFQAFYEKDGWSIRATYAWRDSYLIGVGQAQGSSDAPPQFAKSYGQWDLSVNYDVTEKLTVFFEGINLNNETEEGYGRYEEQFLFARQYGPRYAVGARYTF

SEQ ID NO: 18853 - protein, 868 aa, Azoarcus sp.
MRKKQLVVALAMAGIGVNAPMAWAADEAASGELDRVEVTGSNIKRSIKQEKALPVTIVRTEDMTKQGFTTVEQVVNSLASNQSNLVGASSVQSVSGGASYAGLRGFDPQYTLVLLDGRRVANQAISGVATDLNAIPLSAIDRIEVLRDGASALYGSDAIGGVMNFITKKSYQGLTISGEAQATQHKGGDSANVSLLGGVGDLAKDGWNAYGVLSYQKNKAIKTIDRDFATKNQSLSSITYPANFLYQAAGKPGDGNVYNAAMPGCRPPYTTPRDATSCGEKTWLFMDLTPEVEQFTANGKLSKQFGDHMLTAQYLGARNISTTRIGPTPMQSIATLTAGVNKYFPTVLPDGSPVTPGAKAVLNLRSDPLGPRTTKSTSDTHRLAVNLEGLLGGWDYRTGAAYSSNQTTINYKSGYVNGDKIEQALLNDQINPFGDSPAGAWENVELKGDGWISKYETALADFKASKELFALPAGNLAAAFGGELRHEKLDSQIQDLAQYAVGSGIADSKSTKGSRNISALYLEADVPVIKGLDIQLAARYDKYSDFGKAFNPKVAFKYQPAPQILFRGSASRGFRAPSLFDVFQPDAKTYTNGNNLNDPVLCPNGTPANGGDKTDCGTTFFAKQGGNRNLEPERASSLTFGVVIEPIREITASVDFWWTTINKVIGVLDNDLIFNDPVKYANRFVRVNPNDPYSKLDYVSTPTENLGNLSAAGLDTSFSWRLPRSRLGNFTINLDGTYTSKFVQQVEAGGIYYSRLSQWNNGLQPVVRWKHSLGLNWSLGNWSALLAQNYVSGYTDYKATHSVKPYSNWNLSSTYLWQKKLSVTAGVKNLFDQEPPFSNQNKFFQKGFDPILADPVGRAFFLKASYKL

SEQ ID NO: 18854 - protein, 157 aa, Azoarcus sp.
AGLKKNTANTTDTTDLYTASFIAGGGAFGYKMDDIRVDVEGIYSQLNQDTTVTGTSVPAGGIAKNLTAISGLVNVYYDIAIEDMPITPYVGVGVGAAYVSNPLAKKADDNKASGFGVAYQAKAGVSYDVTPEIKLYAGARYFGSYGANFGKAAKNDA

SEQ ID NO: 18855 - protein, 234 aa, Azoarcus sp.
MGIDSRNDIPEGIATLGAFMGYSHSHIGFDRGGHGSVDSYSLGGYASWEHESGFYLDGVVKLNRFESNVAGKMSSGGAANGSYHSNGLGGHIETGMRFTDGNWNLTPYASLTGFTADNPEYHLSNGMESKSVDTRSIYRELGATLSYNMRLGNGMEVEPWLKAAVRKEFVDDNRVKVNSDGNFVNDLSGRRGIYQAGIKASFSSTLSGHLGVGYSNGAGMESPWNAVAGVNWSF

SEQ ID NO: 18856 - protein, 231 aa, Azoarcus sp.
MNRLSLLALGAALAASPAAAQMTGATLDFGHSFFTEDADVAKTSLGGSAEMSIGTNFGVQGDLGYSRLHGIKDDATSVAVHGLLYVTPETALGAFYGIEELAGDGVHFYGFEVGQKSDFFDVEAYVGRADDSGLTGSMMGLEGRLSLASGFGVGAKVNHLDVEGLDTTRIGLTGDYTLPNGLALTAELGTVNADDLGLDGSEPYIGLGARFDFGRGTMFSRRTLTAVAPGL

SEQ ID NO: 18857 - protein, 699 aa, Azoarcus sp.
MKRSVLFISSVGVMTSHVYALEADQQVVTNLPTISVKADKESSLKQEVGQASSATKGLMQLKDVPQIVNVVPKQVLREQTVTSMQGALQNVAGLSFSVGDGQRDQVMIRGFSAITDNYVDGIRDDALYFRDMSNVERIEVLKGPASVLYGRGSAGGLVNKINKKPMDQSLREVSLIGSTTGQRRAEVDVNEKVAENVKVRLTGAVEDSDGYRDQAFLKRQAVAPSVQWDITDKTKLLLQADYLHDNRLADQGFPTDPITGKPVKTNPKTFYGALNGKEVGDVDTEISSQTISLDHEFNDNFKYHGAVRHYNYSLDRQYSVDSHQKLPADQIQLTQNKRLRNEDGVYVQQELSAVFNTGFLKHSTLIGAEYSKQHKDELVWSKARQITNIFNPQLENWAPLDTNVDADTNNTNTFENYGVYLQDLMTVTDQLKVLVGLRYDNLSQDRDDKTSKNVDLNRTDNTYSPRIGVVYQPVNNLSLYTSYNRSFQPLADSFVFYKNSDDLRPTKTENYEIGAKWDVNDQLNVTLALFEMSQTNIQNKDPNDPKGLTAILAGEQKTKGVEISLAGQLTDQLSVLAGYSYMDGKIEKSAIGFTGNHSALTPNNTANLWLKYQINDHWYAAVGGRGESSRFSAPDNKNVLPGYAVVNAALGYQSERYDVNLNLNNLFDRDYFVSGHSGANDSNMMGDPLNAQVALRYRF

SEQ ID NO: 18858 - protein, 417 aa, Azoarcus sp.
MHKKHCLALACSLALGGQLAHASSQSEAQGFVEDARLNLLLRNAYFHRDYKDNAADAKTWGQAFITTFESGFTQGTVGFGVDAFGLLGIKLDSGRGRNYRPFFDTDSEGRPVDELSQAGAAVKLRVSDTVIRYGNQFPSLPVLAHDDSRLLPQSFTGTLVTSNEIEGLELNAGRFTADSPMGDSARDPNRLKSIDVLGGSYTLSDDLSLAVYHADLEDMYKRYYANLNYNLALAADQALNFDFNIYRTKYDTGSVAAIDLGGDGQGDRNTIWSLAAKYSIGAHAFIVAHQRNSGDAGFAYDYGDGGASIYLANSYYSDFNLKDERSWQASYELDFAQYGAPGLRYKFAYVRGDNIDTGSDNNGTEREIFNQVSYTVQSGAAKDLHLRLRNSIYRSSTDVGPDLNEIRAFIEYPLSIL

SEQ ID NO: 18859 - protein, 341 aa, Azoarcus sp.
MHKKLIAPLLAGLVTSPVALAQSNVGVYGIIDAFFSYAKAGDNKRTGVDSGGAYGSRLGFRGSEDLGDGLKAVFTLEYALSVDQNEGLGTGGLRARQQFVGLQGDLGFVGLGRQYAPGYAIARYDAAGGVPFGPQALLSGGAGASITPASPARWSNAIAYKSPKFGSLTAEAIYSLGERNQDDNRRDGDRWALAGDYSSGPLEVGLKYHHGKEVAIGGGDQKEWGIGASYNFKVAALYATYQTVKTDDTDKVWHVGVRVPTSSGRVYVAYGEHDAEDSRNGARAATLGYIHALSKRTNLYTAYTHVDNESNQNIPNIRPTGVTTMPGDNVNGIVVGMFHLF

SEQ ID NO: 18860 - protein, 1037 aa, Azoarcus sp.
MSFKIEPIKKYINMKNIFMLTNKSEQRLGGKRFSAILLLLCLSLFTVYGQGKKNIKGLVTDEKNEPLIGVSVVELGTSNGTVTDIDGKFDLNVSSNSTLKFSYIGYNVLEKKVGIQAMMNVVLTEVASELDEVVVVGYGTVKKRDLTGSVTSVDSEKLLQSPALSAAEAIQGKVPGVLIQNTSWTPGSTPSILIRGTRSIKAGNDPLYVVDGIPISTAPNLFAPGDIESIEVLKDASATAIYGSRGANGVIIISTKKGKKGKVQVDYNGYYGIQTIQNKLELMDGSEYAEYVREAYRAAGQYDSAVPNMELDKTLPSFTGDDYTWQSIAMAYDENGNYDPGKVRSGALWWNEVERTGIVTDHQLGIRGGGDKMQFAFNTTYFRNEGIYKNQDYSRYTVKLSVDAEVTNWLKIGGQSHFSHSLQDRGSNFQDCWRVNPLGRLYDDDGAPTLMTSGGDSQWWNPLQYLEPDAVVNPLKINRFLGSYYGEIKLPLDGLKYRANIGIDFHSRQDYSFLSSNARQGNPNQAKNATQQTYAYTFENLLFYDKQFGKHSIGITLLQSIQRNRTESLSTTVQDLPSDDLLFNDIASALDITGYDSNNQVWSLASFMGRLNYNYKSRYYATFSMRYDGSSRLADGHKWVSFPAFSLAWRVNEENFLKNFDKLDNLKLRFGYGVTANTSINPYQTKGLLSKKYYNYGENMVIGYTSSSLPDKTLTWETTGQWNVGVDFSFFRGRLSGTVDAYLQNTHDLLLDRQLPAVSGYTSVLTNVGKTRNKGIEVSLSTVNIQNKDFTWSTDFMYSTNKEEIVELYNGKVDDIGNSWFIGEALGVYYDYKKIGIWQDTPEDLAEIEKYNKNGHKFAPGMIKLLDIDGDHKITADNDRMILGQKRPKHIFNFSNTFVYKGLDLNVVLYGTLGGMLRNAVRVNHQSYRNNSVKFDYWTPNNPTNAYPRPNRLYDNIEYESSLYYEKSDFLRVKTITLGYTLPKSLVNKATLSNCRLYVTAQNPLVFTSYTGVDPEGAATYASPSVSSWIFGMNVSF

SEQ ID NO: 18861 - protein, 372 aa, Azoarcus sp.
MQKKLIALAVAGLVSAPAFAQSNVTIYGVADAYMGFGSHGDNDKAAINSDGLSGSRLGFRGVEDLGNGLKGVFTVEQGFDISNGTGMGNASRQAFVGLGGSFGTVSLGRQYAPGYDFQYDVTASAPIGPQSILSNQSGMTITPNSGARWDNSVAYNGSFSGLKVRAIYGMGGNEDTYEVVTAVDPVTGLPTASKLMDPQDDDRFGLGVEYGNGPLKVGAVYHYLKDGADINGLSDDQQEWLVGGSYNFGVLTLAGSYQEVEGIGNLKGVDADLWQIGVLVPVGAAGNVHLAYGEVDFDINAMGVNESAKAKSYTLAYTHALSKRTTAYAGWNRTDNDNGLDLGLVDYIQPAGATTYGGDESDLFFVGMRHTF

SEQ ID NO: 18862 - protein, 694 aa, Azoarcus sp.
MNIRLNRGLMSSASALTLAVFVVTPALAQEAAKASSDAIVLDTVVVTGEKVARDIKNTASSVTVISAKEIDKEKTGDSSVAEVIANVPNVIYTDNVGAPIIRGQDTQGPNTGQNVFWGGTVPRATINLDGHYLNYNEYYFGATSVWDLDSIEVFRGPQTTSQGANAIAGAIIVNTKDPVFTREGAYQVEIGNYNTKRTSIMLNSPIYKDELAARLAIDYSGRDTFIDYVSPNFISEKTNQDFEALNARLKLLWEPAEIPGLTAKLTYSHNRSNRPSQEAASAPFDELEHLTTTMPSWKQDTNTGILDVGYDFGNGVKFYNQAQYSASSVHRHTGIANNGKADINQKNISNESRITFGEQEDVISGVAGIFYANTKSDEFMLLQGTTTFDDTKDNLGLFAEVSYRLDDQWTLTGGLRYQQDRVQRIGKSALAPTPLDYDETFSALLPKVSLAYAVTPDLTIGALVSKGYNPGGVSLNLNSRQWKPFEDETLWNYELFTRANLLDDKLTLTGNLFYMDFKNAQYNIPVVVSPGVAQSYTINAEKAHAYGLEMGLDYQLLSNLTIKTSAGILRTEIDEISSNVSYEGNEFAKSPGYMFSIGASWDATEKLNISGQVRHTDGYYSDLANTPTYVVDAYTIADARVSYDFHESLQLYGYVKNIFDERTPTYLQQNRGIGGIEASMTMPRTFGVGIKGTF

SEQ ID NO: 18863 - protein, 708 aa, Azoarcus sp.
MSSPKSLPTALLGLALACPAFAETRAVELAPAQVLGQEQGGEGQPAQEAAARLAQVPGGTNVVDMRRPLQGRVASNQDVLAYQPGVYAQSAGNEGVKISIRGSGINRAPGAHASGLYTMLDGLPLTGPGGTPYELLEPLWVDHVEVLRGANGFDRGALALGGAIDYVSHTGYDAPLLQVRYATGSHGYQQRQVSSGQVLGDFDYYVSLTDSNADGYQDHTRSQSKGLIGNFGYRFNPNLETRFYLRYRETDNDLAGRVTKRSIEHDPRAANPAYVSRDDRRKQPGSTFVGNKTTYYLDDDSSIQAGLVYHDYPMDLREGPNRLKVAYSDVSGTLDYKRRDSLWGLESRSTLGLRVTKHLPNDGASEFVRIPTGNTANYAPGTRIRNFTYQGSDTVLHVGNDLEIADDLWLTTGLAAIYTRRESAVTYPEGGGKTSLGDWDYAPRLGLRYQLNPDLQLFANLSRSVEAPHPWSLIYSANQRFPAGSGVATGAQRDPVKLRNQTATTLELGGRGDSSLGQWSLAWYYAQVRHELLSVLPDANAITPYELNASPTVHQGVEASLQSELWSRPGVGRLSLRQAYTFSDFHYRDDQRFADNRLPGLPMHYYQGELRYDWPLGFFAAVNTQLVSKVAVDYANSYYADPYALFGATLGYNAPKNDWQTWVDVRNLTDKRYAATVTPGYDDKGLDAARSTPGEGLGVYLGVSWSLR

SEQ ID NO: 18864 - protein, 359 aa, Azoarcus sp.
MRLKLSGAGLILAYAGVAHAQSNVTLYGVIDDGLTYVSNQSGHSAWRMDDSISQGDRFGFKGTEDLGGGLSAQFNLESGFNPNTGASRQGGLLFGRQAWVGLSDSRFGTLKFGRTYDQMTLTLIQYHVGYYVGIYAFDQGDADRISGEWLNNLVTYASPVIGGFKFSAQYSFSSPGVPSTSLGPAYSLGASYDHGPFSIGAAMTSIHGYSINPGGMGMPVFLNTNTGFASTSVVVDRYRTAGIGSSYTFGNLGIAAVYANTRFQTLGHANTLQSINANIHYFILPAVQVTGGYGYSRFTTYNWNEFNLALDYLLSKRTDIITSADYQKANGGARADLVTLPVSGDNKQLVLRIAMRHKF

SEQ ID NO: 18865 - protein, 164 aa, Azoarcus sp.
TFIFNTMPEILPLFTKIEGIEYKKGTDSHNPLKASFIAGGGAFGYKMDDIRVDVEGVYSQLSKNNVDGAALTPADAIADSLTAISGLVNVYYDIAIEDMHITPYIGGGVGAAYISTPLKTAVNGQNSKFGFAGQVKAGVSYDVTPEVKLYAGARYFGSYGANFD

SEQ ID NO: 18866 - protein, 755 aa, Azoarcus sp.
MHTTGGDSVRHTLLAQAIDQAHTARGRRCGWLLMGLTALPCVPAMAETAAGQNTETVALESVTVTATRREESLQKVPVAVSVIEGEQLERDNRNGVASIVQQVPSLNFRTGASNKDTSLFVRGVGTISTSPGVEPTVATVIDGVVYARPGQATLDLLDLERIEVLRGPQGTLFGKNASAGVLNVTTKAPTEATHGYIDQSYYSGNESRTRFGIGGSLIPQTLKGSITTLFGSYDGNVDNKLNGQEVNGYNRKGARGKLEFTPNDDITFTLAADYMQSHDDAPNGVVTKALTPSFASALTPVRADSDNRNVVSDYRSHVEDVNKGLSGQLDWQLGDYTLTSITAWRGWDNTQYQDGDRLGTVTAAFPGTEDKGDLAFNQYSQELRLASPKGRFVEYVGGLFYMHGKSDETYQRTLITPTTHDRGIADYSTTTDSYSVFGETTFNFTPDLRAIAGARWTHDDLEYDHRRVSTSATTVSGIQPATSSSGSVDEDGKSGRLGLQYDLSDSVMTYITYSRGYKGPAYNVFFNMQPRDTEALKPETSNTWEVGLKATTWNNRLTTNLAVFHSEYDNYQANFFDSVAGQVVTRLINAGSVSTEGVELDYALQATRNLKFSGALSYTKARIDSFACPAGAAASCNVDGKTLPYSPDWKSYVRADYTIPLDNGLDIELGTDYSWQSEVQYDISQNPDTRQGAYGIWNASVALADYNSGWRVALLGKNLADKSYSPMLATGGNYVYRSVPRDDERYFGVQLRKDF

SEQ ID NO: 18867 - protein, 1017 aa, Azoarcus sp.
MKAKLMLCLCLLLAATTMFAQNLTVTGVVTEKATGYPAIGVSVLVKGTTNGTITSMDGDYTLSNVPKNATLVFSYVGMTTQEVPVNGQTVVNVLMSEDTQNLEEVVVIGYGTSKAKDLTAPITMIKADEITKHATTSPMGALQGKVPGVQITNSGQPGSGPSVRIRGIGSMNADSQPLYVVDGMFFDNIDFLNNSDIQDLSILKDASAASIYGVRAANGVVLITTKKGALNRPATITYDGYVGFQKATNVLEMASGDQYRMMANEIGDATLIDKVNQANKLWGNLNTNWYDELLRTAMIHNHSLDISGGTEKVTYSVGASYLYQDGILDAENSYNRLNLRTQADYRVFNWLKVGTNIMFSNSNQIIPNHTVWQHAFRMPGIMPAFDENSTLNPYPVKYASPAQIGLSEFYSNPVAAANYYDSKNKSLRIMPSFYAQLDLLPDNKLVWKTQYSQDVNIQQVRTFTPEYRVGGTQAASTSTLKKQNDTYWSYIVDNTLTYKDQFGDHGLTAMLGNSVREENWRNLWGNATGVPEGFEEYYYLNQGNADGRTTGDDGTTYRGVSWFGRISYDYQGKYLLSATMRADGSSKYQDKWGYFPSVGAAWNISEESFMKDQKWIDYLKLRASWGKLGNDKIQASDGFASVTQDMTTTGIFGGSAIPGYTNLVYFSWLGWETVNETNVGLDFRTLNSRLSLEADWYYRLTQNAVIDAPLPMGLGDGSLLGNRGEILNTGVELSLNWSDKIGKDFTYYIGGNITTLHNEVKSLDGAPYIYGGSAEFRTISRVGSELNSYYGYELAGVYQNTAEIAADPIAVANGLEPGDFKYVDQNGDGKIDAQDRVILGSYVPNFTYGINLGFSYKNFDFSMVMQGQTGNQIVNRKRGDRRWHSELNYDADQVENRWTGEGSTNDYPSAKGSVKAWNIANFNSFFVEDGSYFRIQNIQLAYTFPKKDLGKFKMPSIRLSLTADRPLTIFKANSFSPELMSGVNADGTQSLSSTSYGFDEQVYPLSSSYTFGVRIIY

SEQ ID NO: 18868 - protein, 271 aa, Azoarcus sp.
MPTLRFPFHLANHNKDAAINILIIFISIGSIIFNVNYFHTTIVKNGQIINQPTNAFQSDFSLAALWRNENHAGVKDANPVAVNQETPKLSIALNGIVLTSNDETSFVLINEGSEQKRYSLNEALESAPGTFIRKINKTSVVFETHGHYEKVTLHPGLPDIIKQPDSESQNVLADYIIATPIRDGEQIYGLRLNPRKGLNAFTTSLLQPGDIALRINNLSLTHPDEVSQALSLLLTQQSAQFTIRRNGVPRLINVSVGELTGMNGLRHERTQ

SEQ ID NO: 18869 - protein, 411 aa, Azoarcus sp.
MNKKQIFTRSVITAAIALASSQSMAAGFQLNAQSATGLGRAFSGDGVIADNASTMAKNAASMTLFDAPALSLGVIAIDTDVKVKDATYNGSQIPDDQIGGTSYAPNIYYIQPINDKFAVGASLYSNFGTKTEFSDNYAANAFGGLTDVKSMNLGLSAAYRINQQLSIGGGLDVIYGSGKLNRYIPAGKIPTPNGTINTPKIDLLDVDADGVALGFNLGTIYELDQNNRFGLSYRYSPTLEAKGDMHYAGSDLSDQKLKMPLPDMAEFSGFNKLNDKFAVHYSIQWIRWSEFDVLETTGGVKLNDYQWQDGWHYSIGGTYYLNDQWTLRAGYMHDTSAQDSKTSISVPDSDRNWLSGGFSYHLDSKSTIDFGLTYLIGKDVKADETNPLGMSVDATTRANAWLYGLQYSRSF

SEQ ID NO: 18870 - protein, 99 aa, Azoarcus sp.
MALTKAEMSEYLFDKLGLSKRDAKELVELFFEEIRRALENGEQVKLSGFGNFDLRDKNQRPGRNPKTGEDIPITARRVVTFRPGQKLKSRVENASPKDE

SEQ ID NO: 18871 - protein, 282 aa, Anaplasma marginale
MNYRELFTGGLSAATVCACSLLVSGAVVASPMSHEVASEGGVMGGSFYVGAAYSPAFPSVTSFDMRESSKETSYVRGYDKSIATIDVSVPANFSKSGYTFAFSKNLITSFDGAVGYSLGGARVELEASYRRFATLADGQYAKSGAESLAAITREANIAETNYFVVKIDGITNTSVMLNGCYDVLHTDLPVSPYVCAGIGASFVDISKQVTTKLAYRGKVGISYQFTPEISLVAGGFYHGLFDESYKDIPAHNSVKFSGEAKASVKAHIADYGFNLGARFLFS

SEQ ID NO: 18872 - protein, 1019 aa, Salmonella paratyphi A
MGISELRVIALDADKVIHRTLRISGFAAALLFSTALTAPAFAGGGASGHYAHWVARGGDDQLTDPGSPGEDGSGCCGGGGGGAGTTGGQGGTSLYDAGGAGGSTPGADGAAGSMDFWGFGSGGGGGAHGYVGATLPTSGVRGGAGGKGGLGDTSKINHDATEAGGGGAGGYGAVVTGSGLLGTLTTSVYGGSGGAGGDALNDAAAGSGGSGGVGLRFTSTANKQLIIGNSVSGGNGGATGANGGVNGLRTAGLGGVGLEGASMDVTMLAGGSIAGGMSGDSVTQANAINFTDGRNALRFTGPTSQLSGNINLGSNAALWLYGVPGLPGGTVIDNVITGGGTITKDGSGTITFSAANTYSGGTVINDGTLKLSGAGTLGNATSTTTVHSGTLDLGATTQTQSRVNLYSGMLQNGNLNASVFSNGGTIKDLGGTASLTTEDGTTTLQGINRYSGATVVNGGTLDVRGTITGTSSVGVYDGATLTGAGIIVAPSVTIYSGGTFKPGDGTAGSSTTVEGSLAFQSGAFYSVTIDPVTASFANVVTGLNSPGMVTIDSGATVNAVFANGSYISKTYTILTTTDGRSGTFDPTVKTTNLPANFRTTLGYDANNVYLNLALNYTPEPKPEPTNPTAPLFTPLNQNQRNVGNAVINAFNAGGAIPIAFGALTPAGLSQASGETSVGSQQTTFDAMNLFMGAMIDPFAAGRSDGVSPSARVSSYAEEHSPRNAYAMFTKAMPVKADPFAQRWNVWATGFGGSQTTDGNTATGSNTSTSRIYGAAVGADYRISPNTLAGFAMSGGGTTFSVANSGNGRSDLFQVGGFVRHTIGTSYLTAALSYAWQDVTTDRNVAGIDQLQARFNVNAFSGRFEGGTRYVTPWMEIGATPYAAVQATAFDLPGYREQVLSGPGIFALNYDAKGITSTRSELGVRTDKAYALTDSILTLRGRFAWAHEFNPDRSVAATFQSVPGASFVVNGARQASDAALTTASAEVKWRSGFSLAAIFEGEFSDVTRSYAGKGVARYQW

SEQ ID NO: 18873 - protein, 720 aa, Salmonella paratyphi A
MTSFYIPKRVALLLGALFVLNPISMLLAAEDAQSGNAILETDIERLSIHYRQAYRGNVSATELPQAISVLDEQLIKDAGLTRFQDVLDYSASVARQNNGGGLWDSFSLRGFPGNENMPSGYLINGFNGGRGFSGHRDLSNVAYVEILKGPGSALYGRSEPGGTVNIVTKKPQYQTSGYLKASAGSFDQYRLEGDVTSGLTDNVAFRINGAWQEHDSFRDYVFSDKKIVTPSARWQISDKASLLYEMEYLKQEQLFDRGIIVLNNDINTVPRSRYLGEPNDGATVVNATGHQLTYDYELNDDWSLTAGYNYRDSSLKGYSSDAELARGRQSLFDDGRTLTRQHRYRDYASEDNSLRLELSGHVDTGFIRHNLLLGADAYHYSLKTGLYRYRGKKGEYAIDIYEPQYGGPQPEVSLLYENNETQKAWGTYLQDQMDLTEKWKLHLGLRFDSYQQDISEVAKNTLSEQTDSRVSPKVGLVYLWSDALSFYSSYSEGFLPLSGTDYTGKPFEAEESKSVELGMKFNGNWFTGLAENGIAVSGSLAVFDAQKSNILTSDPLNVGFSATLGKAKSSGVELDLVAELTEDLQARLSYAYLNTRTANDSLNPDWGVLIPAGSPLVNVPKHTASVMLKRDLNAFSIDGHLGMSWRYVDSRLGDSANPSFQLPSYQLLGVFMNTHLSDNFVLGVNLDNLLDEHYIASSYSALWAVPGEPRSIKVSVSYEF

SEQ ID NO: 18874 - protein, 185 aa, Salmonella paratyphi A
MKNIILSTLVITTSVLVVNVAQADTNAFSVGYAQSKVQDFKNIRGVNVKYRYEDDSPVSFISSLSYLYGDSQASGSIEPEGIHYHDKFEVKYGSFMVGPAYRLSDNFSLYALAGVGTVKATFKEHSTQDGDSFSNKISSRKTGFAWGAGVQMNPLENIVVDVGYEGSNISSTKINGFNVGVGYRF

SEQ ID NO: 18875 - protein, 1093 aa, Haemophilus parasuis
MKNKLLQFFELPALVPKFLVAITLLLYCSTNINAANVPLNTNIDQQKLTGTVLDNTGMPLPGASIMEVNTTNGASSDFDGNFELNVSQLPAVIKISYIGFTTQEITIESLAPIQVQLQADNNALDEVVVVGYGETSREKLSTAVSTVNTENLEQRPVADVTSSLQGLSPGLNVTQSTGKIGAEPRINIRGFTSINGGTPLILIDGIEGSLSNLNPSDVESISVLKDAGAAAIYGARGSFGVVLVTTKNADKGNVQVNLGVTTAINSPTMNTDFLTDPFKAVSIVDEAFRNNSGASYTGYTEEDMQALYEVSQDPSLARVIIDQRNGRDQYVHYGYTDWWNTFFRKTYPTQIYNASVSGGSEKIKAYFSYRNFQSQGILKVQDDYYDKYNLRGKIDIKATDWLSFSNNMQYNSSEDLEHSGSQYGNYSNLWGSLIWVHALPSYVPVNPDGGALWRTELNNYTIGDGVYAGLLQGTTKQQTNNNEFSNIASVELKPIKGVTLNANYAIRRNEYSRFQRSTRIPYSIYPEQLDLMGNDYLNEYRTESKYDALNVYGEYKGYFGDHNVKATIGFNQETFITKSINASKQNLISNDLNSLGLATSNPTTSGSASEWALQGLFYRLSYDYKDKYVAEFNGRYDATSRFPSAYRWGFFPSFSGAWLANKEQFIENATGETFDLLKFRASYGSLGNQNIGNYAYFPTLPNGLYNYVLNGSRLNYIESPALNPSEITWEKVSTLDFGVDVGVFNNHLSASFDWFQRDTEGMLSPGATLPSVLGTASPLENAADLRTKGFELSVSYNDYFELAEDTFSWSVTANLSNSKTKITNFDNPNRSLVDFYEGMTIGELWGYRIDGLFQTEEEIANHADQSFVSNRITSGGGLQPGDVKYRDLDGDGYIGEGENTVDNPGDREIIGNSAPQYLYSFLANANWKGFDFSVFFQGVGKQDWYPNSDSRMFWGPYNRPYNSYIRKDMVDDMWSPENTDAYYPRNYGYIALGGSLEKVNDRYLQSVAYLRLKNLTLGYTLPDGLISKTAATKLRIYFSGENLLTFSKLTDYIDPEAASASVNLNSPSTSANRGTAQTNPFSETYSLGLSLKF

SEQ ID NO: 18876 - protein, 898 aa, Haemophilus parasuis
MKNKLNLISLALLSLFAVQSYAEQAVQLNDVYVTGTKKKAHKKENEVTGLGKVVKTPDSLSKEQVLGMRDLTRYDPGISVVEQGRGATTGYSIRGVDRNRVGLALDGLPQIQSYVSQYSRSSSGAINEIEYENLRSIQISKGASSSEFGSGSLGGSVQFRTKEVSDIIKPGQSWGLDTKSAYSSKNQQWLNSLAFAGTHNGFESLVIYTHRDGKETKAHKDAESRSKSIQRVDLADNNPQGSNWFKVKNDCPSLNCEPRQQVGVSYDGQKYITEQLSAKEYTGEERALPDPVKYKSDSWLVKLGYSLSPKHYVAGVYEHSKQRYDTRDMTYPAYWQLSDLKNGDKWYPMNNAKGLYRDNALDGVAIDYFTEDGVKSSKGLRWAKARFIDEWHTRDRLGALYRYTNQDGNRLIDRLSLSFDQQKINLSTRLRENNCSEYPTIDKNCRATLDKLWSSTKNEQSSYEEKHDTIQLSLDKTVQTGLGKHQLNMLLGSDRFNSTLKRHEILSEFSVGTWHRIRGNGYKDTPYIYELKDQAIYSKNECDYSGTIAGRADCATSKIKGHNHYIALRDNFAITKYLDIGLGYRFDKHKFRSTHRWANQGDYKNSAWNIGIVAKPTSFLSLSYRASSGFRVPSFQELFGLRYDGAMKGSSDAYQKTEKLSPEKSLNQEVAATFKGDFGVVEVSYFKNDYKQLIAPAERMHQTQSMINYFNVQDIKLDGINLIGKLDWNGVFDKIPEGIYTTLAYSKMRVKEVKNYQGYMNIRSPLLDTIQPARYVVGVGYDQPDEKWGVNLTMTHSSGKNPNELRGNEQVGFANYERTATKKRTRSWHTFDLTGYITPWKHTTVRAGVYNLMNYRYTTWESVRQSSLNAIHQHTNVKDYARYAAPGRNYVVSFEMKF

SEQ ID NO: 18877 - protein, 736 aa, Helicobacter pylori
MKKTLLLSLSLSFLLHAEDDGFYTSVGYQIGEAAQMVKNTKGIQDLSDRYESLNNLLTRYSTLNTLIKLSADPSAINGVRNDLGASAKNLIGDKTNSPAYQAVLLAINAAVGFWNIVGYVSQCGGNANGTESTYSTTIFNNEPGYRSTSIACSLNRYKPGVEGPISIENMKKINEAYQILQTALKQGLPVLKENNGTVSVTYTYTCSGEGNNNCALVNVNGKDEQNGGTKTETQTIGGKSVTTTISSKVVGDNTIEITNKLDGVPDSAQALLAQASTLINTINEACPWFNAINSNSPGAPQWKWNANSGGLCGAFKDEISAIQKMITDAQELVNQTSVISSNEQSAQVGANNNGKPFNPFTDASFAQGMLANAQAQAKMLNLAEQVGQAINPDRLTGTFQYFVKEYLATCNNPSTAGTSGTQGSPPGTVTTQTFASGCAYVQETITNLTNSIAHFGTQAQQIQQAENIADTLVNFKSRYNELGNTYNSITTALSSIPNAQSLQNAVSKKNNPYSPQGIETNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKLNVANFQFLFNMGVRMNLARSKKKGSDHVAQHGIELGLKIPTINTNYYSFMGAELKYRRLYSVYLNYVFAY

SEQ ID NO: 18878 - protein, 732 aa, Helicobacter pylori
MKKTLLLSLSLSFLLHAEDDGFYTSVGYQIGEAAQMVTNTKGIQDLSDNYENLSKLLTRYSTLNTLIKLSADPSAINAARENLGASAKNLIGDTKNSPAYQAVLLAINAAVGFWNVLGYATQCGGNANGQESTSSTTIFNNEPGYRSTSITCSLNRYKPGYYGPMSIENFKKLNEAYQILQTALNKGLPALKENNGTVSVTYTYTCSGEGNDICSKKATGVSDQNGGTKTKTQTIDGKTVTTTISSKVVDSQAKGNTTRVSYTEITNKLDGVPDSAQALLAQASTLINTINTACPYFSVTNKSGGPQMEPTRGKLCGFTEEISAIQKMITDAQELVNQTSVINEHEQSTPVGGNNGKPFNPFTDASFAQGMLANASAQAKMLNLAHQVGQTINPDNLTGTFKNFVTGFLATCNNKSTAGTSGTQGSPPGTVTTQTFASGCAYVEQTITNLNNSIAHFGTQEQQIQQAENIADTLVNFKSRYSELGNTYNSITTALSKVPNAQSLQNVVGKKNNPYSPQGIETNYYLNQNSYNQIQTINQELGRNPFRKVGIVSSQTNNGAMNGIGIQVGYKQLFGQKRKWGARYYGFFDYNHAFIKSSFFISASDVWTYGFGADALYNFINDKATNFLGKNNKLSVGLFGGIALAGTSWLNSEYVNLATMNNVYNAKMNVANFQFLFNMGVRMNLARSKKKGSDHAAQHGIELGLKIPTINTNYYSFMGAELKYRRLYSVYL

SEQ ID NO: 18879 - protein, 210 aa, Wolbachia endosymbiont
GPISDEETSYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKNSTGQAADAGAYKVLYSTVGAEAGVAFNF

SEQ ID NO: 18880 - protein, 196 aa, Wolbachia endosymbiont
GPISDEETSYYVRLQYNGEILPLFTKIDGIPNATGKEKDSPLKASFIAGGGAFGYKMDDIRVDVEGLYSWLNKDADVVGGTVADNLTAISGLVNVYYDIAIEDMPITPYVGVGVGAAYVSNPLAKKVTDDKASGFGVAYQAKAGVSYDVTPEVKLYAGARYFGSYGANFGKATKDDAGIKVLYSTVGAEAGVAFNF

SEQ ID NO: 18881 - protein, 207 aa, Wolbachia endosymbiont
GPISDEETSYYVRLQYNGEILPLFTKIDGIQKTKGKEKDSPLKASFVAGGGAFGYKMDDIRVDVEGLYSWLNKDADVVGDTVADNLTAISGLVNVYYDVAIEDMPITPYIGVGIGAAYISTPLKTAVNEQNSKFGFAGQVKAGVSYDVTPEIKLYAGARYFGSYGAHFDKSEEVDKAVGGKETKVTKDAYKVLYSTVGAEAGVAFNF

SEQ ID NO: 18882 - protein, 207 aa, Wolbachia endosymbiont
GPISDEETSYYVRLQYNGEILPLFTKIDGIQKTKGKEKDSPLKASFVAGGGAFGYKMDDIRVDVEGLYSWLNKDADVVGDTVADNLTAISGLVDVYYDVAIEDMPITPYIGVGIGAAYISTPLKTAVNEQNSKFGFAGQVKAGVSYDVTPEIKLYAGARYFGSYGAHFDKSEEVDKAVGGKETKVTKDAYKVLYSTVGAEAGVAFNF

SEQ ID NO: 18883 - protein, 210 aa, Wolbachia endosymbiont
GPISDEETSYYVRLQYNGEFLPLFTKVDGISHKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTVGAEAGVAFNF

SEQ ID NO: 18884 - protein, 210 aa, Wolbachia endosymbiont
GPISDEETSYYVRLQYNGEFLPLFTKVDGITHKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTVGAEAGVAFNF

SEQ ID NO: 18885 - protein, 199 aa, Wolbachia endosymbiont
GPISDEETSYYVRLQYNGEFLPLFTKVDGITYKKDKSDYSPLKPSFIAGGGAFGYKMDDIRVDVEGVYSYLNKNDVKDVTFDPANTIADSLTAFSGLVNVYYDIAIEDMPITPYVGVGVGAAYISTPLKDAVNDQKSKFGFAGQVKAGVSYDVTPEVKLYAGARYFGSYGANFDKSVGEKDKGGHTVLYSTVGAEAGVA

SEQ ID NO: 18886 - protein, 196 aa, Wolbachia endosymbiont
GPISDEETSYYVRLQYNGEFLPLFTKIDGVTGFKKTADTADTTDLYNASFIAGGGAFGYKMDDIRVDVEGIYSWLNKDTNVTGTSVPAGGVANNLTAISGLVNVYYDVAIEDMPITPYIGVGVGAAYINNPLVTKVTGDKDSGFGVAYQAKAGVSYDVTPEIKLYAGARYFGSYGANFGKAAKDDAGIKVLYSTVG

SEQ ID NO: 18887 - protein, 163 aa, Wolbachia endosymbiont
SYYVRLQYNGEVLPLFTKVDGITYKKDKSDYSPLKPSFIAGGGAFGYKMDDIRVDVKGVYSYLNKNDVKDATFDPANAIADSVTAISGLVNVYYVIAIEDMPITPYIGVGVGAAYISTPLEPAVNDQKSKFGFAGQVKAGVSYDVTPEVKLYAGARYFGSYGA

SEQ ID NO: 18888 - protein, 330 aa, Vibrio anguillarum
MNKTLIALAVSAAAVVTGVNAGELYNQDGTSLEMGGRAEARLSLKDGKADDASRVRLNFLGKVAINDSLYGVGFYEGEFTTADEGTADNKGDLDNRYTYAGIGGNFGEVTYGKNDGALGVITDFTDIMSYHGNKAAYKIVVADRVDNMVAYKGQFADLGVKASYRFADRQESTSAITDNNADGYSLSAIYAIGDTGVKLGAGYADQDTAANASSDQYMLAASYAISDFYFAGTFVDGQDKAASKTDKTGYELAAKYTMGQAVFTSTYNYLESKNSGAKKDKADSFAVDATYFFKPNFRSYISYNFNLLDSDKVGKAKSEDELALGLRYDF

SEQ ID NO: 18889 - protein, 1295 aa, Escherichia coli
MNKIYSIKYSAATGGLIAVSELAKKVICKTNRKISAALLSLAVISYTNIIYAANMDISKAWARDYLDLAQNKGVFQPGSTHVKIKLKDGTDFSFPALPVPDFSSATANGAATSIGGAYAVTVAHNAKNKSSANYQTYGSTQYTQINRMTTGNDFSIQRLNKYVVETRGADTSFNYNENNQNIIDRYGVDVGNGKKEIIGFRVGSGNTTFSGIKTSQTYQADLLSASLFHITNLRANTVGGNKVEYENDSYFTNLTTNGDSGSGVYVFDNKEDKWVLLGTTHGIIGNGKTQKTYVTPFDSKTTNELKQLFIQNVNIDNNTATIGGGKITIGNTTQDIEKNKNNQNKDLVFSGGGKISLKENLDLGYGGFIFDENKKYTVSAEGNNNVTFKGAGIDIGKGSTVDWNIKYASNDALHKIGEGSLNVIQAQNTNLKTGNGTVILGAQKTFNNIYVAGGPGTVQLNAENALGEGDYAGIFFTENGGKLDLNGHNQTFKKIAATDSGTTITNSNTTKESVLSVNNQNNYIYHGNVDGNVRLEHHLDTKQDNARLILDGDIQANSISIKNAPLVMQGHATDHAIFRTTKTNNCPEFLCGVDWVTRIKNAENSVNQKNKTTYKSNNQVSDLSQPDWETRKFRFDNLNIEDSSLSIARNADVEGNIQAKNSVINIGDKTAYIDLYSGKNITGAGFTFRQDIKSGDSIGESKFTGGIMATDGSISIGDKAIVTLNTVSSLDRTALTIHKGANVTASSSLFTTSNIKSGGDLTLTGATESTGEITPSMFYAAGGYELTEDGANFTAKNQASVTGDIKSEKAAKLSFGSADKDNSATRYSQFALAMLDGFDTSYQGSIKAAQSSLAMNNALWKVTGNSELKKLNSTGSMVLFNGGKNIFNTLTVDELTTSNSAFVMRTNTQQADQLIVKNKLEGANNLLLVDFIEKKGNDKNGLNIDLVKAPENTSKDVFKTETQTIGFSDVTPEIKQQEKDGKSVWTLTGYKTVANADAAKKATSLMSGGYKAFLAEVNNLNKRMGDLRDINGEAGAWARIMSGTGSAGGGFSDNYTHVQVGADNKHELDGLDLFTGVTMTYTDSHAGSDAFSGETKSVGAGLYASAMFESGAYIDLIGKYVHHDNEYTATFAGLGTRDYSSHSWYAGAEVGYRYHVTDSAWIEPQAELVYGAVSGKQFSWKDQGMNLTMKDKDFNPLIGRTGVDVGKSFSGKDWKVTARAGLGYQFDLFANGETVLRDASGEKRIKGEKDGRMLMNVGLNAEIRDNVRFGLEFEKSAFGKYNVDNAINANFRYSF

SEQ ID NO: 18890 - protein, 1157 aa, Aggregatibacter actinomycetemcomitans
MCRSTSIKIYFFLLRMIKCGNVKIKTPKRDCMTIKLTPIAAGLALLLAGQAYADGGAAGANGAGSQIGNQNVGDVGKSLDKADGKNGDSFNNTPPINTAPSGPPGAGADGLPPTGSGGGGAGGNGGGSVIGAISTGGAAGHSTLSSPAYANGGHGGAVSSNRIEITNSTLTGAVAGAGGGGSSFRGGGGAAGHGGGSVFGGISTGGAAGHSYSNSSSASSANSGHGGDVTGNQITLTDVELDSKGATAGAGGSVTSSSFGGGGAAGHGGGAVFGGISTGGAAGYSQPSVSSSVSSSANSGNGGNVSANTMAITNSTLTGAAAGAGGSVSPHGGGGAAGHGGGSVFGGISTGGAAGYSKSSSSSPSSSSSSSSSANGGNGGNVSANTIAITNSTLTGAAAGAGGSVFLFGPSASAYVYGGGGAAGHGGGSVFGGISTGGAAGYSEAASSFAAAASSSANGGDGGAVSANTIKITNATLTGAAAGAGGSVSSTYVSASAYVYGGGGAAGHGGGSVFGGISTGGAAGNSSSSSSSSLSSSSANGGNGGNVSANTIAITNSTLTGAAAGAGGSITSSSSSGYRGGGAAGHGGGSVFGGISTGGAAGYADSFGSATSSSANGGHGGDVTDNKITISGVSKISGDIYGGISQGGAKGKVRSSTTITDGIDGQGGLVQNNTITLIGKDITIGGSIYGGRSINGAGVDDHTRAFTGNTLNLEGYKGSVQGIYNIEKFNWVLPKDVVNGVIMVNIAGNTPVQLDNTKHTAAMYNDGNRLNTGDKITLIDKVQGTPSFASNQTVKQGHFILYDANLAVEANKLVLTIAQDGKGDGTGTAGRINPTAKAFLEGRASSAALANQGADMVSDNAMAAARVSAGGGNAGMFMGSAGGSNRYKTGSHIDVRDINLALGVSKGLSWKGSSAVTLGAFVEYGQGNYDTYNDFGALGEVRGHGHSNFYGIGVLMHIAGLGLQHATDAKLGTQTGPYLQSALRAGRIKNTFNSADLDDGTGVQGSYTSRTSYFSAMAGAGYVVYLNEQSSVDLYSRYTWGKLGANSVMVGNSALEFGASQSSRLRLGARYSHISSGTFTPYVGLAAEREFKGDSSGSSSGLDIAQPSLKGNTGIVEVGASMKPWASKQALSLDMGLQGYVGKREGASGSVKIKYAF

SEQ ID NO: 18891 - protein, 184 aa, Wolbachia endosymbiont
SYYVRLQYNGEVLPFRTRIDGVKYKSGKDNNSPLKASFLAGGGAFGYKMDDIRVDVEGLYSQLSKDADVVDTSPEVVESLTAFSGLVNVYYDIAIEDMPITPYVGVGVGAAYVSNPLVTEVTGDKKSGFGFAYQAKAGVSYDVTPEIKLYAGARYFGSYGANFGKAAKDDGGIKVPYSTVGAEA

SEQ ID NO: 18892 - protein, 185 aa, Wolbachia endosymbiont
  misc_feature (168)..(168): Xaa can be any naturally occurring amino acid
SYYVRLQYNGEILPLYTKVDGIANATGKEKDSPLIRSFIAGGGAFGYKMDDIRVDVEGLYSQLARDGDVLSSSERDVADSLTAFSGLVNVYYDIAIEDMPITPYVGVGLGVAYISNPSKASEVKGQKGFGFAYQAKAGVSYDVTPEIKLFVGARYFGSYGAKFDKLTXDDGVIRNVVYSTVGAEA

SEQ ID NO: 18893 - protein, 196 aa, Wolbachia endosymbiont
SYYVRLQYNGEFLPLFTKIDGIDYKKGTDIYSPLKASFIAGGGAFGYKMDDIRVDVEGVYSYLNKNDVKDVVFTPADTIANSLTAISGLVNVYYDIAIEDMPITPYVGVGVGAAYISTPLATAVNSQNGKFAFAGQARAGVSYDITPEIKLYAGARYLGSYGAHFDGEKADPKDAAKKVADKGAYKILYSTVSAEA

SEQ ID NO: 18894 - protein, 192 aa, Wolbachia endosymbiont
SYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAEAGVAFNF

SEQ ID NO: 18895 - protein, 183 aa, Wolbachia endosymbiont
SYYVRLQYNGEVLPFKTKIDGVTYKSGKENNSPLKASFLAGGGAFGYKMDDIRVDVEGLYSQLSKDADVVSDDKAADSVTAFSGLVNVYYDIAIEDMPITPYVGVGVGAAYISNPSKADVVKDQKGFGFAYQAKAGVSYDVTPEIKLFAGARYFGSYGASFDKATKDDTGIKNVLYSTVGAEA

SEQ ID NO: 18896 - protein, 184 aa, Wolbachia endosymbiont
SYYVRLQYNGEVLPFKTKIDGVTYKSGKDNNSPLKASFLAGGGAFGYKMDDIRVDVEGLYPRLSKDADVVGTSPAVVESLTAFSGLVNVYYDIAIEDMPITPYVGVGVGAACVSNPLVTEVTGDKKFGFGFAYQAKAGVSYDVTPEIKLYAGARYFGSYGANFDQTAKDDGGIKVLYSTVGAEA

SEQ ID NO: 18897 - protein, 188 aa, Wolbachia endosymbiont
SYYVRLQYNGEFLPLFTKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYSTVGAEA

SEQ ID NO: 18898 - protein, 162 aa, Wolbachia endosymbiont
SYYVRLQYNGEILPLFTKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGA

SEQ ID NO: 18899 - protein, 162 aa, Wolbachia endosymbiont
SYYVRLQYNGEILPLFTKVDGITYKKDNSDYSPLKASFIAGGGAFGYKMDDIRVDAEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSSGA

SEQ ID NO: 18900 - protein, 186 aa, Wolbachia endosymbiont
SYYVRLQYNGEVLPFKTRIDGIEYKKGTEVHDPLKASFMAGGAAYGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAEA

SEQ ID NO: 18901 - protein, 185 aa, Wolbachia endosymbiont
SYYIRLQYNGEILPLFTRIDGIKNAAGKEKDSPLKASFIAGGGAFGYKMDDIRVDVEGLYSQLSKDTTIINTSETNVADSLTAFSGLVDVYYDIAIEDMPITPYVGVGVGAAYISNPSKADAVKDQRGFGFAYQAKAGVSYDVTPEIKLYAGARYFGSYGASFDKAAKDDAEIKKVLYSTVGAEA

SEQ ID NO: 18902 - protein, 392 aa, Pseudomonas fluorescens
MKKSTIALLLLAPTVQASGLLLQEAVTANAGAAGAGDGVYTKSAAATWTNPASMAFMGEQLTTVNAMLLNLKMDYDDKSGIANGDGEATTTMPSLGVFYVRQLNDSLHLGVNFGVVGGSSIEYGSEWAGAPYLDKAFMTGVQLNPNMSYKLNENWSIALGAQISYGLLEVSTASLQTDLDTDWAYGYTAGVMHKQQDWSIGLSYRSKLEHEFAVTATSVDPAMSLPLQTELLVPAIVDLSGRHDVNSKIAILSSVQFHQWSDFEETPLYTDNLTSSVDRQWQDVWKFAVGTEYKLNNGWALKAGFSYETSPQDDPSLQWVDLPVGEQYRYSFGASTEWGDTTVDFFYEFADFGSIPVERPVGAPDNGLNTPLPDLNGTFKGHIHFVGVNLSF

SEQ ID NO: 18903 - protein, 695 aa, Pseudomonas fluorescens
MLKQPHALRYSLILALGCATTATAQEGTDQAPQSLDTLEVTATRGLDSLNVNPGAVTVVDRDAIDKQSSLGGNVGDILAKTVPGLSPSTHGLTSVAQTLRGRNLFVLIDGIPQTISLRDGLHSLNSIDPSSIERIEVIRGSNGVYGFGGTGGIINIITRKNEKGAPLYRTELNGGFSTEHIKDSEQFGLSQSVIGGKGAFDYQLRGSYEQRANFFDADGDRIPPDPNGQGGIADSREFDVLAKLGFDLDADKRLELTTSYYDIKQDTNYVLEAGVYGEQKTRAVKGDPGGKDQGTENLNVNLTYSDRQLFGDTSLGAQLYYRDYMTRFGYFATFYPGGGQSLTESERIGSRLDFETPFDVMSGAKLLWGLDTLMETTAQPLEDGRTFVPEMDQNSVAPFLQAELRLDPQWTVNAGVRYEKFWFEVDDYTTVYGADVEGGELEYSETVFNTGARYQVNDVWAATASFSQGFTVPEIGRTLRQPQQGTSLDQIRPEPQVVDNYELGTEAVWDRADLALTLFYSESELGTSLAAANANEPIPVLRSPERIYGFEAELNTYPTRDLSAGGTFTWMEGKVDSDDDGSYDTYLAGNRISPLKLTGYVEHDSTARWSNRLQAMVVGDRDRFSGNGFGQGEVESFTVLDLTSTWRTGNGDITLAINNLLNEDYFPVISQIYNFNTQYTTAPGRSVMVSYGVDW

SEQ ID NO: 18904 - protein, 280 aa, Idiomarina loihiensis
MKKWTIFLTSLILLALSLETPKCYAGDKLMSASFSSTKIYYAMKNVTASGSLYFYVTVVTPGEVSYGQYNSNARKGDTLKLISWSGSGPAPTLVLTDYRRTDTSNCPGINTRVFVCAYMTFNVTVESDNYGCPWIASFYSVSEAFGFGTYTSPTVHDSICPTIPVASFDISWSDNYVSHNKALRLQSDGSTITTTLSTYLMESGKLCDGSIFDSRGAYCRAVSDLLTFTSYGCDNAKVTVTPSRQPLTDRKLHDIVVQVNTSSREPIDSTCRFQYVLNEL

SEQ ID NO: 18905 - protein, 147 aa, Idiomarina loihiensis
STDQLRGARVGYRVTDIRLSILEDWTWLGSPKLHIEGALNNWQNSNDRSDNVFALTISPVLAWQLTDGPRPLYVEAGIGGSVLDGTRLGERRLSTRFQFEDRIGLSWQYSAYSNARLTLAYVHYSNADIDSPNDGLDFFGLTWSNTF

SEQ ID NO: 18906 - protein, 1068 aa, Idiomarina loihiensis
MQKLLKLVAFAGALIGLLSHPAAFAQVITTSSLSGTVVNESGNAVPGASVVIVHQPTGVITNATTRADGNFAIRGLRPGGPYSVTVTAEAFAANETTDIYLDIDRGANLAIRLKPEEAIKLEKYTVTASAIEQLFDPTQTGSGTYATSRELDDLPSGDRSINSLARLDPRITYNRDPYDRAISVNGMSNRYNLIQVDGVNASDPFGLNANNTAAERNVVPMDSLEALAISTSPYNARNAGFVGARINAITKSGTNEFHGALTYSFRGNSVPLPIANNDLQLVGDELDGRTYNLARFEEQTWGATLGGPIIKNRLFFYLAYEKVDEDRVAPTPTTRLDSGTVAQIVAKAQELGFEPGSAEPPAANKLTDENLLAKIDWQINANHRATFRYNTVESSRPSFPLFGSGASQNNFSFDSDWYKQKTENTSYIGQLISRWSDRLNTEFSASRSEYHSEPVSNTRQPYVEIRNIPVAGSSNTAYVAFGTEYSRHFNVLDVESDTTELFATYELSDAHTLQAGLQYDNNKVFNAYVQYSLGYYRYNSLNDFLTNAAAGGASGQYQYNFIDPDVEAAARFDEGNAGLFINDNWRVTDTLSVDVGARIDVPLLPEDVPLNQSFQSTFGVRNNYTYDGDSIVQPRVGFNWQPRFDSKRTIIRGGVGLFYGRMPRVWLSNSYSNTGFNYVSYQSNTLPPISANPDNQPTSGTSPAQQVAFLDPGFKLPSRWKANLAIERELGFWNLKASAEIEATKVKNDVFYSNINLQPTGTGPDGRELYWASYAATSRNTQLKSTAFTNKIIRLGNTDEGATRAITFSLERPQTRDGWYWKASYVNTDAEEVLFGTSSVAASNWNNRSVFNANAPEKHTSELEVKHRILFNISKEFEFVHGYPTTVSTIYEGRSGYPFSFTYSGDANGDAVSGNDLLYVPTRGDTSAVRFATPADQENFYKIVDRFGLTEGRAVAADAQRYPWVNTFDFSIKQQVKLPGWKHRLVLGLDILNLGNLLNDKWGLIRGSNQFFVKRENVATVVYDGVAKQYVYSRVSTDLANNKFNPSLGRGEPAASRWSVLLTARYEF

SEQ ID NO: 18907 - protein, 732 aa, Idiomarina loihiensis
MNARTTFSDNTKKTFSRPLLGIMISLSLSSSLYAAQAETMVVSADGGSGVEAESAWGPAPTVAAKRSATGTKTDTPIEKNPQSISVVTREEMEMRNVTSVKGAFNYTPGVLTGNRGSSDVIDALSIRGFSETNTNQYLDGLKLQGDNYSEFAIDPYFLERAELLRGPVSVLYGKSNPGGVVSLVSKRPTQETLREVQFQMGNDNLFSTGFDFGGALDDDGVYSYRLTGQARSQDAQQAMNKEKRYTIAPAFSWRPDDRTRIDLLTYFQNEPETGYYGWLPRQGTVVPITRADGSQYKLPTNFDEGEQSNKISRNTKMVGYNAEHSFNDTWTLRQNLRYADLRTDYRSIYGNGFLPATQEITRGSAVSEEKLNQLAVDTQAQAKFATGQVDHTLLLGVDYQRTRNDIDAAFGTVTPLNAINPQYGNDTAIGTPFPYHYLNKQEQTGLYAQDQMEWNRWVLTLGSRYDYATTSALNRSSSTEVKNHDQAFTWRGGLNYVFDNGVAPYFSYSESFIPNTGTTSGGQPFDPSRAKQYEAGLKYVPKERPVVLTAAVYQLTKTKNLTAEPGNVNFSVQSGEIRSRGVELEAKAALNANVNLTASYTYTDAEYTEDTQLKGKTPVQVPKHMASLWSDYTFHETALSGVTIGAGVRYVGESQGLYSTGTEQNQNFKVAGYTTVDAALKYDLGRFGLPGSTVGVNVNNLFEPHYVASCYREYACYWGAERQIVGTATFRF

SEQ ID NO: 18908 - protein, 840 aa, Idiomarina loihiensis
MKTFIVPFICLSFFFASTQSASAQLTGIVVDAQDQYPLEYASVAIYGQASKKLIAGVVTDKEGFFSISNLKSGNYYLEASFLGYQKYSVPSIVIVRNGNPQDFGVLPLQLGGESQLSEVTITAERPAVSHKIDRQVFDAKAYQSTVGGNAMDVVKNLPSVSMDGSGTLRVRGSQGFAVLINGKPTQGTASTILAQLPANALERVELITAPSAKYDPEGKGGILNIITKKGAINGTFAQVNVRGGMPSIESYDTKVASQRYGIDATVNKRTAQWNLSAGVSYQRNDKAGRREGDLFIINAPENKTTFLPSDGERSFDEVTYNGRFTAAYTPNKANAFSMGFFAGKRSKERLADIVYYDNHAVPITGSAERQYTFAYYNHNLRIRKGDFALGSFDYAHTFNNTSKITTAILYEYTFLGGPTENDNLGFPNNAIVYQKEFNTNDNPLYGTRFTIDYQWKPFSFGLLETGYQYRDLDHTGTFIYERDGVQVPEFSSAVRLKRKIHSGYVQLTGAKKKWNYAAGVRLESMNRDYTEALKSETVENIYYYDFLKLFPSASLQYQLSENTNIKTAYSKRVVRTTTLKMNSFAEREHSEVFEQGDNTLRPEFIDLIELGVTKNLKGGNAIYATAYFRHVKNAINRVNTLAYESNGAIIDTILNRVYSNVGRSNTVGIELGATVKPSKNWTHIIGMNLYNYGIEGTLNFKHRDGVARTYAIASNATVYSINLNTTVDLWENASLQGTFNYVSAANTAMGEDSRFYSPNLTFRKKFMDDRLTATLQWQNIDMGLLKSNEQRISTARAQQFFTTTNYVYEVDVVSLNLSYNFNARKNASKFIDSEFGKKEF

SEQ ID NO: 18909 - protein, 759 aa, Idiomarina loihiensis
MNTNSKKTYLSIAISSILYASTAMNANADSCTDYTVTDICEQSKYGAGEFHNIKLGDGVTAGSEDHHFVFNGEGYELYNSNANFSAQIASGTIRYTEVNNSHFTVNAHHFPDDTIYAGRAENTTLNDSLMWVATSADQTLAKGNSMVVVSTQMAMVDQIFVTTLNDGSLPFDPVTTNSRYEDTSYEMLWGMKNEAKGWDTKATSHDSVFVDASKQSIEANGHSIGATFYGRATQVVKAGGESQDTHLFDHSYSWVYAEAKLTGLTEVNDAATVYLNAAATQGAYAENVVLNGEDTTLMVRASLDNNAYATVDNLILNGGEVVFQQSSGDQYASLNIGTLSGSGSFLFNTSIAEGKGNFVTIANASGEHKVIVNDSGHEITSPDMTTLDLIHDLSGDATFTLASISGANIIEVDGGTYVYSLNTWDNSARAGGNLWYLGSGLNTGTELEPEPEEKTTPSTDAVLSMASSNQFIFDGEMQNLRFRKGDLNNNKGDGASVWGRYLTNNTRVNAAHDAAYRLQQDGFEIGADKVLEMSSGQLVLGGFTSYSNNRVKHARSGNSTVDSYSLGAYGTYFDNSGYYVDTVVKANRFKNSLNAHMTNGGSVQSDYNQNAIGGSLEAGYHYSLSNNWFVEPYVRTSYYTAQDKDIVLNNGMTANIDNNRSAKGEIGTHLGTKIDLNNGAIIRPYAKVAIEREFIKSNTVTINQVNDFNNDLSGHTAKYGLGMDINLMKQTSVYAEANYRNGTHVESPIMANIGFRINF

SEQ ID NO: 18910 - protein, 831 aa, Idiomarina loihiensis
MKNMQYKVLFLALAICTTTVKLNAQEATGHGKIVAKVIDAQTNETVPFATAVILNRKTKAVVKGAQTDINGNLLMTGLPNGAFTFKISYVGYQTMVRDSVSLSDIIREINLGTIKMKTAKGTVLNEVAITAQKSTMTMGVDKKVFSVDQSLVSEGGSASDLLQNVPSVQADIDGNVSLRGSSGVRVLIDGKPSLIAGGNVAQILQSIPASSIESVELITNPSAKYDAEGQSGIINIVLKKNKKLGLNGNVALTAGNRDNYNANTSLSFQNSKVNLYGNYSYRYGNRIGGGYNNITYLNPSFATAFADQNTDSRSNDKGHNVKAGIDYTLTDKDVISFSGGFNIRDNDKTDFININQLGAGYNPLELSRRTNTNLGSGGSYDLNLDYSHKFANPKQEITFNGSFSDGTNDNYQTYNTDIFNQNGMDVTLLPTLSRNDGKGTNRNYNIQADYTMPIGDAGKFEAGYRSQIRYADNNIFADNFNHLTGDYEVDFSLTNNFDSKDQVHALYANYQNQIKNFGYQVGLRAEDATLDTRLGMYQNSSSLSYTPGKVDYTRLYPSIYLTQKLKSEQQVQLSYSRRVNRPRPWDTNPFLDVSDPLNYRQGNPNLRPEDVHAFELSYSKFWKKITFISTAYVRQTNDVIQRVRTEPDENGITTSTPRNLTKELSSGLELIGRVDVSKAWNFTANANLYQTDINGVPEFGIVDNSGFTWNANLTNNFVLPYNITLQIKGDYRAKQVMAQGTRNAMYGIDAGAKYDFKDKKSSLSFNIRDIFNTKRWSMTTETESSIVDFKRYMQGTMGSLTYSYRFGKTTFNAKKAKKPEQQEMRSNEESF

SEQ ID NO: 18911 - protein, 963 aa, Idiomarina loihiensis
MNCRSHRLALSISVSLAVTAACAPPLMAQQTEPDATRATSTLDAVSVTGSRIKRAQVEGAQPVVTISAQQIQQEGFATVYDVLNSMNQQGSVEADTQWGSHTPNASPINLRDLGPGRTLLLVNGHRVADYPLPYGGESNFSNYSNIPSAAVERIDILTGGASAIYGSDAVAGVINVILKRDYQGDQVRLRGGTATEGGRDSFDVSWAGGRTGENWSLTYALQATKRDPLSGRDRPEMDDSDDMSYSNWTGQNRLYGFNPFTGLSLIDANTNERLAPPAGTCARFGGEFIDGQRLSYNQNTGALTNAGDYCGVARDYGDWGLVTGSEDYSAYLYGTWKFGEHTEAWATLSANRSIGRWTYDPPYAYLGPFQDAATGRSLNLIRQLTRREAGGWDRLANYNKEQSWDLSAGLRGVWADRFDWELSVGRSRYTVDEYIRTVDTARATDYFLGSSLGTAADGTPIHAINEARLYTPLSSDQYDALVAKSHNSAYSWVNQASFSVSGDVVQGWAGPIRFATVAEVAKQGYQLSPDPCANACYPVDVVDSGGGERMRSSAGLEFQIPLLSTLSANVAGRYDRYGNYRSSAAIPTDVGTQSDTTWSAGLEWRPVESLLVRSTVATSFRAPDMHYVLGEPSSTNQTVIDQYRCISSGAYLTGGCNDENNNIFYTVDVNRRGTPDLRSETGRSFTGGVVWDIAQGLSLSVDYYRIQLEEMIKDLDRDEILSAEAGCRTGTTISGGTWNNPGGAGYCDTITSRVMRNADGTIASIERGPINLAQMETSGIDASLKYRLATAGWGNFQLSLDYNNLIAYREQIYRTDSDENRRDERVRSRVRGSVHWDNGGAWDWTVYFRRIGSMRAVNWGTCERFDDGYQPSASDACLVTDTANVHLGETSKRYFGRVGPAIYWNLSTGYRITDHAKVNFYVNNVFNEVGYDHKERFYGYGFYNTTLFNPIGREVAAEYVFTF

SEQ ID NO: 18912 - protein, 1043 aa, Idiomarina loihiensis
MKSKDCIKTTVLSFCTTLLFSLFMIQTGYAQAQSKSVSGNVTSAVDGMGIPGATVAVEGTKIGAATDFDGNYKIEAKTGDVLVFTFIGFKTQKVTVGTQKTISVTLQEETSELKEVVVIGYGSQKKTLVTNAVTQVSGENLAKTNTTNALQALQGQAAGIQITSTSGQPGEGLNVVIRGVGSTAGSTPLYVVDGILTSDISYLSNSDIESISVLKDAASAAIYGSQASNGVVLVTTKKGKRGAAGQITFDQYYGVQSVARKVDLLDATEYATILNEAAVNSGKNPYFTNAQIASMGSGTNWMDKMLVDNAATKNFSFGASGGSETSVYSSSLSYLGQEGVVGGKDLSNYERYNFRFNSEHKLYKDVLTFGQNLSFAYINKNGIGVGNQYNNSLRSAYQVSPLLPMYDANGNYYDSSPNNEPWLAGQANPYALMVYNNQNESNNQKLLGNVYLQIEPVKNLTFKTTLGLDYYAGEGHSYTPIYRLSIYANTAFDKVNQNMNKGKTLTWDNLLTYKFNVADNHHFETMVGTSSINFDGTTIDATNADSFFDDLEHAWLDNTTNKDGAKIAFKGIKQQTKRMSYFGRLNYNYKETYLLNATFRVDGSSIFSKENEWGYFPSVSGGWIVSNEEFLKDSKVLNFLKLRASWGQVGNQNARAFQYLSPIKVNNTNYSFGDEEGVLTPGAYPNRLSNLDLKWETSEQIDLGFDARFLNNALNLNVDFYKKTNKDWLILAPILATAGADAPFINGGDVVNKGVEVSLSYQNKIGDFNYSVSANGAYNKNTVGQIPAEGGIIHGLPNELYDNSSEFYRAQNGYPLGYFWGYKTGGVFQNQAQIDNYKSANGVVLQPNAAPGDIIYVNTNGDDKIDATDKTSIGNPNPDFTYGFSISANYKAFDFSLMANGVAGNQIVQSYRNQSNAYGNYTTAILDRWHGEGSSNTMPRVTEDNRNFTQFSDLYIHNGDFLRINTVTLGFDLAKMKQSKPFFASQFRVYFSVLNLYTFTKYNGMDPEIGFGSSNDDQKFSSGVDVGYYPRPRTFMMGLNVKL

SEQ ID NO: 18913 - protein, 1034 aa, Idiomarina loihiensis
MNIQKSLKKKIKYNLVFLFFLNFLVSHTVSAQSTTIEGKITDAAGLSLPGVNIQEKGTKNGTSTDFEGSFKINVTSNKAVLIISYLGFQTQEVSVAGKTKVNVSLAEQSNSLNEVVVVGYGSVKKTDLTGSVSTISAATITERNTTSALEAIQGSTPGVQISSSSGRSGDGFKVVIRGNNSLVGSSPLYVVDGVPVDNIDFLNPQDISRMDVLKDASSAAIYGSRGASGVIIVTTKSGANVKPGINVTFDSSYGTKTAARMPKMMNGEEWWKFHQVAYMSATPATQTPAQLAALAGNQSPLLVSRANSGYNFDWADAVLKPGMTQNNYLNVTGRSDSGLSYNLGFGIQSDEGLIDNDSTDKYSFKLGLNHKINDKFTTGANITIARLDTELGSDLAMQDAFRLSPLMSPWAVDAQGNEQVGTLFFLPGKLTYPDGSWAINKTSTVNPLMEIANSSQTEKTWQTVGNVFFQYQPLKWLSFKTTFAGGIENTETSASYKAQTNAGVTLNGKNSASIKNFNNFNYTWDNQIDLKHTFNEVHDFSVLLLQSLYSNTDKTSYMYSNNQPFDVGSNNMGSGVQTSYNINSGYQKNTLSSYAVRVNYSFRDKYLLTASTRWDGSSVLSEGNKWQSFPSVALGWKISKESFLASSSVISDLKLRASLGYTGNDNVAPYTSQALLNQQTFYANGANVVSGWQTENLANQALTWEKTRELNFGLDFGFLRNRISGSVDVYDRLSDKLIYKQELPLETGYKNTFANVGSVSNKGVEVLLTTKNIKSEKVNWETTFTFTKNVNKLESIYNQDQVSDIGNKLILGSPLNPNYNYVYDGVWQESQAAEAATYNMLPGQAKPKDLNGDGKFNTDDRTVIGNPNPEWQGSLYSKLTVGNFDFNFSVLTSQGQTVLSTFHQNFADVSDRGRQKLAMDYFIPTNGAGIEANANNTNPRPGPVATGAGAYWTSLFAYYRDVSYVKIKNISLGYTLDSELLKKLKINNLRIYVNVLDPFVFTNFDGYDPEWAASSFGVNRPASITTQLGVSVKF

SEQ ID NO: 18914 - protein, 326 aa, Idiomarina loihiensis
MKAFAMQGLALAAMLACGTASQAQSSVQVYGLIDVALAYDKQPGKAGVTGVENGKMTTSYLGLKGSEDLGGGLSTIFALESYFRADTGSNGRFDGDGFWTRSSYVGLQGRFGSVRLGRNSVPLFISTLLFNPFGDSFGYSPSIRHYFASGTVTGDSGWSDSIAYVSPNFSGLTVNLIAAAGEGNGGPNVGGSVLYTKGPLGLTAVYQRVRKGAAIADTTTWQLGSSYDFDVVKVFAQYGQVKNVSAQPDIEYKLTDLGVAIPLGGGKVLAAYGLLDPVVGAKRETLSLGYDYNLSKRTDVYLVLMRDELDALSAGKSLAVGIRHRF

SEQ ID NO: 18915 - protein, 207 aa, Idiomarina loihiensis
MTKYRLLMASILFVSTQANAELTLSLDMFQDSGDRDTSASYSSYGDEIDSVGSVADSSGYRLRLGLGSLTKSRIELYFSQYDVDDEGVINFNKEWEFGANKIITFRQKVVNPSLGAVTPFLKVGLGMGQADTDIDFTTDLSDDTTDNIYNIHLNLGGGVSYSFSDNVAITGNLEYIYRNWQDIEAGPFTIGITDSLFRLGVGVDVSF

SEQ ID NO: 18916 - protein, 198 aa, Idiomarina loihiensis
MKQPKIPVKMLTTLTILMVFLCVGSYLLSPKWQAVRAEYQRQRDPLHQFASQQTPEAQLQALQDKIRANPQNSEQWALLGEYYLWQNDYSNSLLAYRQALQLRGENAELYAALATVLYYQASQHMTAQTRAMIDKALALDSNEITALMLLASDAFMQANYAQAIELWQKVMDLNSPRVNRTQLVESINMAKLLQRRLD

SEQ ID NO: 18917 - protein, 653 aa, Idiomarina loihiensis
MTTYGRLGKTASSALMFATLGCWVTSFSAAQATPVESSEQQPTDLARLTETSGVDPGLFLSTETGLVNSPVEIATPVTEAEIITELEVSTTSEVGMITSTDSLIESEDTFVETQVQDLAQALPEMEDSSDPTVSEPLFVDPLEAVEESDPMDQVTNVSQLRDVSPGDWAYEALRSLVERYGCIAGYPDGTFRGNRAMTRYEFAAGVNACMQQIERLIAGRTEFPTGDLESLRRLVLEFEAELATLGARVDNLEGRTALLEDNQFSTTTKIFGQAILGVQGRTENDFEFGTGTFEDEDTNVNVINNVQLSLFTQLSPRSLLLTSFQAGDGSGTGNSLRNYISLGYEGDTNNDLRLTDLNYRQLFGSNFAVIVGPEGVNPVNVFRGVNRIESAGSGSLSRFAQRNPIINIGNGSGGIGFDWQIATRLSLQGVYSASDSDDPDDGLFGGDNGNTVAGVQLVASPTDTLDLSLQYINAYTPSGLLGTGVGDDQVIRGRFVLDGSDVLLRGPMNTNAFGSGLEWRVTPKFTLGGWLGYTDSNYKAGSGDVQTFNWMAFLNLPDLFGEGNLAGLYVGQPPKITDSDLPITLNVPDFVSNGGVGDEGDQPGTTTHVELFYRWQVADNISITPGVIVIFDPGHNPDNDTIGIGAIRTTFTF

SEQ ID NO: 18918 - protein, 718 aa, Idiomarina loihiensis
MKRFLYLLILFCSLSIYSQTTISGKVLDSKGNPIFGASVYLDGTYDGTSTDEKGIFSFKTEENKSQTIVVSFISFETFTKTAEVSLLQNLTIKLKDDVNSLDAVTINAGTFKAGEKAKVTVLKPLDIVTTASALGDVFGAILTLPGTSTVDEDGRLFVRGGEAEETQIFIDGIRVFTPYSPTPNNTPTRGRYSPFLFQGITFSTGGYSAEYGQALSSVLDLTTIDKPDQEKTDISLMTLGLGVGNTQIWENNSLSVNASYINLAPYLEAFPDRNKWLKPVQSLNGEMVYRHSFKDDSMLKIYGAYSYSDLDIIQEDINFDDGFRFGLQNRNLYVNSSYKNKIGNNWRIQGGLSFTNDNSTIKIFDDVINSNENSAHFKVKLRKQFTSRFRVSFGSEYFITNFDENYTPTNQPEFNYGFNKSIFASFAETDIFFSKNLAAQIGVRGEYTNVLNEFTIAPRMSLSLKASKNSQFSLAYGMFYQNPKNDYLKFSQEFSSENTSHLIANYQHTKKNQIFRVEAYLKNYKDLIKFDTNLPNFNTNFNNNGNGYAKGIDVFWRQNQKIKNTDYWVSYSFLDTEREYRNYPIKATPNFASQHNFSFVAKHLIEDWKSQVGITYNFASGRTYTNPNEAGFLNNKTKNYNSVSLNWAYLIDAQKILYLSVNNVLGTKNVFGYNYNNTADINGNFDRQAILPNADRFFFIGFFWTISDDNKSNQLDNL

SEQ ID NO: 18919 - protein, 718 aa, Idiomarina loihiensis
MFKLHALMGGVALSALVLCAPASAQTADDAQDVIIVTGSQVELNQVFEGGQVARGARNGLLGNVDFLDSPFTTTAYTAELIENQQARGIGDVLANNPQVRLAKGFGNFQELYVVRGFPVYSDDMTLNGVYGILPRQYVAAELVERVEVFSGANAFLNGAAPGGSGVGGAFNLVPKRAGEDDLTRVTLGFEGRSHGYAALDLSRRFGAQDELGVRFNGALRDGETAIEDQDRSLNLFTLGLSYETDRIRLSADLGWQDHHIDAPRPQVTPLGAIPSVPDADVNYAQPWTYTDEQQLFGVVRAEMDFSDVVTGWLAVGARDGEEENVLANPSAGASGVTSAYRFDNARVDQVISADAGLRADVWTGEIGHRLVASVSGIHSESDNAYAFSNFAGFAGDLNDPFAAPQPAADFFVGGDLDDPGKTEEVTNSSFALADTMSLLDGRVLATLGLRWQTIDTASFDYNTGAELSAYDDDAITPALGVVYRASDAVSLYANYAESLQPGQIAPASSGGVVIVNAGEVLSPFRGEQMEAGIKYDGGNYGVTANLFELTQPNAIVVGDRFTDDGEQRTRGAELTVFGEPVEGLRLIGGATWLESEQARTQGGLNEGNAAVGVPEFQASFNAEWDASFLPGLVLEGRVIYTGEQYASADNTLEIPAWARFDAGVRYSFEAQGHPVALRARVENLLDDDYWASTGGYPGANYLVQGEPRTVRVSVSTDF

SEQ ID NO: 18920 - protein, 736 aa, Idiomarina loihiensis
MQQENFIRAIACGVALAVAPSVATAQERETEQMDTVIVTATRTEKELDSAPGSASVVTKQEIEKKEVLTFDDALKGTSGVMLSRSKGPMDTIANITLRGVPGQNRTLIMVDGITLNSPFAGSIQSNSIAPGTIERIEIVKGATSSLYGGNAMGGVVNVITKMPTKREFTLKTGFGSALEGDAPENTRRVAVSYGDVIKDKFHIYLYNDYTGTDGYVTDLVTGTPGSGTSGARPTLTSDEKATFLLGHKGENEAWQDNLTVKAGYDFNSSTKLLFTFLKSYGEYSYNDPETYMTDSSGNPYWSSSGSEYSFLGTYGANNQNIYALSLETEIASAKIKAGISYLDQDTSWYATASSTTKSPVATRSDGPGKLTSTPASALSADVQVTFPLLSWNIFTVGGAFRQSEINGKDYVLSDWTNEHSKGQLIGEARGTDRIYALFMQDEISILDNLTLYAGFRQDWWETSDGHVLASNASNVVTVGPTSFGSRSESAFSPKGAIVYTPFAGTTLKVSGGKAFRAPSNYELYRTTMMGSSTTYQCNPDLKPERSVSWDGGVSQDLWQGATVKATYFENYIKDMIYSTTTGSIREKKNAGRGESKGVEVELEQKFGKLLRLFANYTYTNAKITKNSAVPATEGKRMTDIPRTMYNAGADLEYGPAGASVIARYVGKRYGNDTNNDTARNVKGVYDSYITTDVKLRYKLTSWATASFSVNNIFDEKYFSSTKSPGRSCYGEVTLQY

SEQ ID NO: 18921 - protein, 1039 aa, Idiomarina loihiensis
MKAITQPVHSAVEQQTHTVTGTVTDATGPVIGASVIEKGNTTNGTITDLDGKFTLNVAPGATLVISYIGYKTIEIEASKKPLNIVMAEDSKVLNEVVVTALGIKRERKALGYGVDEVKGESLTKAKETNVINSMAGRVPGLVVSQTAGGPSGSTRVILRGSTEMTGNNQPLYVIDGVPLDNTNYGSAGTSGGFDLGDGISSINPDDIENMSVLKGPAASALYGSRASHGVILITTKKANGKEKFSVEYNGTLTFDTQLAKWNDIQQVYGMGSNGTYSIDAISNTNKSWGPKADGSNMLTYFDGVARPYLIIPDNTSGFFQTGLTATNTAIISANSGHTGVRFTYTDMRNKDIVPQSNMSRDIFNLRTNTSLGKVDVDFSANYTREAVKNRPALGDSKSNIGKNLMTLATTYDQEWLKNYQDENGEYSNWNGMDPYNVNPYWDVYKNSNNSKKDQFRFNGKAIWNINKHLKLQGTIGAELNYFIFEDFKAPTTPGYEAGYLQNSNFRNRMYNFELLALYNNTWGDFDFNATLGGNVYKVNNQTTVTTAQDMQIRDVVALMSFNETSLEQNSYRKQINSVYGAVNVGWKHLVYLDATLRGDQSSTLPIGNNVYVYPSFSGSFVFSELLKQSDLMPYGKFRLSWAQVGSDTDPYQLGLVYSKSKFTYPGYTIGYINNSTMPNKNLKPTKTNSFELGLEMKFLKNRIGLDFTYYTQNSKNQIMGMASSWTSGYNYRLINAGEIENKGIEIALNTRPIELKDFSWDLNLNFSKNSNKVKKLVDGMDMFELEKAAWLDVQVAAKVGENFGAIVGPDFKRNENGDILIDPQTGLPQYDKSNHVLGNASWDWTGGLGTTLTYKNLSLSALFDIKVGADLYSMSARASYESGKSKETLAGREEWYRSEEQRQAAGIAKGSPDWTPTGGFIAPGVIDNGDGTYRPNDIYINPEDYWMSVCRNAPSMFIYDNSYIKCREITLSYRVPQSWLKNVVKGLTVSFVARNPFIVWKNIPNIDPDSNYNNTTGMGLEYGSLPSRRSYGFNVNLKF

SEQ ID NO: 18922 - protein, 229 aa, Idiomarina loihiensis
MKLKALLLASTVALVAATGAKAADAVIEQEPVPVVVAPTFTWSGAYIGGQIGYGWGKSDFSGDVYSFGNVKPDGFLGGIYAGYNFDLGNSIVLGIDGDVTYNDVSKDIDVYSGDLAVGDFETKLRWSGAVRARVGYAVDRFMPYLAGGVAFGNIKNSGSIDGIGSFSESKTLTGWTAGAGVDYAATDNLIVRLEYRYTDYGDKDIEFGGLNVNQDFKTNEVRLGVAYKF

SEQ ID NO: 18923 - protein, 699 aa, Idiomarina loihiensis
MFMRSTLIPSTFILSTLLLPAVVLAEDTIIVERNRSQTDSYQATTSVTANRSPANIIDTPQNVTVVTHPVLEDYDVTNLGEALYFVSGITQSNTLGGTQDALIKRGFGNNRDGSILHDGIRSIQARNFTPTSERVEVLKGPSSMLYGMNEPGGLINVISKKPQLDPHVHLEANASSFKGGGGQLDVTGPLGESGFAGRLIIDHQETDYWRNFGRNRQTVVAPSLDWYGENTTVHLAWERMEYLVPFDRGTVIDPRTGKPVDTPRDRRFDESYNATRGDQDTVTFSINHDLNEFWSTQLNYAFSRNSYSDNQARATAFNAETGVLTRQSDATANAKSHSQAVQWVVNGDLDWGFTHHQLMFGIDYEARRVFRGDMIRGSKNNGFNVYDPIYGTLPPSTAVSAADSDQRENIDSRALFIQDSMRLNEHWLLLGGLRYDSFDVMAGKGRPFKKNTDSSDSRLVPRAGVVYNLNDWSSLYVSYTESFKPNVSIATAIDALPPEYGKSWEAGYKIDINNRVTGTLAVYDIHKRNIMVSELVDGETVTRTAGKARSRGLELDMAGKVTDSLSLIGSYAYTDARLTEDPDNNGNDLPNVARHTAALFLSRDFGSTSLISGDEVKAGIGARYVGKRAGDAANSFWLDNYTVADAFIAWKMPLSGYQLKWQLNVKNLFDKTYYPSSANNLRIAIGEPRQVVLQGSIDF

SEQ ID NO: 18924 - protein, 1051 aa, Idiomarina loihiensis
MFNSTFKRTALAAAIAMTVSGAALAQDTSSSIRGVVTAESGSIISGATIQLRDERTGSVKTLTTNAQGTFSSRGLPVGGPYTLMVKGPNGQSQVIENVYLTLGDSETVNVVLEPQDIETISVTGAAPTNALYGSNSPAANFNLADLQDAPAANRDLKDVVRIDPRIYINETNAGDIQCGGANPRFNSLTVDGVRMNDNFGLNSSGYPTERMPFSYDAIEQVAVEFAPFDVQYGGFTACNINAVTKSGDNEMFGGVFFDYTNDSLQGSKLEGDSINVGAFNEKRYGFNVGGAILEDKLFFFTSYEKLEGSDTFDRGPEGTGVASPVLGVSAADAERIRQIAINNYNYDPGTFPASLPVEDEKFLAKLDWYINDAHRASFTYNYNDGFSIAESDGDADELEFSNHFYERGSKFTSYVGEFFSDWTDNFSTEVRVGYSELDARVNPLGGTEFGEVQIGVNDATVYLGADDSRHANKLKYDTTFFKLKGTYLAGDHIISAGIEQEKYDVYNLFVQEAEGEYRFGSIDDFEAGTPSRVIYESAAGTNNPTDAAAEFSYAVNTAYVQDEYYYAPMDITFTYGLRYDWYTSSDNPVNNPLVEDLYGFSNQQNMDGQDLLQPRFGFNWFVSPQLEVRGGVGLYSGGNPNVWISNNYSNNGVTQYEANLFGDFFAGGNTLFNIPHTGEGRPIYDIPQNLFDEVANANGEGPINTMDPNFELPNEWKYALGATYTFDNDYVLLVDFLHTEKKDAAVIYNLGLEQTGTAPDGRPIFSELSTDGRDQGDDFLLTNVKGDSGSQTTVSLALNKSYDFGLDWSFAYAYNRAKDVNPMTSSVAFSNYTNLATANPQNPGVSTSNYEIPHRFTFRATYTSEIMGYENTMTLFATRNEGRPYSFTMSDGAFGDVAYQGRQLLYVPTGIDDPNFVAGMDGDGNPFDSQAFFDFINSQGLGEYAGGIAPRNEFNSKWWTKVDLRVEQQLPAFSNDHEASAFFVVENLGNLLNDDWGVLYEASFPRAVTVADVSINDQGQYVFESFRDPRVQSRAGAPSLWSVRVGFEYKF

SEQ ID NO: 18925 - protein, 904 aa, Idiomarina loihiensis
MKNQVRLRSRAMRAFAASTILSTVVLPAAAYAAEVTEVAAQPAIETTPAEEQVQPEGFGDIVVTATRQAQSIQKVPISIQALNADTLQQRQVKGLTDFATLMPSVSFAGIGPGRNTPYFRGIVPAGGARESVGYYIDDIPITGTGLPDIHVYDVERVEGLSGPQGTLYGAGSLAGTIRFITNKPKFERFEYGYDAEVNKYGKGDFGGQYQSYINVPVASNLAVRAMGYYRRDGGYVDNTPNNGKFNDGSSSTLSLGDNNPDTFYTLDNSDIAQDDYNSIEEYGGRLQVLWEMAPGWEIASQLTAQQQIANGYFGFDPRVGDLEVHDFDTTQQNDKWYQAALTVHGHIGDWDVVSSTGYYQRQINLLNDYTYYTVTYDRFGAGYENYLQFFDKNGCTGSGDAMKCTSLIDPTQFYRGLRNENKFTQELRFTTPKSWPFDVTFGGFYHRQKNEVNNDYSIHGLDQIAGYTQSGGGDSNPEGFGIPTTAGGTMVVGSPAVKRDAFYMSEQNQYWNDYALFAEGHYNITPTLKLTGGIRYFWTNFRVLGFAGVAASARNTITSLYVPTGEYGCPVPLPAERLQCLNSNFAAADGVGRYKEEGETHKVALNWQFEPSKMVYFNYSTGFRPGGFNRPLRIRGVGVATVPSFESERLTNFELGFKTTWNNMFRFNASLYYENWDNIQYSVVIAGTQGAGMTGNAGKARVYGVEFDADLKLGKFTISTNGAYNNAALKGNFCNFKVDTSTLAITQLATCTPGATFGSPAVAEVAATDGTRLPRQPRFKGTTSVRYDTQLGDMDLYLQGAALYQTNATQNLNVYNNNLLVCPDIADEATDAGRSCATPGFVSFDFSGGIKKDNWTLDLFIQNAFDKRGELTRNTFCSIQFCSDSSRTFTIKPQFFGMRWGQKF

SEQ ID NO: 18926 - protein, 889 aa, Idiomarina loihiensis
MKLNALANSVRLAIIYTPVIITGLITSAQAADPCKSTDSMTYVCSGSETSGIDLAGSSLNISTVPGFGVDTTEANAIKLTNSGGDLILKDENQSQIIGGDAGITAINDSSATNMMISTSGHVNGGSNAVYAQNSGAGATVITTTGTIKSGNVGINAINDSDTKGLTIITDNEFGVGKDAINATNNGTGATVITTTGTINSGNVGINAVNGSHTPGLTIATDSTFGVGVDAINATNNGTGGTTVTTSGNISSGRHGIYVNNDTTATDITINSSSDIGVGGDGINTTNNGSGMTEINISGTVSGGHGIYAVNGGNATDMAIDVSGDVSSWATGIYAENNGGGKTSITNTGEIRAPSYGNAITTKGRSNSITNAGRIIGKVQLGNEGNTFTNAIAGTWDMSGDTSDFGTGSNSLVNSGILITASGSFSDDVQTTTLSNVGTLTNSGSLTMANERAGDTTVIDGNYIGKGGTLTFDTVLGDDNAVTDKLIINGNTSGTSLVLVNNIGGSGAQTLNGIEIISVNGQSDGVFTQDGRIAAGAYDYSLVRGKGINSSNWYLNSWQDQGDTAQVLRPESSAYATNLAASNNLFTMRLHDLIGETQYTDTLTGEKRATSMWMRNEGGHNRSRDSSGQLKTQANRYVLQIGGDIAQWSSNGDDLYHLGMMAGYANSKSKTVSSINGYRADGSVNGYSTGVYGTWNANYVDKTGAYVGTWAQYNWFKNRVSGEGISSESYDSQGITAAVESGYIYHLGQSEDGLQSYFIQPRAMFIWMGVKADKHTELNGTEVSGEGDGNVQTSLGAKTYISNKNKAENDKGSDLQPFAEVNWIHNTQYFASRMDGVGVKQDGTKNIAELKMGVEALLNKQFSLWGNIAQQIGDKGYSDTSATLGGKYSF

SEQ ID NO: 18927 - protein, 706 aa, Idiomarina loihiensis
MDQSFKLRYPALFIALSVSLSGHALAEQGDEAEMEVITISGKGLISYVSASASKTDMPIIETPSSISVLTEKRITDLGAENVQDAIGYVAGVYNGPYGVDTRGDWAQIRGVSPLQYQDGLQMMFGNYNNVRTNPYMLQQIEILKGPSSVLYGQGSTGGIINMVTKRPEAEQQGEIWAQVGNYDRKQLAGDVTGSLNDDESVQYRLTGLYRDSETQTDYVDNNSYFIAPAITWYATDTTKLTLLANLQKNESGSSTQFFPHEGTILPAPNGQISSSRFVSEPGWDQYDTEQKSVTLLLEQELNDYLSLHWTSRYVDSKATYRTMFAWPPKFQDDGRSILRNVSMSDSSAQALTSDLRLQAEFDTGSVEHNLTFGIDYQDVDTDTDRLYIPGAGGLLDLYDPKYGLNLASLPTGADIPDTPGESNNQLGIYLQDSIKFGNFIVSGALRHDRVESRTTKDGKQDQSATTGRLGLMYSFDSGIAPYVSYAQSFQPIYGSNQVGTPFKPQEGEQYELGIKYQPSGSEHLFTAAIFDITDKNRKQSAGPDLTLQLGEVQIQGLELEAQLEWDEIDVYASYAYTDSEKHTNKVGEVDAKLAAMPEHMLSTWVTYRPQSFWHGFKAGLGFRYVGETSDGSVDVFMPDGTQLHNALNTEAYHLFDMMLGYEFSDFDLSLNIDNLADETVITSCLARGDCFYGQRRTITANVRYKF

SEQ ID NO: 18928 - protein, 730 aa, Idiomarina loihiensis
MKARKNNRKKAQWLLPVLMVVVPPVLSAEPATINDSEKAKAADVMVVKADRSEANVNLAGAGMTTDEVEIGPLGKRARLDTPYSTTTVTETMIANQQAKNVNDLLKYSASSQMQARGGIDVGRPQSRGMQGDVLANSRLDGLNIISTTAFPVEMLERLDVINSLTGALYGPASPAGQFNFTQKRPTAQTLNRFTVGYSGKGAAMGHADLGGHVGDENQFGYRINLLHDEGEGSISNSTLRRQLASVAFDWNLSPDTVLEVNASEYRFRKMGYAGGFSYGPTIQLPSAPDVTKQGYGQSFAGLDLVTKTTSTRLKHYFNNNWYASGGVGYQTADRGMRSLSNAITNNQGTVSTSLTQPYSAGRFKVLSNTLQLNGHIDTNGPSHDVVFSTTGYQWTIYNGLGNSRRFPLGNSTIDSPRHYTDPSDGRFYLGSGRYKSSRTSQQAITAGDTITFNDRWSAMGVVSQSWITSRSFGSDGGVTRDTGTSPTVSLMYKPLSNVMTYVAYADSLEQGGTAPTDDYVVNKGQTLKPYRSTQYEAGVKSQWDGLNLNAAIFRLERPFAYVAADNVFKEQGNQVNTGLELMADGEVLSGLHLYGSMTLLDPKLKDTALAATRDKRVVGVPKFQANLLTEYSHPSAPNLVYIANLHYTGKRAANDTNTSWADSYVTLDLGTRYGFKLYDKPAAFRVALNNVTNERYWASIFPGSTDGINGGANAFVGDPREIRASLTVDW

SEQ ID NO: 18929 - protein, 690 aa, Idiomarina loihiensis
MNKRCLLTILMGGCAAMGAFAQQHATGKKTEMSVDLNPVVVTGTGTHQRLKNTPAPVEVVTANEIKKAGITDFQQAMTMLVPSLSFSTNSMGSYLMMNGLSNKYVLILINGRKLTGDTSNNIDLSRIDMSRVKRIEVLDGAGSSLYGSDAIAGVINIITNEPKELMQVTSTTRYEDHRQLTQMVNADIATEKFGSYTSYKHEQSAGWQNSDLAYVTDKKGNVSTVPTVSATSNGFHSNLVNQKFTFEPTEKLSFYANGGYYWKLTDRPVYTADIDGGSKYDLHYESYNFGLGGRYKINKRSSIQLDLMNDNYMQNYKYTVADDKNKIAIGDYAKTKEQHFYDAELKGIFNFAKNNMTVLGVDYRSESLDRPSARVDKSVYTASAYAQHEIKLWNCLTGIAGVRYDYHELAGGRFTPKVAVMYSVGAFNIRGTYSTGYRAPGLDELYYYMNKGKTITQGNKDLKAEHSNYYSVNLEYNTNRLNVSVTGYLNYIDDMINSTTYRLVDLPNGEELRAQAQKEFNLTDSETKALANYKLYGNLDKGVVRGFEVNAATNLGAGFSLNGNYAYAYARGKSVDGIWGNIDRSVRHTGTVAGNYTHAWNDYMLNVNINGRFQSKRFHPGHSYGDAPGYGVWNLNVKHSLTGFQHLGLDFGMGLDNIFNKRDTRPNGVNYALLSPGRMAYVSLTLRFKK

SEQ ID NO: 18930 - protein, 215 aa, Idiomarina loihiensis
MKIIMIKRTICLVYPLFCLASPTWAEESPWTYRIGMTNIAFDASAKVYLNGQRVPGGSADASDNNALTFDFGYAINDQWNVRAIVGIPPTTKVTGAGTLPGIQLGKITYAPTVLTLNYNLPALGPVRPHIGAGVNYTRILESRDANLKSFDADHAWSPALHVGADIDVNRGWFVSIDIRKLYLKTDASGYLGPQEAKARVTLDPLLTSIAIGRQF

SEQ ID NO: 18931 - protein, 333 aa, Idiomarina loihiensis
MKKTILASAIAAATFSGAAMAQSTLSASELAAKMDSMPTVYGNIQYAITHTNVDGGGSEVKHFDNGTTLGVKHDHEVAPGITGFFKLELEGINADDKSGSNGIDGLDEAYIGIKGDSFGQVWVGSDDSMYESAIDEIYNFHEVGSDIQGNYDTGEGDLIQYLSPSFSGLTFGAAVQFNGDNDAKDGDKSFPYQLAAMYEVDALELAFAIDSNDNGNGNNENTYGLRASYNLDNLRLTGSYETRKDVADIFGVMGVYTMGKNQFALSYQLEDNDESGDKNDTIILQALHNLSDHMYVYVEGYLSNADEEVYSVENEPGTGDEQSIAAIGAVYYF

SEQ ID NO: 18932 - protein, 794 aa, Idiomarina loihiensis
MLYRRTLLLLLLSTLFFSTFAQNNATISGQVKDGTETIIGATVTIKGTKNGVITDISGRYEIKGITPGTYTVIVSYIGYLKSSQSVTLSAGQQKTLNFSLSKDPQQLDNVSIDGKTKNQEVKESGFAVNAIETKKFANTTADLNQILNRSTGVRIREQGGLGSDFKFSINGLSGKQVKFFIDGIPIEVMGSAMSLNNIPVNLAERLEVYKGVVPVTLGADAMGGAVNVITNQKVSNYLDLSHSYGSFSTNRSALTGQFVDQKTGLIFKGSGFFNSSANNYKMKDVEILQGGVRDGDQIVDLNGAEFVSTDIRRFHDNYMSASGQAEIGVVNKKWADVLFIGGGYNESTQDLQTGFEQKIVYGKVRKTSSSANGTIRYKKNDIFTEGLNLSAFASRTKDESKTTDTLLRQYYWDGTWTVKSSPEMGSLKQINNIARPRTYAMANMSYLINNEHSLNLNYTFDHLKNKNYNQYFASRDSMPGLMKKQIVGLAYQQNLLDQRLSNTVFAKYYRLGLERPKLISGSYSLLDTTFSNWGYGVASRYKVTQNFGLKASYEHAYRLQEAEEMFGDGLNLQPNPDLKPERSDNINIGAYYSFRLDRHSFFIEASGFYRNAKDFIYPVPDLRSQLLKNENKSDVLITGFESELRYAYSELLSLNLNLTYQNAVNKTKTGSTESMVPEYTYNNKIPNQPFLFGNADFGIGKDNLLGKDTRLQFNWFTQYINWFYLTWENAGNPNGKSDIPTQFIHNASLSYSMEKGKYNLSLECRNLTDNLSYDNFKLQKPSRSFSVKFRYFIQ

SEQ ID NO: 18933 - protein, 150 aa, Idiomarina loihiensis
MKYQQLENLESGWKWKYLVKKHREGELITRYIEASAAQEAVDVLLSLENEPVLVNGWIDKHMNPELVNRMKQTIRARRKRHFNAEHQHTRKKSIDLEFIVWQRLAGLAQRRGKTLSETIVQLIEDAENKEKYANKMSSLKQDLQALLGKE

SEQ ID NO: 18934 - protein, 572 aa, Idiomarina loihiensis
MNGVRVMLLVIALIMGGVMQGRLLAAGNDDIVAISASELEATDATDVAELLNRIPGVKASESSVSIRGSSNVKVLLDGRPINDPTSHSGSVKWSMISLSGIEKIVIHKGRGSVSYGDNTEGGVIVITSKKASRIGGMVGVGAGNNGEKHADINLQGRFDRFAANLTAGAKGYDGFTVNDDKREYRAGLRLDYAPLEGTSLFLSGDYSTQEKGMRGYPGSRTPNARMGYDDWSLLFGVSRNTLDGRAWFRKTLTQNSDSDRDFFSGLEVLSAGMSVDGPVSLPLAGSLKAGFGYEWQSASGSGFGAKEERRGWLHLTRLFRQKDGPWSADVGIRENIYSAFHNTLNPEVKVAWKRKPWRVELTAGETNNLPTFRQRYNETSTTRPNPDLEMEQALNTGCSVSFAPSEKLSAELSFFHRDITDRITYVRASDNTGKYENFGEVIYQGVEASLSWKPSPWIEFTPSYLYLHARNEETGLWLPATAFHTVSGELLLKPAAGLSIRTDVKYTGKVFARTDNTETIAGYLVAALRVDYRTGAAQFFVDIDNLFDIEYLYADGYDAPPREWEIGMNYTF

SEQ ID NO: 18935 - protein, 425 aa, Idiomarina loihiensis
MNKFHKTLIATAVGLLSAQASAAGFQLNSQSATGIGRAMAGDAVIADNASVLSRNPAAMALFDETALSLGVVYADIDVSVSDVEGNYGGKDVAFGSEHNAAEAKVIPNFYYINPINDKMAFGVAVFSNYGTGTDLGDLANRTPTISGNAVPLPPPVDLLGNTEVVTINFNTSMSYRVNDQFSFGFGVDAVYGSGTLTRTNEQLGSLVDVDADGWALGGIVGVVYEVNPDNRFGLSYRISPKLTAKGDVNYLYTEYNEIDIPIADIAQFAGFHQLTDKFAVHYTAQWTNWSAFDKIVVKDGANGVDQADLKEYHWKDSWFLSLGATYNLTQDWTLRAGVATDQGVVNQHSSLSIPDSDRTWYTAGVSYDLDAKSSVDLGIAFVRGEDVTVLENSNLLAQVPGYNSEISAQTRSNAVYYSVQYNYSF

SEQ ID NO: 18936 - protein, 296 aa, Idiomarina loihiensis
MIMKKTLLAAGAALALSSSFTVNAAENNKPEYVSDWWHQSVNVVGSYHTRFGPQIRNDTYLEYEAFAKKDWFDFYGYMDAPVFFGGNTDAKGIWNHGSPLFMEIEPRFSIDKLTGTSLAFGPFKEWYFANNYIYDMGRNASGRQSTWYMGLGTDIETGLPMSLSMNVYAKYQWQNYGAANENEWDGYRFKVKYFVPLTQLWGGNLSYIGFTNFDWGSDLGDNDFRDLNGRKARTNDSIASSHILALNYDHWHYSVVARYWHNGGQWNDDASLNFGNGDFSVRSTGWGGYLVVGYNF

SEQ ID NO: 18937 - protein, 841 aa, Idiomarina loihiensis
MRRFPGHPVLSPLALALRLSWAGLALSVASLPAVAEEAARRSFEVPAGNLAQALGSYAQQAAVSLAFTPEALAGLQSNGLHGLYSVDSGFAVLLAGSGYRVERSDNGYRLVAEPQAAVSSEAMELGVTTVAGQGMGQSTENTGSYAPGLISVGSKTPTSLRQTPQSVSTVTRQLIEDQQLTDINQAMKVTPGIVTQSTTFRTQDFISRGFSIQNLQIDGAAPQALGTAMGSFYSSNIFELAEFDHIEVLRGTAALYGGSGDPGGIINMVRKRPTSFNQLKLTLSAGSWDNYRQEFDLSGPLGWDGRVRGRLVMSNTDRQYFTDNRATERPLVYGVLEADVTDDTMLTFGARYNKSHETGSNSAVPRYSNGADLNLPRHTGLTKNWAYLDATAREYFAKVDHRFNDDWKLNLSYTNTWDLGLFKTATTLNAVDPVTNTGATWYGTSTRQENEQHLYDGNVSGHFQAFGLDHEVVFGADYQKIDSRWLGTAPYAASGAPANVFDPDSSAFDDPGNGRDYKRDYSPNSQRQYGLYGSLRLQLAEPLHLIVGARAQRFHFWQTYTNNLTSPASISSPEQRIGTKVTPFGGLVYDLDDQWSTYVSYSEIYKPQSSRISGPAQSGSPLEPMTGKTYETGLKGELFNGALNASVALYYSTRENEAVQDPNFLATNAGFSGSCCYVSNGKVVSKGIDMELSGELLPDWMLVGGYTFNLNRNRSADAPLSTVMPKHLFKLYSTYRLPGILSDFKVGGGVQVQSATYMSGTVNRYDSSGALVERNVPFDFDQSGYAIWNALVEYRVDDHWNVTLNGNNLFDKKYYETVGTSTYGNYYGEPRNFMVTLRGTY

SEQ ID NO: 18938 - protein, 901 aa, Idiomarina loihiensis
MNHRSLRPAARYGVLPSAIAAALVSALVPAIAGAQEADASKNPTTLDRIEVTGSRIRQANLETSQPVVTMSRAEIQKQGFTSVADIVQNITATGSPAISRADALASGEDVGGQYVDLRNLGPQRTLVLIDGKRMGISSTGYSDLASIPSSIVERIEVLTDGASALYGSDAIAGVVNIITRKRFDGLEGSAYIGQYGQGDGNKEVYNFVIGQTGERGSVTLGAEYSKEDPVFARDRDFTRYPNGRAHPTPDLGGPDGSVRSNGWSGINQWGTLFDADGNAWTANRGTTDTSKLSNFHPTNGLTDQANANEQMYLSTGLERRSVFANAEFDITDNLRAKADILYTDREATQQIAGYPFRSTGFSDRYAGDLRLKADSAFNPLGEDADFYRRGWEVPRQTKSELTTYRFSGGLEGSFELAGRTWDWDAGYLYNQNKGVKTGTGNLFLPNAEKALGPSFIDANGVARCGTAAAPIAGCLAWNPLLGPDVNGPGSLNNKDLQKFLYLPTHDTSTTKTEVYSLNLSGTLATLPAGDLGLAVGYEHRKESAHYSPDALLQSGLSTDLAGSETQGGYSLDEFYAELAVPVLSDVAFAKELSFNIAGRYSDYNTFGDTTNGKFSLKWKPFDDLLIRGTYATGFRAPTVADLYGGISESFDNYTDPCDSLFGSAVRNPQVAARCVSAVPANFRQVASGGKPATGPNAQSDNPFLSGSNSQLTPETSKSTSIGFVYSPSWFGGFDIGLDWWKIKIDDVIAAETVTSILNNCYVLGINSACNRFVRGDDGQVVGVTRNLINAGYQETAGYDLNLSYRLADTRFGNFSFNWKTTYVDYLEYKRDNESTTPVEQRTGWVADGLSNFRVRSNFNADWSWGDFGASWGIRYYAGLKEECAYDLDAGKECNNPNYRSS

SEQ ID NO: 18939 - protein, 892 aa, Idiomarina loihiensis
MITPRLATLLLLSTALSMPALAQAQEATPSATAETVAPQDDTGTAADAAPQEQAPEISVPGGEIIVTGQRERNVQRAAAQVVSVLGTAEIARTGEGNIAGALGRVTGLSVVGNGYVYVRGLGDRYSLALLNGSPLPSPEPLKRVVPLDLFPSSIIASSLVQKSYSVNYPGEFGGGVVNLTTKAVPQDAFIQVGGGISADTETTNQLGYTYYGSSTDWTGFDNGQRDYTSALKSFLASGDRISGGTVDANALAQGIVNTRNGLIQKIPNMPPNWTASLSGGKSFDLGGATLGLIATAGYSNKWTSRDAINQISTSPDVGDLFSDYRRVTTDNRVVVNGMLGVGLEFGKNRIRWTNLYIRDTLKHTRLGLGRNVNSNAEADHQVQDTAWYERQLIDTQVVAELKPLDGLSVDLRGAYANSQREAPYELSFDYVRSNSSADPYGDYFVNRLNNGNGGDATVSFSDLNENLWSGGVDVGYKVIPTVKVTAGYAYGDTRRTSSRRDFQFQAPSDFPSGVGMFRPDYLLSDAVIKAYNIKLVETNEGVPAFLATLRNHAGYAKIEAELLSGLQLDAGVRYETAKLRVSPIQVFNTPGSNAAPTNLDNDYWLPAATLTWEVRDNMQVRLNASKTIARPQFRELVYQFYFDPDTNRTYRGNPNLKDSTLTNAEARFEWYFARDQRFSLSGFYKQIKNPIESFVAGEDFTTSFANAPKADLYGAEVELQKYFDLADWGGMFASRRFTSIVNYTYTKSKLRVKEGDTTSYYLAASSNALEYFRDGASLTGQSEHIANVQFGLEDTDKLSQQTLLLSYASKRVTSRGLVNTGQPDIYEDPGLRIDFVARQGFDLFGKELELKFEARNLTGRKHIEYQQVAGNRIDVNTYDVGRTFSLSASLKF

SEQ ID NO: 18940 - protein, 378 aa, Neisseria meningitidis
MRKKLTALVLSALPLAAVADVSLYGEIKAGVEGRNIQLQLTEPLQNIQQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNQPPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAA

SEQ ID NO: 18941 - protein, 291 aa, Neisseria meningitidis
ETSRSVEHNRGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGKYNSESYHAGFNYKNGGFFVQYGGAYKRHVRVDENVNIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTA

SEQ ID NO: 18942 - protein, 334 aa, Neisseria meningitidis
ETGQTKVKTTTTTEKSHTVTQIADFGSRIGFKGHENLGNGLNAIWKVEQKTSVAGTDKGWGNRQAYIGLETTAGTFRAGKMSTQLDEMDKTDAWEYNNNALGLGIFTRTGQKIVSVRYDSPVFAGFSANVQFTPRDNAVNTVRGVGNPTSGRDDAAKDNAGYYAGLNYENSGFFAQYGFGYKKSAYVATNPVTGAQSSKSGQAHRIEAGYDANNLFVSGGYQYTNGWDSQESYHAALTGDAYNASADRSAGLKTHELAVTGAYKFGNVTPKVSYAHGFKTAGKHLSDAEKKQTQYDQVIVGADYDFSKRTTAFAQAGWLKSGHKETYRVETTAG

SEQ ID NO: 18943 - protein, 322 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTEDVLGLGTIGRVESREISVRYDSPVFAGFSGSVQYVPRDNANDVDKYKHTKSSRESYHAGLKYENAGFFGQYAGSFAKYADLKDNAERVAVGTTGAHPVKDYQVHRVVAGYDANDLYVSVAGQYEAAKNNDGTANQGKKHEQTQVAATAAYRFGNVTPRVSYAHGFKAKVNGKKAARYQYDQVIVGADYDFSKRTSALVSAGWLKEGKGVNKTEKTASM

SEQ ID NO: 18944 - protein, 323 aa, Neisseria meningitidis
  misc_feature (156)..(156): Xaa can be any naturally occurring amino acid
EVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTGDVLGLGTIGRVESREISVRYDSPVFAGFSGSVQYVPRDNANDKDKYTHKQSXRESYHAGLKYENAGFFGQYAGSFAKYADLNKDAERVAVNTPNAHAVKDYQVHRVVAGYDANDLYVSVAGQHEAAKNNMVGSTDIGKKHEQTQVAATAAYRFGNVTPRVSYAHGFKAKVNGKKAARYQYDQVIVGVDYDFSKRTSALVSAGWLQEAKNKNKTEKTASM

SEQ ID NO: 18945 - protein, 283 aa, Anaplasma marginale
MNYRELFTGGLSAATVCACSLLVSGPVVASPMGHESVSEGSGVMGGSFYVSTAYSPAFPSVTSFDIRESGKETSYVKGYDKSIATIDVSAHENFSRSSYSFAFSKNLLTSFDGAVGYSLGGARVELEASYRRFATLADGQYAKSGAEALAAVSREAALTATNYFVVKVDEIINTSVMLNGCYDVLHTDLPVSPYVCAGIGASFVDISKQVTAKLAYRGKGGISYQFTPEISLVAGGFYHGLFDESYKDIPAHNSVNFPGEAKASIKAHVADYGFNLGARFLFS

SEQ ID NO: 18946 - protein, 282 aa, Anaplasma marginale
MNYRELFTGGLSAATVCACSLLVSGAVVASPMSHEVASEGGVMGGSFYVGAAYSPAFPSVTSFDMRESSKETSYVRGYGKSIATIDVSVPANFSKSGYNFAFSKNLITSFDGAVGYSLGGARVELEASYRRFATLADGQYAKSGAESLAAITRDANITETNYFVVKIDEITNTSVMLNGCYDVLHTDLPVSPYVCAGIGASFVDISKQVTTKLAYRGKVGISYQFTPEISLVAGGFYHGLFDESYKDIPAHNSVKFSGEAKASVKAHIADYGFNLGARFLFS

SEQ ID NO: 18947 - protein, 921 aa, Haemophilus influenzae
MKKAIKLNLITLGLINTIGMTITQAQAEETLGQIDVVEKVISNDKKPFTEAKAKSTRENVFKETQTIDQVIRSIPGAFTQQDKGSGVVSVNIRGENGLGRVNTMVDGVTQTFYSTALDSGQSGGSSQFGAAIDPNFIAGVDVNKSNFSGSSGINALAGSANFRTLGVNDVITDDKPFGIILKGMTGSNATKSNFMTMAAGRKWLDNGGYVGVVYGYSQREVSQDYRIGGGERLASLGQDILAKEKEAYFRNAGYVLNQAGQWIPDLNKNHWSCNHPTEPKLADPRKIGDFTPECKWYNNNSERKEILKQLIQEKKDPSEIEKLQKGDDGIEKTDKSFEDNKEQYSVAPIEPGSLQSRSRSHLLKFEYSDDHHTLGAQIRTLDNKIGSRKIENRNYQVNYNFNNNSYLDLNLMAAHNIGKTIYPKGGFFAGWRVADKLITKNVANIVDINNSHTFLLPKEIDLKTTLGFNYFTNEYSKNRFPEELSLFYVNESHDQGLFSYSQKGRYSGTRGLLPQRSVILQPSGKQKFKTVYFDTALSKGIYHLNYSVNFTHYAFNGEYVGYENTEGKINEPILHKSGHKKAFNHSATLSAELSDYFMPFFTYSRTHRMPNIQEMFFSQVSDAGVNTALKPEQSDTYQLGFNTYKKGLFTQDDVLGIKLVGYRSFIKNYIHNVYGDWSKDGVTPIWATANGFRLTIAHQNYQPIVKKSGAELELNYDMGRFFANFSYAYQRTNQPTNYADASSRPNNASKGDILKQGYGLSRITMLPKDYGRLELGTRWFDQKLTLGIAARYYGKSKRATTQEEYINGSRYEKNTTRDRIYYAIKKTEEIKKQPIILDLHVSYEPIKDLIIKAEVQNLLDKRYVDPLDAGNDAASQRYYSSLNDSLACKINESTCNDGSDKTVLYNFARGRTYILSLNYKF

SEQ ID NO: 18948 - protein, 915 aa, Haemophilus influenzae
MKKAIKLNLITLGLINTIGMTITQAQAEETLGQIDVVEKVISNDKKPFTEAKAKSTRENVFKETQTIDQVIRSIPGAFTQQDKGSGVVSVNIRGENGLGRVNTMVDGVTQTFYSTALDSGQSGGSSQFGAAIDPNFIAGVDVNKSNFSGASGINALAGSANFRTLGVNDVITDDKPFGIILKGMTGSNATKSNFMTMAAGRKWLDNGGYVGVVYGYSQREVSQDYRIGGGERLASLGQDILAKEKEAYFRNAGYVLNDAGQWTPDLSKNAWSCNEDPPRLAENIENVKCTHYSFDPRKNDRKEILKKLKAGTKPENIDELQNGKDGIKETDKSFERNKDQYSVAPIEPGSLQSRSRSHLLKFEYGDDHQNLGAQIRTLDNKIGSRKIENRNYQVNYNFNNNNYLDLNLMAAHNIGKTIYPKGGFFAGWRVADKLITKNVANIVDINNSHTFLLPKEIDLKTTLGFNYFTNEYSKNRFPEELSLFYNDDSHDQGNYSNLGRFRGNRNLLPQRSVILQPSGKQKFKTVYFDTALSKGIYHLNYSVNFTHYAFNGEYVGYENTANQINEPILHKSGHKKAFNHSATLSAELSDYFMPFFTYSRTHRMPNIQEMFFSQVSNAGVNTALKPEQSDTYQLGFNTYKKGLFTQDDVLGIKLVGYRSFIKNYIHNVYGVWWRDGVVPTWADSTGFRFTIAHQNYQPIVKKSGAELELNYDMGRFFANVSYAYQRTNQPTNYADASSRPNNASKEDILKQGYGLSRVSMLPKDYGRLEIGTRWFDQKLTLGMAARYYGKSKRATIEEEYINGSHFELKTSGKRTYYVVKKTEEIKKQPIILDLHVSYEPIKDLIIKAEVQNLLDKRYVDPLDAGNDAASQRYYSSLNDSICSKSQDCEDGGKDKTVLYNFARGRTYILSLNYKF

SEQ ID NO: 18949 - protein, 477 aa, Moraxella catarrhalis
MKVTLPEFERAGVMVVGDVMLDRYWYGPTSRISPEAPVPVVKVNTIEERPGGAANVAMNIASLGANARLVGLTGIDDAARALSKSLADVNVKCDFVSVPTHPTITKLRVLSRNQQLIRLDFEEGFEGVDPQPLHERINQALSSIGALVLSDYAKGALASVQQMIQLARKAGVPVLIDPKGTDFERYRGATLLTPNLSEFEAVVGKCKTEEEIVERGMKLIADYELSALLVTRSEQGMSLLQPGKAPLHMPTQAQEVYDVTGAGDTVIGVLAATLAAGNSLEEACFFANAAAGVVVGKLGTSTVSPIELENAVRGRADTGFGVMTEEELKLAVAAARKRGEKVVMTNGVFDILHAGHVSYLANARKLGDRLIVAVNSDASTKRLKGDSRPVNPLEQRMIVLGALEAVDWVVSFEEDTPQRLIAGILPDLLVKGGDYKPEEIAGSKEVWANGGEVLVLNFEDGCSTTNIIKKIQQDKKG

SEQ ID NO: 18950 - protein, 681 aa, Francisella tularensis
MMRKTHLARCISLVMAGCAVAPLAHAQSETDALMLIRVTEGQSAEAARLSAAAIQTEPVQRLSSDAGVSLSRMGGRGLDPVIRGQNEERVEVLLDGMRVEGACPSRMDPPTSRLSTALAPVLEVRTSNRTLRWGPIAGGQVVATTAAPEFADDNRTTGHLTVGGADNGEGKLVNGSVAVGDKETFIRLAGGYDEADDYEDGDGNDVRSAYKNSEGRVDAAWTADNGFYIKGLVSRQEERDVKFPGRGMDAPKTDTDLYRLELGAPVASGGWNLMAWQADVDHVMDNFSLREPPVNMGMPMKMQTNSETRTRGARLVLDQTINYTKDIAFGVDVESNEWDATMYNGMNLDHEASLMWPGVERDRVGVFVEAFHQIRANARLGAGIRYDRVEMDATRADQTFTPMAGGMMTFSPSGLYASAYGASDTEANDDNVSGFLTGEWRVSPVQALEVTASHSVRSPSVNERYVARKTMKSSWIGNPDLDTEKHHKLEVSLPGNQGEWSWRPAVWVDQVDDYVYRFDIRNPNNTTDTRYENISARLLGVEGMLGWTNGTWSSTSKLASVRGENRDADKALPRIPPIQFIQTLGWHYQGHTLEAEWQLARRQDRVDLESGLDPSTSPGYGVFNLSGTHPLMANLSLTWAVDNLFDNTWANHVSKDNLADSGVFRVNEPGRTLRAALTARW

SEQ ID NO: 18951 - protein, 339 aa, Aeromonas hydrophila
MMKMAPSLIAIAMAAMGATAAHAADDIYFGAGVGATHFNGLNKLESTNVGQEDAAAANAFMGYNFTENFGTELGYQYTGRGNTDGNRYESQGATLSGIARMPVGNDFSLFAEGGAYWGHTDGLGTSDTKVSPLAGAGVTYKVNDALDLQARYRYMWDVADLHANGERYKANQSIATLEAVYHPFRTSYVAPVAAPVVEEAPAPAPQVVEKNFALNSDVLFAFGKDTLKPEGVAALNGLYQQIVEFQPKDGNAVVVGYTDRIGSDAYNQKLSEARARTVANFLVSKGMAASKVAIEGRGEANPVTGTKCNGVTAKAQLISCLAPDRRVEVRVSGVQEVQK

SEQ ID NO: 18952 - protein, 282 aa, Ehrlichia ruminantium
MNYKKILVRSALISLMSFLPYQSFAEPVSSNNIGNENAKEGFYISAKYNPSIPHFRKFSAEETPVYGKDSPTKKVFGLKKEGSITKYSDFTRTDISFEGQNNFISGFSGSIGYIMDGPRVEIEAAYQKFNPKNPANETDTSDYYKHYGLSRAETMTDKKYVVLTNNGVTFSSLMFNACYDITAEGVPFIPYACAGIGADLISIFDDINLKFAYQGKIGISYPITPEISAFIGGYYHGVIGNKYNKVPVKLPVTLTDAPQSTSASVTLDAGYFGGELGVRFTF

SEQ ID NO: 18953 - protein, 223 aa, Ehrlichia muris
ASHFGVFSAKEEKNATAKTFGLKQDWDGAAISNTSTDVFTTSNYSFKYENNPFLGFAGAIGYSMGGPRIEFEVSYDTFDVKNQGNNYKNDAHRYYALSQDTTIAQNKFVVLKNEGLADISFMLNACYDVTTEGIPFSPYICAGIGTDLVSMFEATSPKISYQGKLGLSYSISPETSVFVGGHFHKVVGNEFKDVPAIVPSGSTLAGNHFAIVTLNVCHFGIEL

SEQ ID NO: 18954 - protein, 239 aa, Ehrlichia muris
ASENSSRSPYYVQADLAYAAERITHDYPQATGANNTSTVSDYFRNIRAHSIHPRVSVGYDFGGWRIAADYASYRKWSNNKYSVNTKVLKENQGNRIKLKTENQGNGTFHASSSLGLSAIYDFKLNDKFDKFKPYIGARVAYGHVKHQVHSVETKTTIYTTAPTGDATVGGTIPERPSSKPAYHESNSISSLGLGVIAGVGFDITPKLTLDTGYRYHNWGRLENTRFKTHEVSLGMRYRF

SEQ ID NO: 18955 - protein, 226 aa, Ehrlichia sp. Shizuoka-37
ASHFGVFSAKEEKSPTAALYGLKQDWTGVGASAHNDNDFNNKGYSFKYENNPFLGFAGAIGYSMGGPRVEFEVSYETFDVKNQGNNYKNDAHKYCALDQQATSSSATKDKYVLLKNEGLLDISFMLNACYDIITDGIPFSPYICAGIGTDLVSMFETTNPKISYQGKLGLSYSISPEASVFVGGHFHKVIGSEFKDIPTLKAFASSTATPDMAIVTLSVCHFGIEL

SEQ ID NO: 18956 - protein, 227 aa, Ehrlichia sp. Shizuoka-36
ASHFGVFSAKEEKNPTVALYGLKQDWAGVGASAHTDEDFKNKGYSFKYENNPFLGFAGAIGYSMGGPRVEFEVSYETFDVKNQGNNYKNDAHKYCALDQQATSSSNATKDKYVLLKNEGLLDISFMLNACYDIITDGIPFSPYICAGIGTDLVSMFETTNPKISYQGKLGLSYSISPEASVFVGGHFHKVIGSEFKDIPTLKAFAASTATPDMAIVTLSVCHFGIEL

SEQ ID NO: 18957 - protein, 226 aa, Ehrlichia sp. Shizuoka-36
ASHFGVFSAKEEKNPTVVLYGLKQNWTGVGASTHSDDDFSNKGYSFKYENNPFLGFAGAIGYSMGGPRVEFEVSYETFDVKNQGNNYKNDAHKYCALTQQDGTTKPTQNKYVLLKSEGLLDISFMLNACYDIITDGIPFSPYICAGIGTDLVSMFETTNPKISYQGKLGLSYSISPEASVFVGGHFHKVIGSEFKDIPTLKAFASSTATPDMAIVTLSVCHFGIEL

SEQ ID NO: 18958 - protein, 93 aa, Legionella pneumophila
MYKWNALVAFEQVDWSIGYQYVGKRPDLDYNTYPTQNITLDAYSLVDTSVSYYVTDSTTISARIDNLLDKEYETANGYPAAERAYYLNIGYQF

SEQ ID NO: 18959 - protein, 412 aa, Legionella pneumophila
MKNKIVFFSCFILMSLTSFSQSISSSPYSLYGVGSLYDSDFGSIPSIGSSGIALPSSNFINNLNPASLGSMPLNHFMLDVGGKAIATTYQNNSRSEKRNNFQFSHLAFAFPITKRSGFSVALRPYSSASYKISNLKLPIADSNESYYLTAGGSGGLNNFDFSYGYRVTEKLSVGASAALLFGNVVDDRTFSILNSITNVHKKTDYNGLRATLGMQYKIDSTLTIGATFKLPAQIKSSKIQTVETITDDVYNAIETDVASDVDDYYLPSEIGVGISKKFKKVLTTTFDYQKSLWKDTKQSDLYGEFVNQDRFAFGLTYFNEKRNFRKYWDRVQYFAGANFDTGYLEVDGKRVNDASISIGVRLPIENTFSALNISYSYGQKGRIANDLIKENYHKLSINLSLDGIWFVKRKFE

SEQ ID NO: 18960 - protein, 466 aa, Legionella pneumophila
MKIRGNWKRTRAVWLVALVAAPVVSAAENPSNGSTEPISPGFKSNAEASGQTNAEPKTEMWSWHAQNTYILQYHPGFPAKYSGPNSLRNVNEVDETGSLDLLVGRRLWPGAEFHVDGLMWQGFGFSGTRGVEGFPNGEAFRVGTKVPNVNISRLFIRQTIGLGGELENVTGDDLHLAGERDVSRVTLTVGKMSAKDIFDNNAYANDPRTQFMNWSLMANQAWDYPADSLGFMTGLAVELNQPSWTARYGFFQVPRTSNGVAQDQAYTKAWAMVTELEHRHTLNEHPGAIRLLGYLNQAHMGSYQETLNNPSLNENITLTREYRFKYGVGLNVEQELVKDIGVFMRLGWSDGQNEAWMFSDVDHAASLGLSVKGSFWSRPDDTLGLGGAINGITHVHQEFFAAGGLGILAGDGALTYGLEELMEIYYDFQIWKTVHGAGDYQFINHPAFNRDRGPVSVFSARLHFAF

SEQ ID NO: 18961 - protein, 329 aa, Legionella pneumophila
MKIKFLLSMIGVILSTQSAYAKIPDSSASRAQNINDNKSAKNANNFLKKITPEFAYSYIDFNFDSTAGLNFNRYNGHSNLYSIGADHFSPVPSIIAGLYVLNIDTEVSSQFQLFPNTPIPSSQTIHNNTLFAHMRKIFTPKFDIDIAGGYGQNRINSQTLLNRAITDVAFSKHTNDNWLASINAVYRKRGKKISLRTYVGMLYSQINSGSYILAFQSNQRGQIIAPLTTKTTYIMEGTEISYKLNSTLTPFVNGGLIQIADFTNSRPILTQQINGSLPQLNMDKNGYKLGAGLIFNYKQMTLRLEEKYYSAGNIFESYQTTAGLEYRFN

SEQ ID NO: 18962 - protein, 254 aa, Legionella pneumophila
MYLGFPVQSILLFLFFSFTPLFVLAAEKTPLNFFLRPDTYFGFSVIRDTAHYNFKRDETSQELNFTDFDHFDWHGSGLGGEIYLGYEKFFRTHYYIGLEGFFNRSSNEGKIYFFDSNELYSRILKGSFKQKWQSGLAIHPGIYLPSVGIIYGRVGWIVSDVNLSGSITQSGPFGSFSGRFSNTKKKNGVQLGTGLELELTKNWRCRVEWDWNRLQDFIFDSQGRDSNNHRYQTTRIAKHPILEQFKLGLNWRFA

SEQ ID NO: 18963 - protein, 378 aa, Legionella pneumophila
MFRINLIRYVALLFIITLNLDCISVAFSSQVIYGTQNAARVTGKSLKKIYFLQLGAFTQKNNAQQLARKIQARTQYPVIISHSGNAFSVRVGPVNTQELHQLSIKLSQNSNITPIKHNSSPKQTPTIQTKSQILVKENSRPLPTHSVTKETIDGKGTWYVTAKIGAQEITPDDQFTVNNDSGFPSPFDKDIYTNSSDSSLLLGIGGGYRFTNIILPAISVGVYYSHFFNMDINGQVIQYSLPEFTNYNYQWKVKSDLVLASVKANAFRWKNLMPFVQGGVGASSNRASQYYENALPDVTPRISPNFANHTATVFAYQLGAGLDWEIRPQWLLSLGYEYSDLGKVRSGYGTDSWNRETLSSKNLTSNAGTFGFTYLFHG

SEQ ID NO: 18964 - protein, 695 aa, Legionella pneumophila
MRITKLAACLATLSSPLMAADLENPNHTNMPVTALDAVTVTATRTAKSALNSAQAVNVINAEQIEQVLASSVFDSLISIPNVTATGGPRNMGQKFNVRGFSDAEDVLISVDGAIQTFEKYRMGSFFSDPELYRSVNVKRGPSTVLHGGGALGGVVEMELKDASDFLAPGEQGGVKVKLGHHGNNNENNGTVYAYARPTDSLDILTSYVKRSSGDFKLSNGETLDNSGIEAESLLLKAEYYLNEDSLIGLSYTKSEDNQRTEFNTTDPGAWGTVYREIEQSVTNLSYELNPANNPYVNLTARLGRTQSQVVESDGSGTLKDFIGLESNYEYNITTLDIANTSLIKQHALTYGMQYSEKDRVGTKLSYPCLNLDMQTYQCIDYAEQAIQNEITSQPGGTQKRIGVYLQDEFTWQALTLTTGLRYEKYKTTATSSFANSFNNLDTDVDHSQVVPALTAHYQINNQLAVFSSYQQGFRAPLIDELYDQYGGRDPALELKVENSTNKEIGASYQNQNIFTNRDALTARVIYFKVKIDDEIQSNTNIATNPEPAARYNNSGENQRDGIEFEVNYAHTLGYANFSYSRISGENQNNEPLWYLPADKFALSSGLNFFNDVLKTGFNIQHVNDRTVLVSGIEQQHKSYVLAGINASWDINDSWNARLAIDNLFDKEYQVIAGTTGAIGDYGVGRNIKTQINFKF

SEQ ID NO: 18965 - protein, 390 aa, Legionella pneumophila
MRLIFTGVLCLLTFNAQANVIQYFAGISYNNPADLFKVKNGILLIGGTGSYADLQFKGSALNFNTFQYDSGVNHSRTYIVWPYGRVAKRLNDKTVVAVDLTEPFNSNLDWGNDAFTRYAATQNYLTDVDLSPKISYAISKKLQIGGGINFNVLLKNEVNWAFPTGQSTYANLINRSSSFGVGYNLGINYAVNDTNFLGITYYSRIRQNTSGTSYLGLAANPDFQFGFYMPATTVASYVHIFNPKWLINLQVFQSEWNANQKVRLYNTAAPHPFTNFIFDMNFDASYAYLAAIRKQVSDKLGIALAGMIDDGPEEDGLRTIVFPSDTQYFLGLIGDYRFTEHASMELILGHVYSNPSIQNKAKVNNVPVPFTTGRVTINANVLDLKIKIEG

SEQ ID NO: 18966 - protein, 948 aa, Legionella pneumophila
MTGIRPPMKRSLLATTISSCLVLTACGGGGGGGNVRNDPPPTTTVVPAPITDPTPAPAPTPAPTPAPTPAPTPSPAPAPAPAPPPTADPLPKTAPVPVAPPRYQGLASNLLVPTNADLAQQAGARGQGVKIGVMDDNLVQTYAPVAGKVDAFTDYTAVPGAAESTSNRLRGHGSVVSALVLGSAQDGFAGGVAPDADLIYGRICAENSCGTQQARRAAVDMAAAGVRIANLSIGASYADAASSANAALAWRFALTPLVQADALIVASTGNDGAAEASYPAAAPVQEASLRNNWLAVGAVEIDSAGNPAGLSSYSNHCGSAAQWCLVAPGMYAAPALAGTELQGQIAGTSFSTAAVSGVAAQVLGVYPWMSASNLQQTLLTTATDLGDPGVDALYGWGMVNAAKAIKGPGQFASNWAANVTSGYDSTFSNDISGSGNLTKNGAGRLTLSGNNSYAGGTSISDGVLALSGSVRSDVLVLNSATFESRGGTINGNYSLVNSTGTTAIELGKGLTVTGQASLKGNLLLLPEAAGYTVAGSERIVRAGALQGTFDRVQYANNFFWTAALAYDPTSVTATLTRNAAAASAQAAGASQSVVAGARQADSLVKALDTRVASGDTANLGGVITATGALLLATDAQVASSLPTLVGQVHGIERTLGFQSALNDARVAADRLPLLASTTTLTTWMQGSYLDGDLSRAGYASADYTQRATTVGFDMPLGGAGTIAGAALTSGEDRGTISASASRLRADRYAMTAYLYQPVGMAYLSAIGSYGMGSVETERSVQAGSIGERLQDRRHDTNWSLRTELGLLPRAGLSPFVAAGVVSQTQDAFSEASVTGLGLSAASDTLRAGYGEVGVRGHLAHGKWGFDGLVAYRSLFGDNRADFTAWFTGLPEARFTVAGEPLSKEALRASVGVRYSVSDTFSLYGNVGAERGSSDASSVNANVGLRWQF

SEQ ID NO: 18967 - protein, 190 aa, Legionella pneumophila
MKRLISCLTIICALNASAAAETTSNPCSRWISFLKPVCQRIHQTWTEGHDDMYFSGYAWHNRYVYSNEKIKSYNETAWGGGLGKSLFDEKGNWHGLYAIAFLDSHRHLEPAVGYAYLKTASVNKDLKAGLGYSVLVTSRVDYDNVPIPGALPWAALFYKRITIAATYIPGSSREGHENGNVLYMLGKISL

SEQ ID NO: 18968 - protein, 308 aa, Legionella pneumophila
MKNKIVLLAPISLSFLFSFPTYAADYEFNGLSLSASLGILSGNAHEYVYHPETDTKLSQLDWRIKNAPIIKGELNYDVLDWLSMNGRGWTTLVKNKAAMDDYDWFNPYQETWTHWSHHEDTYLNYANELDMSLRAWLMQKQNYKLGLATGYQWNSFDWQATGGCYQYNGGLYAGCFPSDQPGIGYQQKFRTPYIGLAGKYFINNFEFSGLLKFSDWVSARDHDEHYVRNLTFNERGNSSRYYAATIHSGYFLKPNTKIFVEASYNHYSNGRADTEIIDNDTGERSYFGDSAGLSNKHYTVALGLQYLF

SEQ ID NO: 18969 - protein, 1361 aa, Legionella pneumophila
MDFTASNVTINENISVTGSKAGKVIIAQANYNGATNSSTIKVTNKGKIDYSGNKSTALATDFGQVTNETSGTIRMSGDNSIGLYGAANSIVTNKGTIEMGKAGVGIWGANNLSNKYANRNINIVNSGTIRGISGKEGVFGIYAKNSHAGATSNISHSGNIDLSQAKKSTGIFMTKGTLNSSGNISVNEGSVGVNAEDSTVNVNGGTHTIGANSIGFNLKGNSSLLANSGNISITGKGSVAYLFEGVNLTSGTNFKDNLTLTATNGYTYINLTNSTLNYKNQKTINNDETIFVNSKNSTVNLLEGNDISSTKNKVVGVYSEGGVVSNAGKMTLMGDGSSALYSKGAATVNGAPGKITIGANGSGIYVVNAGSTGSNYGEITIGAGSVGMRAENGKIKNNSTGKISSTAEKATGMSQSGNENLENEGTITLTGNQSVGMHSEGVTAAGHQMINKGIVTVGHSATATSPSIGMYAANTDKTTIVNNGKVIAGNKSTGIYGGNITLNNNSETSAGNGGIGVYSKGGTVDIKENAKISVGDTLGDKQEGVGVYLAGNNQTLNSDTDNLTIGKGSFGYVMTGQGNTVRTGKAGTTRMINLTHSSIFMYSADRTGTAVNYNNLRSTGDLNYGIYASGRVDNYGTIDFSQGIGNIGAYSYTKGATTTPNSIRNYGTINVSKSDLQTNPDDRKYGIGMAAGYSEESPAGSGRKVTRGIGSIENHGLIRVTTPDSIGMYATGKGSRIYNGPTGRIELSGRKRNIGIFAENGAEVVNEGTITTVGSGNVGQIGIGITSGATLINRGNIHVNAARGYGLFVAGGIVKNYGNITVAGGAQKTKEVSASDTSKALGDEGLDRVGIKSPAGASKGTITSNGKVKKPTIVQAIPNRKPSEIPKSSIGMYLDTSGINYTKPINNVGALAGLKQGDLIVGTEAADYTNSKYIQLGQDIIKPYNEMIRKSGIEKWSIYSASLTWMASITQLPDYTIRNAYLVKIPYTVFAGDKNTTRDTYNFTDGLEQRYGVEGLNSREKELFKKLNKIGNNERILLQQAFDEMMGHQYANVQQRIYATGQILDKEFDYLRNEWKTVSKDSNKIKIFGIKGEYKTDTAGVIDYKNEAYGMAYVHENEDIKLGKGIGWYTGIVDNTFKFKDIGKSKEEQIQAKVGLLKSIPFDDNNSLNWTISGDIFVGYNKMHRKYLVVNEIFNAKSKYYTYGIGIKNKISKDFRLSEDFSLVPYGSLNLEYGRVNKIKEKVGEIRLEVKENYYVSVNPEIGAELTYKHLLASRKTFRMGLGIAYENELGKVANGKNKARVAYTNADWFNIRGEKEDRKGNIKFDLNIGLDNQRVGVTANAGYDTKGHNVRGGLGLRVIF

SEQ ID NO: 18970 - protein, 863 aa, Legionella pneumophila
MKQSIAFTPSIIIGATLSLSAGFTTTTYAAEEAKKVERIEVTGSRIKRSDIEGPSPVQSISKADIENMGYDNLQQLLERMPVAGSGTFSTRGNNQDSTANGAAAVSLRGLGADATLVLINGRRVSISAFAEGITNSFVDINSIPVSAIERIDILKDGASAIYGSDAVAGVVNVILKKDIDGVEVNLGYGGTDGPNYEETTASVVWGTTSEKSSASVIIDYFKNTSLSSDEMGRLGTANQSPYGGEDFRSSRGFPGYFYVDGVKTIDPDCPAENATASGSCLFDYGPFGYIAPAAERIGAISQFEYRFDNGITGFLEMAVQHNTSVAAGAPTPLDEDAGLTVPANHPNNPFGQDIEIGRYRTVDAGARQWDIESDTMRIVAGLKGEINDWSWETAVQKGRSKSMQTGDRSQGWVRTDFLQQEIDAGNYNPFGGTYNDPAVVDRITTSLVRRGESHMTSFDANITGEAFSFGDDVVMMAAGIEYREEDVSDIPDDQFQRGLIFGTESVSASANRDQYAAYVEFSIPLAETLELQLAGRYDDYSDFGTTTNPKVALRWAPTDEITVRGSWAQGFRAPSLAQVGLGPSQESQFFVDTYRCQATGKDCSALDYNIEFAGNPDLQPEESESWNVGFIWAPTAEFGLSVDVWSITQDNKIDEQEFGPIYASECNNQNSTVCVRLAPNGGDALGTIQKIFSTFENVSSQEVSGVDISTNYNHSLDDLGLLKFNLEWAYQDKFEKDGRDYTGEYGYPEHRFIFSTNWEMGAFNTNLNISYVGEFEDTPDIDFDGNLDFDTNTSRMVDSQTLVDLQTSYRVSDSAKVSLGINNLFDEEPPFAIGDGDSDLYGYASGVHNPRGRYIYTKVSFSF

SEQ ID NO: 18971 - protein, 480 aa, Legionella pneumophila
MKIRHKPLRTLVSTAVLGVLATGTLNAGGFSLYTEGAGYTIGNFAAGVAAEAADASTGWYNPAGLVLIRDQQAVFAGVGVFPTAKLSGVSTYSTINPPPFPSFVYSEVFNNINGAEDAFVPSFHYALPLGENATFGLSVVSPFGLATDWGPDSPVRYQATFTELITTNISPEIGGRLTEHVALGAGLDLQYARVKYNRILGVPNILNVLPPFNPMLADSLTYNKGHSFGVGFHVGVLGMFNDNHTRLGANYQSSMRHEFYGYSRLTGPLASPGNILAPFLFPAPGIFQSDDLFSNSIDFPDVVTISAYHDVNDKLALLGSLVYTAWSSYKTVQLYNAAAGRPADNGNVSQAKAISISPQNYNDTLRVAIGANYHVNDKLMLRVGGGYDPTPTNDIDRDVRLPDTDRWALSAGAHYQATNNIGLDIGYTHLFTSSDPVINKTDAFTATTRYNVTASGTAGANLVGVQATWTIDKEPPAPTK

SEQ ID NO: 18972 - protein, 222 aa, Legionella pneumophila
MKIKFLLGMILGFGFISSVYGAKSGVFIGADVGVNYHVSEGKVIFSSPGNAYTSESNDYLFDLSYGLRGGFQYYFTPKVGLRVVGAFGKGNYSEGEANDGETYGFFRYAGNVDFLYQFGSSEINQVGVFVGAGYEGIGGELKKLLDDTKGLPGHKYNTSGIFMNLGLQVIRDVHHQFDFIVRVPFYSYLERNFSTNTAQGNITINSSHKNNYSFNIAYTYVF

SEQ ID NO: 18973 - protein, 800 aa, Legionella pneumophila
MYLFLRLSNFLFVWIILGISSSVFGQNSPLIEGVVVDVTDSSPLIGANVYWEDDVSSGVVTDLDGKFRLSKRNLPARIVVSYVGYEKSIRTISQNESEKEIKFFLKPLEMSLDEIIIQERRPDEQIKNLSMGKASVPMETIKNIPALFGEVDLLRSLQLLPGVQTAGEGTTGLFVRGGSADQNLVQVDGAPVFNPSHFFGFFSVFSPDALDNVDLYKGNMPANYGGRLSSLIDVSLKEGNNQQIHGQGGIGSISSRLMLDGPLFSEKSTFAISARRTYADVFLRLSNNEDVKNNKLNFHDLSAKLSFLIGDKDKLTFSSYEGSDFLGLDEQFGLGWRNWVSSGHWSHTISENSFFDLEAYHSNYKYKVEFEEPNTGFYWNNRLSESGLKGQWTWINSDRIQSYWGFHSQYYHFAPILLDPAEDSAIESITTNPKNGVLNSGFIGMTAAITPRLSTEIGLRMGLYTQVGKGVDYLYQDDIPDDTNNITDSVRYGNFEPIRFYHGLEPRVAFRYLVNEEFSIKAAYNRNFQYVQIASNSSAGLPIDRWILAGKYIAPLRSDQVSLGFFKNFDSDRWEFSVEGYAKNFKNVIDLKNGASVLFTDQVETELLAGDGYSYGMEFLLRKNVGKTTGWLAYTYSRTWREIEGISLGEKYNPRYDRPHDVTLVLNHEFSPSWSAGLTFVYTTGQAVTFPVGIYESDNQIVPVYPDYRNQDRFPDYHRMDASVTWKNPNKGRKWRGSWNFSVYNLYGRKNPFAYEFREIYNDQINYDPDVDGPIVSEKQGVVMTYLFTFLPSITYNFQF

SEQ ID NO: 18974 - protein, 458 aa, Legionella pneumophila
MFRIARVALAATASLIAMPLAAAPLSAEESQALREEVRALQARLAAIEARLGEAPPGAAPAAASAPAVTAAAAASAPATAIGWKGSPQFTSDDRSFKVKGRIQLDAGYVSKPRGIVDRGLGFSNEVRRIRLGGEGKLGSGFGYKLEVELSDNKVGLVDTFVTYDTGPWQVSIGNQNQFQSLDELTGDTTGSLMERAAFTDAFNFERRLGIAVQYHRKDILLQGGVFSDDIDALADSSDGPNGGDENNSFSIDGRAVYAPKLGGTQIHLGGSAHLRMLNRLSDAPTRYRQRPFLHSTNSRILATPNMLVDREFNYGLEVAAIHGRWHTAGEANWLDAIGPGPNSRFFGGYAEVGYFLTDDTRTYRNGIFGGAKPSSPFGKGGIGAIQVNLRYDYLDLNDGAIRGGTQNGWFAGIIWTPVEYLRFNLNYGYLAYTGAAIPAGGRTDYGMHVGGARVELDF

SEQ ID NO: 18975 - protein, 212 aa, Legionella pneumophila
MRITLLTTAILATGVASAAVPVDGWYASAFGGYTYIPPNIYNFAYGVFRDEVGYNNGYNAGGRVGYQSNPIRYEVEYTYLRGEARKFNLNFITQLGVTGFTSANTIMANIYYDCPDMLPAIAPFIGLGIGYASLRTELDSIGPFRPSYFTTSDSAFAYQGTVGITYNFSENYAANLAYRYIATDNSSNFGKTYQAHLASVGAIYRFDQGNYK

SEQ ID NO: 18976 - protein, 240 aa, Legionella pneumophila
MGLKKYVILWFLMGFYSGLNALDYDTLDPKYYKYIKYYKAYEDKEVEELIKDLKRANAKSGLILGINTGFFYNHEIMVRTNSSSITGNILNYLFAYGLRFGYQTFRPSFFARLVKPNIIGRRIYIQYYGGAPKKAGFGSVGFQSVMLNGDFLLDIPLPFVGKYLYMGGYMGLGLGVVAHGVNYTAEWGMSFNAGLALTVLEKNRIELEFKILNNFPFLQSNSSKETWWGAIASIGYQYVF

SEQ ID NO: 18977 - protein, 390 aa, Legionella pneumophila
MRLIFTGVLCLLTLNAQANVIQYFAGISYNNPADLFKVKNGILLIGGTGSYADLQFKGSALNFNTFQYDSGVNHSRTYIVWPYGRVAKRLNDKTVVAVDLTEPFNSNLDWGNDAFTRYAATQNYLTDVDLSPKISYAISKKLQIGGGINFNVLLKNEVNWAFPTGQSTYANLINRSSSFGVGYNLGINYAVNDTNFLGITYYSRIRQNTSGTSYLGLAANPDFQFGFYMPATTVASYVHIFNPKWLINLQVFQSEWNANQKVRLYNTAAPPPFTNFIFDMHFDTSYAYLAAIRKQVSDKLGIALAGMIDDGPEEDGLRTIVFPSDTQYFLGLIGDYRFTEHASMELILGHVYSNPSIQNKAKVNNVPVPFTTGRVTINANVLDLKVKIEG

SEQ ID NO: 18978 - protein, 1021 aa, Legionella pneumophila
MKRLIPSVVFGLALLLLPGLAWAQQGTVTGTVTEAETGNPLPGATVQIVDEGSGAASDAEGQYRIAGVPTGEQTLRVSFVGYQAQERTVNVPEGGTVRVNFQLQTGEAQLEEVTVSAYRPETDRVATGADATVSGESIETADLTSAEGALQGRASGVRVTSLGGQPGSGFSIQVRGALSVNAGSDPLYIVDGVQINKENNLDLANGNPLSTINPGNIESIQVLKDAAAASIYGAQAANGVVVIETKEGRSGDTQINFSTKLGSVSNIEPYGVMDSEQYLNFRAEALDNASRENFGLPASVAFGSDPQTIVNGAFGPDSINTDWTDQVFREGFTQSYNLSLRGGSDDTQFYISGNFTRDEGQVIDSNFRRGGLRLNLNHQPADFLNLSAKTNLSTTRYQGTISDGAFINSPFWAAYNIPPTSPVYTTPGDPSTALNLTPNSTFSYNPVAQEKFNTRESSANTITSNVTANWDLPAEFAARTYAGVQYVDTKEFDYGDPRLPPNAGFGGEGFNSTQRDITFNVSQTLSYENTFASVNTISALAGAEIKRNREQFTSGSGEGFPNELFRTLASAANPTDVSSFSTQYRQISYFGNATYTFDNTYQIGGTLRRDANSRFGVDNQSGIFGTVSGFWRISNESFLEDTDVISNLKLRASYGVTGNSDIDNFQSRQQFSGSGEYNGTPGIRPTALGNPSLTWEEKVSTNVGLDYGFFGGRITGSVDVFRDDREELLLFRDLSLDSGFGSYLDNVGEIRVEGLDFSVSTINLNDWNGLTWETNFNISFQRTEVRSLLPGDDEVTSGGDVYRVGEPAAQLRYTRYAGANPANGRPMYLDANGDLTYVGNDTNNEKLIGNLQPDFYGGFGNTISYKGLQVSAFFQYDYGRKTLNNDRFFADVGYFPYNKAERLVENRWKEPGDVTESPAAFGSLLASGLDTYADGTDPGIFTTRFVENASYIRLKEVKVSYTLPKSLTETVGSLRNVTVFVQGSNLATWTNYTGPDPELVGTGLGNYPQARTLTAGLDLGL

SEQ ID NO: 18979 - protein, 326 aa, Neisseria gonorrhoeae
MKKSLIALALAALPVAAMADVTLYGTIKVGVETSRSVDHTGRANRVKTATEIADLGSKIGFKGQEDLGNGLKAIWQLEQKAYVSGTNEGWGNRQSFIGLKGGFGKVRVGRLNSVLKDTGGFNPWEGKSDYLSLSNIAEPEARHISVRYDSPEFAGFSGSVQYELNDNSNKYNSESYHAGFNYKNSGFFVQYAGAYKRHHYATEKHQVHRLVGGYDHDALYASVAVQQQDAKLALIDDNSHNSQTEVAATVAYRFGNVTPRVSYAHGFKGLVYHADLSNDYDQVVVGAEYDFSKRTSALVSAGWLQEGKGAEKFVSTAGVVGLRHKF

SEQ ID NO: 18980 - protein, 311 aa, Neisseria gonorrhoeae
MKKSLIALTLAALPVAAMADVTLYGTIKAGVETYRFVAHNGAQASGVETATEIADLGSKIGFKGQEDLGNGLKAIWQLEQKAYVSGTNTGWGNRQSFIGLKGGFGKVRVGRLNSVLKDTGGFNPWEGKSEYLSLSNIARPEERPISVRYDSPEFAGFSGSVQYVPNDNSGENKSESYHAGFNYKNSGFFVQYAGSYKRHNYTTEKHQIHRLVGGYDHDALYASVAVQQQDAKLAWPDDNSHNSQTEVATTVAYRFGNVTPRVSYAHGFKGSVYEANHDNTYDQVVVGAEYDFSKRTSALVSAGWLQEGKGA

SEQ ID NO: 18981 - protein, 327 aa, Neisseria gonorrhoeae
MKKSLIALTLAALPVAAMADVTLYGTIKAGVETYRFVAHNGAQASGVETATEIADLGSKIGFKGQEDLGNGLKAIWQLEQKAYVSGTNTGWGDRQSFIGLKGGFGKVRVGRLNSVLKDTGGFNPWEGKSEYLSLSNIARPEERPISVRYDSPEFAGFSGSVQYVPNDNSGENKSESYHAGFNYKNSGFFVQYAGSYKRHNYTTEKHQIHRLVGGYDHDALYASVAVQQQDAKLAWPDDNSHNSQTEVATTVAYRFGNVTPRVSYAHGFKGSVYEANHDNTYDQVVVGAEYDFSKRTSALVSAGWLQEGKGAEKFVSTAGGVGLRHKF

SEQ ID NO: 18982 - protein, 332 aa, Neisseria gonorrhoeae
MKKSLIALTLAALPVAAMADVTLYGTIKAGVETSRSVAHNGAQAASVETGTGIVGLGSKIGFKGQEDLGNGLKAIWQVEHKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQENVNIEKYQIHRLVSGYDNDALYASVAVQQQDAKLALPNDNSHNSQTEVAATLAYRFGNVTPRVSYAHGFKGSFDDADLSNDYDQVVVGAEYDFSKRTSVLVSAGWLQEGKGENKFVSTAGGVGLRHKF

SEQ ID NO: 18983 - protein, 348 aa, Neisseria gonorrhoeae
MKKSLIALTLAALPVAATADVTLYGAIKAGVQTYRSVEHTEGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDGQAYSMPSLFVEKLQVHRLVGGYDNNALYVSVAAQQQDAKLYRAMSGNSHNSQTEVAATAAYRFGNVTPRVSYAHGFKGTVDSANHDNTYDQVVVGAEYDFSKRTSALVSAGWLQEGKGADKIVSTASAVVLRHKF

SEQ ID NO: 18984 - protein, 348 aa, Neisseria gonorrhoeae
MKKSLIALTLAALPVAATADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAKRGHRYLSVRYDSPEFAGFSGSVQYAPKDNSGSNGESYHVGLNYQNSGFFAQYAGLFQRYGEGTKKIEYEHQFYSIPSLLVEKLQVHRLVGGYDNNALYVSVAAQQQDAKLYGARRGNSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 18985 - protein, 346 aa, Neisseria gonorrhoeae
MKKSLIALTLAALPVAATADVTLYGAIKAGVQTYRFVEHREGKVVGVGTGSEISDFGSKIGFKGQEDLGNGLKAIWQLEQGASVAGTNSGWGNKQSFIGLKGGFGTIRAGSLNSPLKNTGSKVNAWESGKYTGEFLEISKMAEREHRYLSARYDSPEFAGFSGSVQYAPKDNSGSNGESYHVGLNYRNNGFFAQYAGLFQRYGEGTKKMEGYLYNIPSLFVEKLQVHRLVGGYDNNALYVSVAAQQQDAKLYGATRVNSHNSQTEVAATAAYRFGNVTPRVSYAHGFKGTVDSANHDNTYDQVVVGAEYDFSKRTSALVSAGWLQEGKGADKIVSTASAVVLRHKF

SEQ ID NO: 18986 - protein, 348 aa, Neisseria gonorrhoeae
MKKSLIALTLAALPVAATADVTLYGAIKAGVQTYRSVEHTEGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDGQTYSMPSLFVEKLQVHRLVGGYDNNALYVSVAAQQQDAKLYRAMSGNSHNSQTEVAATAAYRFGNVTPRVSYAHGFKGTVDSANHDNTYDQVVVGAEYDFSKRTSALVSAGWLQEGKGADKIVSTASAVVLRHKF

SEQ ID NO: 18987 - protein, 348 aa, Neisseria gonorrhoeae
MKKSLIALTLAALPVAAMADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQAYSIPSLFVEKLQVHRLVGGYDNNALYVSVAAQQQDAKLYGAMSGNSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 18988 - protein, 332 aa, Neisseria gonorrhoeae
MKKSLIALTLAALPIAAMADVTLYGTIKTGVETSRSVYYEDGKAAEVTTGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHERVDKNVNIEKYQIHRLVSGYDNDALYASVAVQQQDAKLALPNDNSHNSQTEVAATVAYRFGNVTPRVSYAHGFKGSVDDAKRDNTYDQVVVGAEYDFSKRTSALVSAGWLQEGKGENKFVATAGGVGLRHKF

SEQ ID NO: 18989 - protein, 348 aa, Neisseria gonorrhoeae
MKKSLIALTLAALPVAATADVTLYGAIKAGVQTYRSVEHREGKVVGVETGSEISDFGSKIGFKGQEDLGNGLKAVWQLEQGASVAGTNTGWGNKQSFVGLKGGFGTIRVGSLNSPLKNTGANVNAWESGKYTGKFLEISKMAGREHRYLSARYDSPEFAGFSGSVQYAPKDNSGSNGESYHVGLNYRNGGFFAQYAGLFQRYGEGTKKIEYDSQYYSIPSLFVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQEGKGAEKIVSTASAVVLRHKF

SEQ ID NO: 18990 - protein, 348 aa, Neisseria gonorrhoeae
MKKSLIALTLAALPVAATADVTLYGAIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYRNNGFFAQYAGLFQRYGEGTKKIEYEHQVYSIPSLFVEKLQVHRLVGGYDNNALYVSVAAQQQDAKLYGARRANSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 18991 - protein, 348 aa, Neisseria gonorrhoeae
MKKSLIALTLAALPVAATADVTLYGTIKAGVQTYRSVEHTKGKVSKVKTGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSASVQYAPKDNSGSNGESYHVGLNYRNGGFFAQYAGLFQRYGEGTKKIEYDNQFYSVPSLFVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQEGKGADKTVSTASAVVLRHKF

SEQ ID NO: 18992 - protein, 345 aa, Neisseria gonorrhoeae
MKKSLIALTLAALPVAATADVTLYGVIKAGVQTYRSVEHREGKVVGVVTGSEISDFGSKIGFKGQEDLGNGLKAIWQLEQGASVAGTNSGWGNKQSFIGLKGGFGTIRAGSLNSPLKNTGSKVNAWESGKFTGNVLEISGMAEREHRYLSARYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYQNQIVRDNSHNSQTEVAATVAYRFGNVTPRVSYAHGFKGTVDSADYDHTYDQVVVGAEYDFSKRTSALVSAGWLQEGKGADKIVSTASAVVLR

SEQ ID NO: 18993 - protein, 348 aa, Neisseria gonorrhoeae
MKKSLIALTLAALPVAATADVTLYGAIKAGVQTYRSVGHREGKVVGVETGSEISDFGSKIGFKGQEDLGNGLKAVWQLEQGASVAGTNTGWGNKQSFVGLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYDNQSYSIPSLFVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQEGKGADKIVSTASAVVLRHKF

SEQ ID NO: 18994 - protein, 196 aa, Wolbachia endosymbiont
  misc_feature (34)..(34): Xaa can be any naturally occurring amino acid
SYYVRLQYNGEFLPLFTKVDGITCKKDKSDYSPXKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRRVTDAGAYKVLYSTVGARS

SEQ ID NO: 18995 - protein, 1182 aa, Azospirillum brasilense
MLLASPWIHAQDSSDEEEEVFELSPFVVDGSDDQGYRATSTLAGTRIRTDLKDVGSSISVYTEEFLKDIGATDNNSLLTYTTATEVAGVGGNFAGTGNGATLTEDFSSPNQSTRVRGLDSADNARNYFLSSIPWDGYNVSRVDMQRGPNAILFGLGSPAGIINVTTDQAGFKDDNEISLRFDSNNSIRFNFNLNRVLIEDELSVRVAGVRDDKKYRQQPAYQDNQRFYTAFRYEPKFLNSDSSSFKITGSFETGQIESNKPRSVTPQDRITAFFNESGAVLNYDSEDVLTSIDYPLTAGTGGWIGDPYGVEDQSGDYGLGENRLELGDGGILNPNYLPAIGNFGQNYGGPLTVFPDSSTTNVSGTTVHEAKLYGGLNADGSIDNTLYFPYGRLTSIDTYTSYADQANLPYADAGVYKNIYLQDETIFDYWNNLIDGPNKREWYDFDTKNLAIEQTFFDNKLGYELSFYEETLDSGNLSLMNNSSNIAIFIDTNTHLGDGSENPNLGRAFISDSSSSGNSVGTTERDAMRFTAFTEYDFREQGSDGWLSRLLGKQRFSGMYSDSDTYSDSVNFRRWMVDPSIYDELVLAGADSSWNDNAVTVNTVHYLGDSLLGQSSASGSYLPGVSAIHDVTSGTYYSFDATWNATGVDPSAAWTTPVGDVSTQSENPDNYVGWTSREYPIINALTGNTLTDYRTVTGASMNSESIESEALVWQGYFWDGALVGTYGWRKDTDTAKVLNASDANAAPGVRDTVTGHVDVFNSNYDLALVDADVQTGQTQTWSAVLHLNRVLNDRLPLNVSLYYNESENFRPAAGRVDLFGEALSSPKGSTEERSILLSTKDNRYSLKVTDYETRVSNISSGYIDGSWFLGGFLEWGTEWANVAEHNISDGYTLDGVWDPSDTSNSWRYDYDGEAEAIAGWRAFTEAVAENYPQYLEAWSFNGDINSDIMDFSNSGPSGLTYTQDGISRGQEYEFTANPTENWRIAFNATRTEAVRENVGGAALIEWIDFVQDYIQDTPAGDVRIWWAGGPTIRDGFNSTFYSNYSLTRLLEGNSNPEVREWRFNMVNNYAFKDGMLKGVNLGMGYRWEDEVVLGYPVLEVEEGVVQYDIANPYYGPSLDHYDFWIGYERPLNDKINWRMQFNLYDAFADKELIPISVQPNGDWAGVRLGSTTTWSLSNTFTF

SEQ ID NO: 18996 - protein, 327 aa, Neisseria meningitidis
MKKSLIALTLAALPVAAMADVTLYGTIKAGVETSRSVAYHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATAAYRFGNVTPRVSYAHGFKGSVYDADNDNTYDQVVVGAEYDFSKRTSALVSAGWLQRGKGTGKFVATVGGVGLRHKF

SEQ ID NO: 18997 - protein, 386 aa, Neisseria meningitidis
MRKKLTALVLSALPLAAVADVSLYGEIKAGVEGRNIQLQLTEQPSKAQGQTNNQVKVTKAKSRIRTKISDFGSFIGFKGSEDLGDELKAVWQLEQDVSVAGGGATRWGNRESFVGLAGEFGTLRAGRVANQFDDASQAIDPWDSNNDVASQLGIFKRHDDMPVSVRYDSPDFSGFSGSVQFVPIQNSKSAYKPAYVDEKKMVHAAVVGKPGSDVYYAGLNYKNGGFAGSYAFKYARHANVGRDAFELFLLGSTSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 18998 - protein, 768 aa, Moraxella catarrhalis
MANKFQLLPLTLAVSAAFTTTAFAAVSQPKVVLAGDTVVSDRQGAKIKTNVVTLREKDESTATDLRGLLQDEPAIGFGGGNGTSQFVSIRGMGHNAIDLKIDNAYQDGQLHYHQGRFMLDPQMVKVVSVQKGAGFASAGIGATNGAIVTKTLDADELLRNSDKDYGFKVGAGLSTNKGHSYHGSAFGKAQTGFGQVDALVSYNQVNDSDYKGGKGYTNLLGNDVVTRSALDKSSYLVKAGLTAGDHRFVVSHLNEVHKGIRGVREEFDFANRALTIDIEKKGKIRTEAELLAELNKDYPGQGYKLGKKINDKDNKVVGYHVVDANGRQVPNLNRNNPTQRETYQKLTNLEWTAKNLGFANEVTANVYKLEHGRNSSSDQGNTYITKDVPKEIIDNVDTPSNMHVVATGANINFDKEFTHSPLKGFGVDHTLLKYGINYRHQKAVPPRSLKPGVVHQEKTDAGIYLEAVNQINDFTINTGVRVDRFDFKAMDGKKVGKTDINPSFGVIYDVNPNLSVSGNLIYATRSPRFVDAILSRGYRGGVISIDDNAKAEKARNTEIGFNYNNGPYTAFGSYFWQRVDNARATADITRHGTTDANGKSIKVPALGNQGHQTNQGYELGVGYTEGAWRARAGVAYSKPTMHNVTLDGNPEYAVRTGRTWTADVAYRLPNPSVELGVRHTLVEGVDAKDTSILSGKFDDKDGAILNREGYNVSDIYANWKPYGNDKVNVNFAVNNVFNKNYRPHTQRASIDTLPGAGRDFRVGVNFTY

SEQ ID NO: 18999 - protein, 701 aa, Moraxella catarrhalis
MANKFQLLPLTLAVSAAFTTTAFAAVSQPKVVLAGDTVVSDRQGAKIKTNVVTLREKDERTATDLRGLLQDEPAIGFGGGNGTSQFVSIRGMGHNAIDLKIDNAYQDGQLHYHQGRFMLDPEMVKVVSVQKGAGFASAGIGATNGAIVTKTLDANDLLANSSNPNFGAKVKASYSSNKGHGYGASAFGKTDNFDFVVSANVVNDSNYKDGSGREIEYSALDKKSYLAKAGVNLGDHRLSLSHLQESHKGVRPVREEFVNFDLKRQAPHQRDTYQKLTNLEWTGKNLGFANEAVANVYRLEHGRDSQSDLGNTYATNDSPEATDKKLADTPSNMHVVATGANLNFDTEFNHSLLKGFGVDHTLLKYGINYRHQEAVPPRSLKPGVVHQEKTDAGIYLEAVNQINDFTINTGVRVDRFDFKAMDGKKVGKTDINPSFGVIYDVNPNLSVSGNLIYATRSPRFADAILSRGYRGGVISIDDNAKAEKARNTEIGFNYNNGPYTAFGSYFWQRVDNARATADAVNHGTTDANGNPIKVPTLGNQGHQTNHGYELGVGYTEGAWRARAGVAHSKPTMHNVKFKGHSEYAVRTGRTWTADVAYRLPNPSVEFGVRHTLVEGVDAKDASIISGQLNTSRDGKTIYNREGYNVSDIYANWKPYGNDKVNVNFAVNNVFNKNYRPHTQNASENALPGAGRDFRVGVNFTY

SEQ ID NO: 19000 - protein, 760 aa, Moraxella catarrhalis
MANKFQLLPLTLAVSAAFTTTAFAAVSQPKVVLAGDTVVSDRQGAKIKTNVVTLREKDESTATDLRSLLQDEPAIGFGGGNGTSQFVSIRGMGHNAIDLKIDNAYQDGQLHYHQGRFMLDPQMVKVVSVQKGAGFASAGIGATNGAIVTKTLDADELLRNSDKDYGFKVGAGLSTNKGHSYHGSAFGKAQTGFGQVDALVSYNKVDDSDYKGGKGYTNLLGNDVVTRSALDKSSFLAKVGLTTGDHRFVVSHLNEVHKGIRGVREEFDFANRALTLDIKKGGKTRTEAELLTELDKKYPGQGYKLGSKTPDGKKYNVVDANGKLVADLDRNNPTQRETYQKLTNLEWTGKNLGFANEVTANVYKLEHGRNSSSDKGNSYILRVVPDTINDNGDSSSSMYVSAKGANINFDKEFNHSLLKGFGVDHTLLKYGINYRHQEAVPPRGIRPGFQHQEKTDAGVYLEAVNQINDFTINTGVRVDRFDFKAMDGKKVGKTDINPSFGVIYDVNPNLSVSGNLIYATRSPRFADAILSRGFRDGVISIADNAKAEKARNTEIGFNYNNGPYTAFGSYFWQRVNNARAAADAIQHPNDNTAQITYLGNQGHQTNHGYELGVGYADGAWRARAGVAHSKPTMHNVKFKANPEYAVRTGRTWTADVAYRLPNPSVELGVRHTLVEGVDAKDTSIMSGKFDDKDGAILNREGYNVGDIYANWKPYGNDKVNVNFAVNNVFNKNYRPHTQRASIDTLPGAGRDFRVGVNFTY

SEQ ID NO: 19001 - protein, 270 aa, Moraxella catarrhalis
MANIVDINNSHTFLLPKEIDLKTTLGFNYFTNEYSKNRFPEELSLFYVNESHDQGLYSLSKKGRYSGSKGLLPQRSVILQPSGKQKFKTVYFDTALSKGIYHLNYSVNFTHYAFNGEYVGYENTQNKINEPILHKSGHKKAFNHSATLSAELSDYFMPFFTYSRTHRMPNIQEMFFSQVSDAGVNTALKPEQSDTYQLGFNTYKKGLFTQDDVLGIKLVGYRSFIKNYIHNVYGDWSRDGVTPEWARLNGFRLTIAHQNYQPIVKKAELS

SEQ ID NO: 19002 - protein, 148 aa, Moraxella catarrhalis
HGPDANMVAVSLTWDWGKRWFTEGDWHLGGYWELTGAAWKGDGPSPEKELYAIGIAPVFRLQRFTPSGWLNPYAEAGIGAYQFSGRRVHGSLSMGTRFEFGSHVGLGVTFGDQQQYDLSYRFQHFSNAGITSENPGVNFNEIRFGYHF

SEQ ID NO: 19003 - protein, 646 aa, Moraxella catarrhalis
HMAVSQPKVVLAGDTVVSDRQGAKIKTNVVTLREKDESTATDLRGLLQDEPAIGFGGGNGTSQFISIRGMGHNAIDLKIDNAYQDGQLHYHQGRFMLDPQMVKVVSVQKGAGFASAGIGATNGAIVTKTLDADELLRNSDKDYGFKVGAGLSTNKGHSYHGSAFGKAQTGFGQVDALVSYNQVNDSDYKGGKGYTNLLGNDVVTRSALDKSSYLVKAGLTAGDHRFVVSHLNEVHKGIRGVREEFDFANRALTLDIEKNKKKRTEAELQAELDDKYAGKGYKLGSKTPDGKKYNVVDANGKLVDNLVGNNPTQRETHQKLTNLEWTAKNLGFANEVTANVYKLEHGRNSSSDKGNSYILRDVPNTINDNGDSPSNMHVSAKGANINFDKEFNHGLLKGFGVDHTLLKYGINYRHQEAVPPRGIRPGFQHQEKTDAGIYLEAVNQINDFTINTGVRVDRFDFKAMDGKKVGKTDINPSFGVIYDVNPNLSVSGNLIYATRSPRFADAILSRGFRDGVVSIADNAKAEKARNTEIGFNYNNGPYTAFGSYFWQRVDNARATADAVQHPTVTTAKITYLGNQGHQTNHGYELGVGYTEGAWRARAGVAHSKPTMHNVKFKANPEYAVRTGRTWTADVAYRLPNPSVELG

SEQ ID NO: 19004 - protein, 692 aa, Moraxella catarrhalis
LTLAVSAAFTTTAFAAVSQPKVVLAGDTVVSDRQGAKIKTNVVTLREKDESTATDLRSLLQDEPAIGFGGGNGTSQFVSIRGMGHNAIDLKIDNAYQDGQLHYHQGRFMLDPEMVKVVSVQKGAGFASAGIGATNGAIVTKTLDANDLLANSSNPNFGAKVKASYSSNKGHGYGASAFGKTDNFDFVVSANVVNDSNYKDGSGREIEYSALDKKSYLAKAGVNLGDHRLSLSHLQESHKGVRPVREEFVNFDLKRQAPHQRDTYQKLTNLEWTGKNLGFANEAVANVYRLEHGRDSQSDLGNTYATNDSPEAKDDKLADTPSNMHVVATGANLNFDTEFNHSLLKGFGVDHTLLKYGINYRHQEAVPPRSLKPGVVHQEKTDAGIYLEAVNQINDFTINTGVRVDRFDFKAMDGKKVGKTDINPSFGVIYDVNPNLSVSGNLIYATRSPRFADAILSRGYRGGVISIDDNAKAEKARNTEIGFNYNNGPYTAFGSYFWQRVDNARATADIVRHGTTDANGKPIKVPTLGNQGHQTNHGYELGVGYTEGAWRARAGVAHSKPTMHNVKFGGNPEYAVRTGRTWTADVAYRLPNPSVELGVRHTLVEGVDAKDTSIISGKLSTSRDGKTIYNREGYNVSDIYANWKPYGNDKVNVNFAVNNVFNKNYRPHTQNASDTTLPGAGRDFRVGVNFTY

SEQ ID NO: 19005 - protein, 146 aa, Moraxella catarrhalis
LTFYTLQGGIYWRANSHDTLTSHDGNDTGISPMGEVGLEYAVTKNWATRLDYQWVSNIGDAGTVGGRPDNGMLSVGVSYRFGQETPAPVVAPTPAPAPVVQTKLSRLKSDVLFTFNKAELRPEGQSSLDQLYTQLSTMDPKDGSVV

SEQ ID NO: 19006 - protein, 177 aa, Wolbachia endosymbiont
EILPFYTKVDGIQNPKDKEKDSPLTRSFIAGGGAFGYKMDDIRVDVEGLYSQLAKDTAVVDTSEANVADSLTAFSGLVNVYYDIAIEDMPITPYVGVGVGAAYISNPSKADTVKDQKGFGFAYQAKAGVSYDVTPEIKLFAGARYFGSYGASFDKAAKGDTGIKNVVYSTVGAEAGV

SEQ ID NO: 19007 - protein, 187 aa, Wolbachia endosymbiont
SYYIRLQYNGEILPLFTKVDGITYKKDNSDYSPLKASFLAGGGAFGYKMDDIRVDVEGVYSYLNKNNVTDARFTPDTIADSVTAISGLVNVYYDIAIEDMPITPYVGVGVGAAYISTPLKDAVNDQKSKFGFAGQVKAGVSYDVTPEVKLYAGARYFGSYGANFDKSVGEKDKGGHTVLYSTVGAEA

SEQ ID NO: 19008 - protein, 183 aa, Wolbachia endosymbiont
SYYVRLQYNGEILPLFTKVDGITYKKDNSDYSPLNGITYKKDNSDYSPLKASFIAGGGAFGYKMDDIRVDVEGVYSYLNKNDVTDAKFTPDTIADSLTAISGLVNVYYDIAIEDMPVTPYIGVGVGAAYISTPLKDAVNDQKSKFGFAGQVKAGVSYDVTPEVKLYAGARYFGSFGAHFDKDA

SEQ ID NO: 19009 - protein, 163 aa, Wolbachia endosymbiont
SYYVRLQYNGEVLPLFTKVDGITYKKDKSDYSPLKPSFIAGGGAFGYIMDDIRVDVEGVYSYLNKNDVKDVTFDPANAIADSVTAISGLVNVYYDIAIEDMPITPYIGVGVGAAYISTPLEPAVNDQKSKFGFAGQVKAGVSYDVTPEVKLYAGARYFGSYGA

SEQ ID NO: 19010 - protein, 185 aa, Wolbachia endosymbiont
SYYVRLQYNGEILPLFTKVDGITYKKDNSDYSPLKASFIAGGGGFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHYDKDAAAGKDKGELKVLYSTVG

SEQ ID NO: 19011 - protein, 185 aa, Wolbachia endosymbiont
SYYVRLQYNGEVLPFYTKVDGITNVTGKEKDSPLTRSFIAGGGAFGYKMDDIRVDVEGLYSQLAKDTAVVNTSETNVADSLTAFSGLVNVYYDIAIEDMPITPYIGVGVGAAYISNPSKADAVKDQKGFGFAYQAKAGVSYDVTPEIKLFAGARYFGSYGASFDRAAKDDTGIKNVLYSTVGAEA

SEQ ID NO: 19012 - protein, 189 aa, Wolbachia endosymbiont
SYYVRLQYNGEILPLFTKVDGITYKKDNNDYSPLKASFIAGGGAFGYKMDDIRVDVEGVYSQLSKNNVTGAVFNPDTVADSLTAISGLVNVYYDIAIEDMPITPYIGIGVGAAYISTPLKKAVNDQKSKFGFAGQVKAGVSYDVTPEIKLYAGARYFGSFGAHFDKDDIAVSKDKGELKVLYSTVGAEA

SEQ ID NO: 19013 - protein, 184 aa, Wolbachia endosymbiont
SYYIRLQYNGEILPLFTKVDGITYKKDNSDYSPLKASFLAGGGAFGYKMDDIRVDVEGVYSYLNKNNVTDAKFTPDTVADSVTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVG

SEQ ID NO: 19014 - protein, 157 aa, Wolbachia endosymbiont
SYYVRLQYNGEILPFYTKVDGITNATGKEKDSPLTRSFLAGGGAFGYKMDDIRVDVEGLYSQLVKDTAVVNACETNVADSLTAFSGLVNVYYDIAIEDTPITPYVGVGVGAAYISNPSKANEVKDQKGLGFVHQAKAGVRYDVTSEIKLSSGARYLG

SEQ ID NO: 19015 - protein, 163 aa, Wolbachia endosymbiont
SYYVRLQYNGEFLPLFTKVDGITYKKDKSDYSPLKPSFIAGGGAFGYKMDDIRVDVEGVYSYLDKNDVKDVTFDPANTIADSVTAISGLVNVYYDIAIEDMPITPYIGVGVGAAYISTPLEPAVNNQKSKFGFAGQVKAGVSYDVTPEVKLYAGARYFGSYGA

SEQ ID NO: 19016 - protein, 162 aa, Wolbachia endosymbiont
SYYVRLQYNGEILPLFTKVDGITYKKDNSDYRPLKASFIDGGGAFGYKMDDIRVDVEGVYSYLNKNDVTDAKFTPDTIADSLTAISGLVNVYYDIAIEDMPITQYIGVGVGAAYISTPLKDAVNDQKSKFGFAGQVKAGVSYDVTPEVKLYAGARYFGSFGA

SEQ ID NO: 19017 - protein, 196 aa, Wolbachia endosymbiont
SYYVRLQYNGEVLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTVGAEA

SEQ ID NO: 19018 - protein, 162 aa, Wolbachia endosymbiont
SYYVRLQYNGEILPLFTKVDGITYKKDNSDYSPLKASCIAGGGAFGYKMDDIRVDVEGVYSYLNKNDVTDAKFTPDTIADSLTAISGLVNVYYDIAIEDMPITPYIGVGVGAAYISIPLKDAVNDQKSKFGFAGQVEAGVSYDVTPEVKLYAGARYFGSFGA

SEQ ID NO: 19019 - protein, 189 aa, Wolbachia endosymbiont
SYYVRLQYNGEILPLFTKVDGATGAKKKTADTDTTTDLYKASFMAGGGAFGYKMDDIRVDVEGLYSQLSKDTLDVAPTPAIADSLTAFSGLVNVYYDIAIEDMPITPYVGVGVGAAYISTPLATAVSSQNGKFAFAGQARAGVSYDITPEIKLYVGARYFGSFGAHFDKDTAVASKDKGELKVLYSTVG

SEQ ID NO: 19020 - protein, 195 aa, Wolbachia endosymbiont
SYYVRLQYNGEFLPLFTKVDGITYKKDKSDYSPLKPSFIAGGGAFGYKMDDIRVDVEGVYSYLNKNDVTDAEFTPDTIADSLTAISGLVNVYYDIAIEDMPITPYVGVGVGAAYISTPLKTPINDQKSKFGFAGQVKAGVSYDVTPEIKLYAGARYFGSYGANFDGKKTDPKDSTKQVTDAGAYKVLYSTVGAEA

SEQ ID NO: 19021 - protein, 192 aa, Wolbachia endosymbiont
SYYVRLQYNGEILPLFTKVDGVTGLKKSANDKTDTTDLYTASFMAGGGAFGYKMDDIRVDVEGIYSQLNQDTTVTGTSVPAGGIAKNLTAISGLVNVYYDIAIEDMPITPYVGVGVGAAYVSNPLATKVTDGKASGFGVAYQAKAGVSYDVTPEVKLYAGVRYFGSYGANFGKTAKDDAGIKVLYSTVGAEA

SEQ ID NO: 19022 - protein, 189 aa, Wolbachia endosymbiont
SYYVRLQYNGEILPLFTKVDGATGARKKNADAATTTDLYKASFMAGGGAFGYKMDDIRVDVEGLYSQLSKDTLESAPDPAIADSLTAISGLVNVYYDIAIEDMPITPYIGVGVGAAYVSNPLATKVTDDKASGFGVAYQAKAGVSYDVTPEVKLYAGARYFGSYGANFDKTAKDDAGIKVLYSTVGAEA

SEQ ID NO: 19023 - protein, 186 aa, Wolbachia endosymbiont
SYYVRLQYNGEILPLFTKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLATAVSSQNGKFAFAGQARAGVSYDVTPEVKLYAGARYFGSYGANFDKTDKDGKGELKVLYSTVGAEA

SEQ ID NO: 19024 - protein, 187 aa, Wolbachia endosymbiont
SYYVRLQYNGEILPLFTKVDGITYKKDNSDYSPLKASFIAGGGAFGYKMDDIRVDVEGVYSYLNKNDITDAKFTPDTIADSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEV

SEQ ID NO: 19025 - protein, 177 aa, Wolbachia endosymbiont
LQYNGEILPLFTKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDAAAASKGELKVLYGT

SEQ ID NO: 19026 - protein, 188 aa, Wolbachia endosymbiont
SYYVRLQYNGEILPLFTKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARNFGSFGAHFDKDAAAGKDKGELKVLYSTVGAEA

SEQ ID NO: 19027 - protein, 163 aa, Wolbachia endosymbiont
SYYVRLQYNGEFLPLFTKVDGITYKKDKSDYSPLKPSFIAGGGALGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGA

SEQ ID NO: 19028 - protein, 162 aa, Wolbachia endosymbiont
SYYVRLQYNGEILPLFTKVEGITYKKDSSDYSPLKASFIAGGGAFGYKMDDIRVDVEGVYSYLNKNDVTGATFTPDTVADSLTAISGLVNVYYDVAIEDMPITPYIGVGVGAAYISTPLKEALNEQKNKFGFAYQAKAGVSYDVTPEIKLYAGARYFGSYGA

SEQ ID NO: 19029 - protein, 191 aa, Wolbachia endosymbiont
SYYVRLQYNGEFLPLFTKIDGVTGFKKTADTADTTDLYNASFIAGGGAFGYKMDDIRVDVEGIYSWLNKDTNVTGTSVPAGGVANNLTAISGLVNVYYDVAIEDMPITPYIGVGVGAAYINNPLVTKVTGDKDSGFGVAYQAKAGVSYDVTPEIKLYAGARYFGSYGANFGKAAKDDAGIKVLYSTVGAEA

SEQ ID NO: 19030 - protein, 185 aa, Wolbachia endosymbiont
  misc_feature (74)..(74): Xaa can be any naturally occurring amino acid
SYYVRLQYNGEILPLFTKIDGITNATGKEKDSPLKASFIAGGGAFGYKMDDIRVDVEGLYSQLSKDTTIINTSXTDVADSLTAFSGLVNVYYDIAIEDMPITPYVGVGVGAAYISNPSKVDAVKDQRGFGFAYQAKAGVSYDVTPEIKLYAGARYFGSYGASFDKTAKDDAKIKKVLYSTVGAEA

SEQ ID NO: 19031 - protein, 186 aa, Wolbachia endosymbiont
YIRLQYNSEFSPLNTKVDGITGAQKDSKDTNDLYKPSFMAGGSAFGYRMDDIRVDIEGLYSQLSKGALSRVPTPDIVDNLTAISGLVNVYYDVVIEDIPITPYVGVGLGVAYISNPAKAQVIADQKHGFGFAYQAKAGISYDVTPEIKLFAGARYFGSYGANFDKSEEVNKGTSEDKETKVTAGAY

SEQ ID NO: 19032 - protein, 185 aa, Wolbachia endosymbiont
SYYVRLQYNGEILPLFTKVEGITYKKDSSDYSPLKAPFIAGGGAFGYKMDDIRVDVEGVYSYLNKNDVTGAAFTPDTIANSLTAISGLVNVYYDIAIEDMPITPYVGVGVGAAYISTPLATAMSSQNGKFAFAGQARAGVSYDVTPEVKLYAGARYFGSYGANFDKTDKDKGEHKVLYSTVGAEA

SEQ ID NO: 19033 - protein, 186 aa, Wolbachia endosymbiont
SYYVRLQYNGEILPLFTKVDGMTYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLATAVSSQNDKFAFAGQARAGVSYDVTPEVKLYAGARYFGSYGANFDKTDKDGKGELKVLYSTVGAEA

SEQ ID NO: 19034 - protein, 188 aa, Wolbachia endosymbiont
SYYVRLQYNGEILPLFTKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYSTVGAEA

SEQ ID NO: 19035 - protein, 189 aa, Wolbachia endosymbiont
VRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKNSTGQAADAGAYKVLYSTV

SEQ ID NO: 19036 - protein, 190 aa, Wolbachia endosymbiont
SYYVRLQYNGEILPLFTKVDGITNVTGKEKDSPLKASFIAGGGAFGYKMDDIRVDVEGLYSWLNKDADVAGDTVADNLTAISGLVNVYYDVAIEDMPITPYIGVGVGAAYISTPLKTAINDQNSKFGFAGQVKAGVSYDVTPEIKLYAGARYFGSYGANFDKTSGANGKDKGGHTVFYSTVGAEAGVAFN

SEQ ID NO: 19037 - protein, 189 aa, Wolbachia endosymbiont
SYYVRLQSNGEILPLFTKVDGATGAKKKTADTDTTTDLYKASFMAGGGAFGYKMDDIRVDVEGLYSQLSKDTLDVAPTPAIAVSLTAFSGLVNVYYDIAIEDMPITPYVGVGVGAAYISTPLATAVSSQNGKFAFAGQARAGVSYDITPETKLYAGARYFGSFGAHFDKDTAAASKDKGELKVLYSTVG

SEQ ID NO: 19038 - protein, 167 aa, Wolbachia endosymbiont
FTKVDGVTGLKKKTTDTTDTTDLYTASFMAGGGAFGYKMDDIRVDVEGVYSQLNKDTTVTGTSVPAEGIANNLTAISGLVNVYYDIAIEDMPITPYIGVGVGAAYVSNPLAKKVTDDKASGFGVAYQAKAGVSYDVTPEIKLYAGARYFGSYGANFGKAAKGDAGIK

SEQ ID NO: 19039 - protein, 162 aa, Wolbachia endosymbiont
SYYVRLQYNGEILPLFTKVEGITYKKDSSNYSPLKASFIAGGGAFGYKMDDIRVDVEGVYSYLNKNDVTGATFTPDTVADSLTAISGLVNVYYDVAIEDMPITPYIGVGVGAAYISTPLKEALNEQKNKFGFAYQAKAGVSYDVTPEIKLYAGARYFGSYGA

SEQ ID NO: 19040 - protein, 162 aa, Wolbachia endosymbiont
YVRLQYNGEILPLFTKIDGIKNAAGKEKDSPLKASFIASGGAFGYKMDDIRVDVEGLYSQLSKDTTIINTSETNVADSLTAFSGLVNVYYDIAIEDMPITPYVGVGVGAAYISNPSKADAVKDQRGFGFAYQAKAGVSYDVTPEIKLYAGARYFGSYGASFD

SEQ ID NO: 19041 - protein, 196 aa, Wolbachia endosymbiont
SYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDVAIEDMPITPYIGVGVGAAYISTPLKTPINDQKSKFGFAGQVKAGVSYDVTPEIKLYAGARYFGSYGANFDGKKTDPKDSTKQVTDAGAYKVLYSTVGAEA

SEQ ID NO: 19042 - protein, 185 aa, Wolbachia endosymbiont
  misc_feature (9)..(9): Xaa can be any naturally occurring amino acid
  misc_feature (24)..(24): Xaa can be any naturally occurring amino acid
  misc_feature (39)..(39): Xaa can be any naturally occurring amino acid
  misc_feature (73)..(73): Xaa can be any naturally occurring amino acid
  misc_feature (124)..(124): Xaa can be any naturally occurring amino acid
SYYVRLQYXGEILPFYTKVDGITXATGKEKDSTLTRSFXAGGGAFGYKMDDIRVDVEGLYSQLAKDTAVVNAXETNVADSLTAFSGLVNVYYDIAIEDMPITPYVGVGVGAAYISNPSKANEVXDQKGFGFAYQAKAGVSYDVTSEIKLFAGARYFGSYGASFDKAAKDDTGIKNGGYSTVGAEA

SEQ ID NO: 19043 - protein, 162 aa, Wolbachia endosymbiont
SYYVRLQYNGEILPLFTKVDGITYKKDNSDYSPLKASFIAGGGAFGYKMDDIRVDVEGVYSYLNKNDVTDAKFTPDTIADSLTAISGLVNVYYDIAIEDMPITPYIGVGVGVAYISTPLKDAVNDQKSKFGFAGQVKAGVSYDVTPEVKLYAGARYFGSFGA

SEQ ID NO: 19044 - protein, 130 aa, Aeromonas hydrophila
MELVYGSVSGKSFSWEDRGMALSMKDKDYNPLIGRTGVDVGRTFSGDDWKITARAGLGYQFDLLANGETVLQDASGEKRFEGEKDSRMLMNVGMNAEIKDNMRFGLELEKSAFGKYNVDNAINANFRYSF
